United States Patent 11,098,302 (IDENTIFICATION OF POLYNUCLEOTIDES ASSOCIATED WITH A SAMPLE) - sequence listing, part 26

SEQ ID NO: 86093 - DNA, 821 bp, Homo sapiens
  misc_feature: GYAE6OF01C6BIB.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctcctcccaggttgtactgactcaatccgccctctgccctctcgccctcccgtgggacgccctcggtaccaacctcacctgcgttcttagtacgtcaaacacgaattactaacaccgtcgcgtgcatacaaacaacgagccggaagaacggtcctcgactacttaatagaagagttcggcctaagttttggacgaacggaccaaccgaaccggtaacgggggttccgggaactaccccgtggaacgtccgaccgtttcgtccgggccttaccgacggtccgtcggtcgggggacccgaacggccggtaccgtaacccgttacccgaaacccgttacgtaccttacccgtaaccgcccctttaaccccggaagtttaccgttaacggaaacgtaaggttcgggaaacgggtccgtaacggtaacgttaactttaccggttagttacgtaacgaccgtaagtacggggaccgtacggcggtacggttcgtacgggtcgttcgggttccggggacgggaaccggggtaaccaaacggtccgtacggtaacccgggttaccttaacggggtaccgaacccggtacccgtaaaccgggccgttaccccgtacccccggtcggttaccccggtaacttcccggttccgtttccccccggacccccttttcccgttaaccgtaacccggttaccgg

SEQ ID NO: 86094 - DNA, 968 bp, Homo sapiens
  misc_feature: GYAE6OF01D43ZA.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccagtgggagttggggctgagcgtggtccttttccttgttgtcttagttttagaaggtgtaccagtgtgaggtgcgccgtggtaggagtcgggtcggggggtccttggtccgtaggccgggttcggggggtccctggacgtaccgtccggtccgttggtcgaccgacgtccgtcgtaggtacgttcggtaaggtttcggacgtccttacgttgtaccgtaggtaccggttccgggtaccggacccggacggtccgtaccggggaagggggacggggtcggtacggggtagggttgggggtaccggaccgtaacggtaccgtaacgtaaccggtaaaaccgggaaacgggtaaccggaaaccgttaaaaggtttaaaacgggtttaaagttttacggttacgggttacccgggttacccgtttacggttacggggtaacgggtaaacccggggttacccggttaaaccgtttacccgtaaacccgttaccgttacccgtaaccgggtaaacggtaaaccggtaacccgtaaaaccggtttaccgaaaaaccggttaacccttaccggttaacccgttttggtttaacccgtacggtaaccgtacgggttaacggtaccgggtaacctaaccgggtccggttaacgggacccgggtaccggtaacccggggtaacgtaacccggtacgggtttcctttacggttaaccgttttcgtttaccggttagggtaaccgtaccgggtaacgggtaaacggtaacggtaaacgttaacccgtttaaaccttacgggttaaactttaccgggttttaattaacggtaaggttaacggttaaacggg

SEQ ID NO: 86095 - DNA, 687 bp, Homo sapiens
  misc_feature: GYAE6OF01DBDI8.22.30.C08.1.454.CMB.1.raw
  modified_base (187)..(187): a, c, t, g, unknown or other
  misc_feature (187)..(187): n is a, c, g, or t
tcagacatacgcgtcacgaccggtgctcgatttagtctgacgtcaaaggggaaaggggggagctctggggagtctgcaccatggcttggacccactcctcttcctcaccctcctcctccactgcacagggtctctctccaggttgtactgactcaatcgccctctgcctctcgcctcccgtgggacncctcggtccaacctcacctgtcgtttcttagtagtaccaacacgtattactacaccgtcgcgtgcatacaacacaggccggagacggccctcgctactaatgaagtagtgcctagttttggacacgaccaccgacgtaagggggtcggactcccgtgactcgcttcgtcggctcgacgctcgtcgggcgcgcgtcctaccgtccaccatcctccacgtcctccagttcgtagaagagttaggacggtcgtacgtaacttaacgtttacgtgttacgaaggtacctaagggtcggggaaccgtcggttcgggtaccgttcggtacgggtcggttcgggttcggggaccggggacggggaaccaagggtcgtaccgggtacccgttccggtacggttaccgacgggacccgtaacggtccgtacccggttccccggttcggaccttaccggttccctttcccggttacccccctacccgttccccggctcccgggttaccgg

SEQ ID NO: 86096 - DNA, 847 bp, Homo sapiens
  misc_feature: GYAE6OF01B6Y8E.22.30.C08.1.454.CMB.1.raw
  modified_base (185)..(185): a, c, t, g, unknown or other
  misc_feature (185)..(185): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccagtgggagttggggctgacgctggtcttttccttgttgtcttatttagaggtntccagtgtgaggtgcgcgtggtgagtcggtgggggccttggcnggcggtcgggggtccngcgctcgctgtcgcnctccgtgtgtagttcggtaggtttacggacgtccttagtcggttnttacggtaccgttccggggccgtcggacggtcccggtacgggtaagggggacgggtcggtaggggtacgggtcggggtcggaccaggtactaaccgtaaccggaaacggaacggaacggtaaacgttaaacggtttaaagggtttaaattttacggtacggttaccggtcccggttggttaacgggtacggggtaaacccgggtcccttaacgttaaccctaaccgttacgtaacccggttaacccgaaaacgggaaccgtaaacccctaaaacggggttaaacccctaaaacggttaacccttcgttaaccggttttcggtttaaccacggaacgtacggtacggtccggtaaccaccgggtcccgtaagggaacccggtccgggaccggggtaaacggccgtacgggttcttacgtttcgtttacggtttaccggttaggtaggtaaccgaaggggttaaggaaccttaaggtaaaccctttaacgttaaccgggttttaatttaaccggttttagtaacggtaaggttaaccgttaaggg

SEQ ID NO: 86097 - DNA, 742 bp, Homo sapiens
  misc_feature: GYAE6OF01AOJ9F.22.30.C08.1.454.CMB.1.raw
  modified_base (187)..(187): a, c, t, g, unknown or other
  misc_feature (187)..(187): n is a, c, g, or t
  modified_base (367)..(367): a, c, t, g, unknown or other
  misc_feature (367)..(367): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctcccgtgggacncctcggtccaacctcacctgtcgttcttagagtcaacacgtattactacaccgtcgcgtggcactcaacaacgagccggaggaacggccctcgactactaatgaagtattcggacctagtttcggcacgccaccacggaacgggggtcggactccgtagtactcgcttcgtcggctccgngtcgtcgtcggggccgagccgtctacctcaccacgtctccgacgtcctaccgtagtcgtacgtaagacgtacggacggtctacgtaacgttattaacgtcgtaacgaacgtaccgtagttacggggaccgtacgttacgggtccgttacgttcgggtacgttcgggggtaccgggtaccgggggtaaccgggtaacccgtaacgggtaccgttaccgggtaacccggttacccggtacgggtacccgaaccgggtaccccggaaacgggtcccgtaccccggtacccccgggttaccggtaccccgttacccgttacccggtttccccggttacccccgtaccccgttccccgttaccgtcccgggttaacccgg

SEQ ID NO: 86098 - DNA, 697 bp, Homo sapiens
  misc_feature: GYAE6OF01DBTSV.22.30.C08.1.454.CMB.1.raw
  modified_base (185)..(185): a, c, t, g, unknown or other
  misc_feature (185)..(185): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgcctctgcctcccgtgggacncctcggtcaacctcacctgcgtttcttagtacgtcaacacgtattaccacaccgtcgcgtggcatcaaacaacagccggagacggcctcgctactaatgaagtatcggctagttttggcacgccaaccgaacggaagggggtccgggaactcccgtagtacgtcgcttcgtcgggcctccgagtctcggtcgggcggacgcggtacctaccgtccacctaactcctaccgacgtccctaccgtacgttctacgagtactggtacggtctacggtaaacttacgttaacgtacggttaacacggaaccgtacggtacgggaaccggtcggtacgggtccgtacggtcgggttcgtcgggtttacgggacgggtaacggggtaccgaacggtcgttaccggtaccgttaccgtacggttaccggaccgtaccggaacggtccggtaaccggccccgtcggtacctaccgttccgttacccgtaccccgtacccgtccctccgtcgttaacccgg

SEQ ID NO: 86099 - DNA, 836 bp, Homo sapiens
  misc_feature: GYAE6OF01D51HZ.22.30.C08.1.454.CMB.1.raw
  modified_base (188)..(188): a, c, t, g, unknown or other
  misc_feature (188)..(188): n is a, c, g, or t
  modified_base (786)..(786): a, c, t, g, unknown or other
  misc_feature (786)..(786): n is a, c, g, or t
tcagacatacgcgtcacgaccggtgctcgatttagtctgacgtcaaagggaaagggggagctctgggggagtctgcaccatggcttggaccccatcctcttcctcaccctcctcctccactgcacagggtctctctcccaggtttgtactgactcaatccgccctctgcctctcgcctccgtgggacncctcggtccaacctcactgtcgttcttaagtacgtacaaacacgtattacctacgaccgtcgacgttggaccatccaaacaacgaggaccggagaaccgggtccctacggaccttaacgttaataggaagtaattcgggacctaagtttttcgggaccaacggtaccccgaaccgaaccgggtaaacggggggggttccggggaaccttccccgtagggtaacttccggtacggttttccggtccggggtacctccgtacggtccgttaccgggtcggggggacccgtaacggccccgggtacccttacccgttaccgaaacccctcttccccgtaacccgtaaccgtccccgttaccgtacgttcgtaaggtaaacggtaacgttacggaccggttacgtacgtaaacctttagttaccgtacggtactaaccggaccgttaaggtcgggtaaccgtcgttaccggggtgttcccggtcgggtcgttcggggtcggggaaccgggtaacggggaccctaacggtcggttacccggaccggttacgtaccggtacgaccggaccggacggtcctacccggttccccgtcggttacccnccgttacccttccgttaacccccgccgtttaccgccggtacgttacccgg

SEQ ID NO: 86100 - DNA, 825 bp, Homo sapiens
  misc_feature: GYAE6OF01BMO9N.22.30.C08.1.454.CMB.1.raw
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaactcgccctctcgcctctcgcctcccgtgggacgcctcggtaccaacctcacctgtcgtttcttagtacgtacaacacgtattactacnccgtcgcgtcggcancaacacacgcggagacgcctcgctactaangaagattcgccttagtttggcacgccaccgacgaacgggggtccggactccgtagtacgtccgtctttaccgtcgggtcctaccgacgtccgtcggtccggggcgacggacccgtaccttacccgtaccaacccgtaccttccgtacccgtacccgtccccgttaaccgtaccggttaccgtacgggtaaagttacggtacgggtacggtaccgttaaccggttaacgtttaaccgtttaccggtaacggttaaccctaacgggtaaccggtaacggtacgggggacccgttccgggttacggggtacccggtttcccgggtcgggtttcccgggttacggggtttacccgggggaacggggtaccgggaaacccgtaggtacccgttaccgggtacccgtaccggtaccggtaccgaccggacccggtaacgggtcccgttacccccggaccccggttccggttaccccttaacccggttccccttacccggttacccccttacccccgtttcgaaccccggtcgttaccccggg

SEQ ID NO: 86101 - DNA, 624 bp, Homo sapiens
  misc_feature: GYAE6OF01AKWJ1.22.30.C08.1.454.CMB.1.raw
  modified_base (185)..(185): a, c, t, g, unknown or other
  misc_feature (185)..(185): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
  modified_base (386)..(386): a, c, t, g, unknown or other
  misc_feature (386)..(386): n is a, c, g, or t
  modified_base (468)..(468): a, c, t, g, unknown or other
  misc_feature (468)..(468): n is a, c, g, or t
tcagacatacgcgtcacgaccggtgctcgatttagtctgacgtcaaaggggaaaggggctcagagaggagccttagccccggactccaaggcctttccacttggtgatcagcactgagcacagaggactcaccatgggattggggctgagcgtgtctttcctgtgctatttagaggtgtcagtgngaggtgcgcctggtggagtcggtggggggccttggccaggccgtgggggtcctgacgctcgctgngcncgctgtgtatcgagtttgacgctactgtctgacgttcggccnccgaggtcgacgaggggagggtcngggaggtcgggngacctaggacaatccgaaacggacggtacgaacgtaagttaaggttaattttcgnggtcggaccttgtggtagggaccggtccgtatttacccactaacgtccgtaaccaggacgaaccaacgtacgtaaacgtacncccttagttcgttctagaccgtagtacgtggacctccgacgcggacgacggtcggaaccgtcgtaccgtactagttcgttacttcgtcgtaggtcgaaggtacgacgtagaacgttaccttaagtactttacgttagttaactaggtaagtaacgg

SEQ ID NO: 86102 - DNA, 809 bp, Homo sapiens
  misc_feature: GYAE6OF01B4T8H.22.30.C08.1.454.CMB.1.raw
  modified_base (184)..(184): a, c, t, g, unknown or other
  misc_feature (184)..(184): n is a, c, g, or t
  modified_base (259)..(259): a, c, t, g, unknown or other
  misc_feature (259)..(259): n is a, c, g, or t
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
  modified_base (731)..(731): a, c, t, g, unknown or other
  misc_feature (731)..(731): n is a, c, g, or t
  modified_base (787)..(787): a, c, t, g, unknown or other
  misc_feature (787)..(787): n is a, c, g, or t
tcagacatacgcgtcacgaccggtgctcgatttagtctgacgtcaaagggaaagggggagctcgtggggagtctgcaccatggcttggaccccactcctcttcctcaccctcctcctccactgcacagggtctctctcccaggttgactgactcaatcgccctctcgcctctcgccgttcccgnggggacgtcccgtccggtaccaaccctccgtaccctggtcgtttacgttagtacgtacaacacgtacttactacnccggtgacgtggctatacaacacgaggaccggtaggaacggccctcgacttactagtacgaagtagttcggtcctaagttttggccagacccgaaccgaggtaacgggggtaccggtacgtacccgttggaccgtcgtcgttacgcggtcnccgtacgcgttacggcgggggacacggaccgtccttaaccnccacgtaaccttccgaccgtaccgtcccttaacgacgtaccggttaagaaacgtcggtacggttacgggacttaacgttaacgttacgtttacgtacggttaacacgggaacgttacggacgggtaccggacggttccgggtacggttaccggttacggtccgggtttccgggtttaccggggggaccgggtaacccggggttaaccgtaccggttaccgggtaccgtaccgggttacccggtttaacggaccgaaccggttacccgaacgggtttcccncccggtacccccgttagtccccgtacgttcccgttaccccgtaccccgttaccccncccggttccgaacggttcccgg

SEQ ID NO: 86103 - DNA, 696 bp, Homo sapiens
  misc_feature: GYAE6OF01AQ3IP.22.30.C08.1.454.CMB.1.raw
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (445)..(445): a, c, t, g, unknown or other
  misc_feature (445)..(445): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgcctccgtgggacgcctcggtccaacctcacctgcgttcttagtagtcaacacgtattaactacaccgtcgcgtggcatcaacaacncgaccggagacggcctcgctactatgaagngttgctatttaggcacgccaccgacggaagggggtcggactcccgtgactcgacttcgtcggctcgagtctcggtcggggaccaggccgtccgtaaccgtccacccgtactccgtacccgacgtacccgtccgtacgttcccgtagtaaccgggtntaccggaacgggtctacgtaacgtttattaaccgtcgtaaccgaacggtacctagggtcgggaaccgtggtacggtcgttcgtgggttccgtacgggttcgggcgggtacgggaaccgtaggcccgtacggtacccggtccgtacgggtaccacccgggaccgtaacgggtcccgtaccccggtccccggttaaccggccttaccgttcccgtacccgttaccccctacctcccgttaccgccggttaccg

SEQ ID NO: 86104 - DNA, 894 bp, Homo sapiens
  misc_feature: GYAE6OF01BLBN3.22.30.C08.1.454.CMB.1.raw
  modified_base (187)..(187): a, c, t, g, unknown or other
  misc_feature (187)..(187): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctcgcctctgcctcccgtgggacnccgtcggtccaacctcactgtcgtttcttagtacgtccaactacgtaatttactaccacccggttcggcgttggccataccaaacgaacgacggtacccggaaggaaccggggtcccctacggtaccttaaactttaaaccgtaggtaaaacgtaacgttcgggtacccgttaagttttttcggaccgtacgaccccgtaaccccgaacggggtaaaacggggggggttccgggtaaccgttccccgtaggtaacgtccgtccgtttccgtcccggggtacctcccgtagcccgttcggtcgggggacccgaggacccgtccttaacccgtacctacccgtaacgtttccctaccgtaaccgtcccgtacccgtcggttacctacgggtaacgaacggttcggtaaaccgggtcgtttacggtaaacctttcgttttaacccgtgggttaacctaaaggaccgttacgggtacgggtaccgtcggtcgggtacccggtttcgtcgggttcgttcgggtaccggggtacgggtaccggggtaccgtaccggtccgttaaccggggtacccgttaacccgttaagggcccgtaacggcccgggtaaacggtccccgttacccgggtacccccggttccggtaccggttacctttccccggtaccggtttccccccgtacccttaccggttccccggacggttacccggg

SEQ ID NO: 86105 - DNA, 758 bp, Homo sapiens
  misc_feature: GYAE6OF01DDLC8.22.30.C08.1.454.CMB.1.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (290)..(290): a, c, t, g, unknown or other
  misc_feature (290)..(290): n is a, c, g, or t
  modified_base (357)..(357): a, c, t, g, unknown or other
  misc_feature (357)..(357): n is a, c, g, or t
  modified_base (490)..(490): a, c, t, g, unknown or other
  misc_feature (490)..(490): n is a, c, g, or t
  modified_base (561)..(561): a, c, t, g, unknown or other
  misc_feature (561)..(561): n is a, c, g, or t
tcagacatacgcgtcacgaccggtgctcgatttagtctgacgtcaaagggaaaggggctcgagagaggagccttagccccggactccaaggccctttccacttggtgatcagcactgagcacagaggactcaccatgggattggggctgaggtcgtgtcgttccgtaggtcgtctaatttaggagtgtacngtgtgaggcgngcctggtagactcggtgggggccttgggccagtccgtcggggtccngagctcggtctgnacgncctntaggcttgagttgcacccttntgtctcgtacgttccggccgacgaacgcgtaccggaggggaggttcagggtccgtgggactacccgngacggatacggaaccgtaagaccggtaattagtaaaacggtttaatttccggtgaacggttacccctgtttaaggggtaggaacgggtaccctaaagtttccccgaacgtacccttacgggtaacccggtaanaacgtaaacccgtaacaaccggttaacgtaaccttaccgtacctttaagtaccgtaggaccgtaaggttanaccggtactacccgggaacccgtagggaacccggtaacgtaccggggtaaggttacctacccggttaacgttacgttaaccgttttacgtccggttacgaaccgtaaacgggtaacgtaccgggtaacttaacccgtttaaacgtccctttaggtaaaccttttacggtttacccgtaaacgcggttaaacgttaag

SEQ ID NO: 86106 - DNA, 722 bp, Homo sapiens
  misc_feature: GYAE6OF01DG5XN.22.30.C08.1.454.CMB.1.raw
  modified_base (233)..(233): a, c, t, g, unknown or other
  misc_feature (233)..(233): n is a, c, g, or t
  modified_base (405)..(405): a, c, t, g, unknown or other
  misc_feature (405)..(405): n is a, c, g, or t
tcagacatacgcgtcacgaccggtgctcgatttagtctgacgtcaaagggaaaggggctcagagaggagccttagccccggactccaaggccttccacttggtgatcagcactgagcacagaggactcaccatggagttggggctgagctggtctttctgtgctatttagagtgtcagtgtgagtgcgcgtggtgatcggtggggggcctttggccagccgttcgggggtccnggagactcgacctggtcgcagtcctcgtggtacgttcgagttggactacttactgtctgtacgtcgggccaccgtggtcctacccggtaagggggacgggtccgtgggtacggttcgggtacgggacctgggacacgtacgaaacgtacgacggtacaagtaagtaatttgngtacgtctcgttgacgggttaacgccgtatccgtacagttcctaaccgagaaccggtaacaaccgggtaactaacgggtaacccttaccgtacgttacgtttccgtaacggtgaacggtttaacgaggggttaacccaccgggttcgtaacggcggtaaacccggtcccggtaacgggtacctaccgggtacttacgtccggttttaaccttcgggttactagggttaacccggtaaccgaggtaacggtaaccgttaaccgttaaacgttacccgtagttttaaccctttattacgggtaacgtacgttaaccggg

SEQ ID NO: 86107 - DNA, 724 bp, Homo sapiens
  misc_feature: GYAE6OF01B9IV9.22.30.C08.1.454.CMB.1.raw
  modified_base (287)..(287): a, c, t, g, unknown or other
  misc_feature (287)..(287): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgcctctcgcctccgtgggacgcctcggtcaacctcaccgtgtcgttcttagtagtcaaacacgtattactacaccgtcgcgtgcatacaacaacgagccggagacggccctcgactacttaangaaacgtagttcggcctattttcggcacgcccaaccgacggaagggggtcggactcccgtgactcgtcttcgcgggctccgacgctcggtacggggccgaggccgtaccgtaaccctcaaccctacgtcctcccgacgtcccgtcctacgttcgtaacgaagtacgtcggacggtcgttacggtacttaacgtttcgtagtaccgaacgtaacgtaaggttaccggggacgtccggttcgggtccgttcggttacgggtccggtttcgggtaccggggacgggtaaccgggtaaccgtaaccggtccgttacgggtacccgttaccggtaacgggtcctaaccggacccgtaacggtcccgtaccccgttaccccggttacggtcccgtaaccgttccttacccgttcccccacccgttccctacgtccggttaccg

SEQ ID NO: 86108 - DNA, 747 bp, Homo sapiens
  misc_feature: GYAE6OF01DL669.22.30.C08.1.454.CMB.1.raw
  modified_base (183)..(183): a, c, t, g, unknown or other
  misc_feature (183)..(183): n is a, c, g, or t
  modified_base (189)..(189): a, c, t, g, unknown or other
  misc_feature (189)..(189): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcacagtgggagttggggctgagcgtggtccttttctgtgtctatttagagtgtcngtgtgnggtgcgcgtggtgagtcggtgggggccttggccaggtccggtcggggtccctgacgccgtccgcgtgtgcgcgtctcgtggtgttcgtaggtttggacgtccttagtcgtcgtggtacggttcgggcccgagacggtccgtacgggagggggtaagggtcggttaggagggttcgggtaccgaccgagaccgtagtaaaccggaaacggacggaacggtaacgttaagttaaacgtttaagttttagcgggttcgtacccgtgttagggtacggggaaccgtcgttaatacccgaaccgtcgttacccaaccggtaacggtaacgtaacctaacgtacgaaacgtaaccgtactacgtttcgttacgtacgacgtagtacggacggactccggcgtcggacggacccggaccggtaacggtaccgtcgttcgttacgttcgtttactttggtacgttacgtacggtaacggtaacggtcggtaaactttaaccggtaacgtttaaaccgtttaacgttttaactttacggtttaaacgttagggtaagtttaaacccg

SEQ ID NO: 86109 - DNA, 868 bp, Homo sapiens
  misc_feature: GYAE6OF01AL5PO.22.30.C08.1.454.CMB.1.raw
  modified_base (167)..(167): a, c, t, g, unknown or other
  misc_feature (167)..(167): n is a, c, g, or t
  modified_base (191)..(191): a, c, t, g, unknown or other
  misc_feature (191)..(191): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctcctcccgaggttgtactgactcaatccgccctntcgcctctcgccctccgtgggacnccgtcggtaccaacctcaccgtcgtcgttcttagtacgacctaacacgtacttacctaccaccggtcgacggtcggacaactaccaaaccaacggaccggaccgggtaaggaaccggggcccttacggtacttaactttaagaggtaaacgtacgtttcggacctttagtttcggaccgacgacccaaccggacggggtaacggggggtaccggaccttccggtagaacgttccggtacgtttccggtacccgggactccgaacggtccgttcgggtacgggggaccgtacggtccctacctacccgtaacgacccgttacttcccgaccccggtcctaacccgttaccgtcgttaaccggtaggtaaaccggtcgtaccgggaagttccgtaacgttactttaacgtaccggaccttacggaaccgtacggacgggttccggaccggcggtccggttacgttcggtacggtccggttacgggtaccggggaaccggggtaacctaccgggttagtcccgtaccggttacccggtccggaccgtaacggcccgtaacccggaccgttcccccggttaccccgggccccgttttaccggaccccgttacccgtttccccggttacccccgtttaccccccctacccggtttaacccggtccccggttaaggttcccgg

SEQ ID NO: 86110 - DNA, 678 bp, Homo sapiens
  misc_feature: GYAE6OF01A54LY.22.30.C08.1.454.CMB.1.raw
  modified_base (280)..(280): a, c, t, g, unknown or other
  misc_feature (280)..(280): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggcctcgctacttaangaagtattggcctagttttcggcacgccaccgacggaagggggtcggagtcccgtgactcgcttcgtcggctccgacgctcgtcggggcgagccgccgtacctcgaccctatcctcccgacgtccctccgtacgtaccgtacggaaggtcgtaggacggtcgttacggtaacttaacgtttaacgtacgtactaacggactaaggtcggggaccgtcgttcggggtccgttcggtcggtcgttgggttccggggacgggtacgggaaccgtacgtcgtacgtacccggtcgtcggtaccacggcccgaacggtccgtcccggtacccccgtcgggttacccctaccggttcccgtttccccgttcccccaccccgtttccccgtaccgtacccgtcgg

SEQ ID NO: 86111 - DNA, 651 bp, Homo sapiens
  misc_feature: GYAE6OF01DWACX.22.30.C08.1.454.CMB.1.raw
  modified_base (128)..(128): a, c, t, g, unknown or other
  misc_feature (128)..(128): n is a, c, g, or t
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (333)..(333): a, c, t, g, unknown or other
  misc_feature (333)..(333): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (638)..(638): a, c, t, g, unknown or other
  misc_feature (638)..(638): n is a, c, g, or t
tcagacatacgcgtcacgaccggtgctcgatttagtctgacgtcaaagggaaaagggggctcagagaggagtccttagccccggactaccaaggcctttccaccttggtgatcagcactgagcacagnggactcaccagtgggattcgggggacttggaggcggtcgtcgtttccgtaggtcgctagtttaggagtntcagtgtgaggtgcgccgtggtggatcggtgggggccttggccagccggtggggtcctgacgctccgactggcncgagcctacgtaggtccttggtaagttcggaactccttactggtaacctgacgtttgggccncgtacggctaccggagggaggccgtagggnggtacggnggcccaggtcatacgaagacgtaccggatgtaaacgtagtttagccgtgcccgtgtaggacgaaacggtntcctacggaacctnccgacgacggaactacaacgtacgtaanactaaccgtnttactgtacgagtacgtacgaacgtcacgtaccgaagccgaaccgacgggttggaaccgtaaggccgttgttcccttagtacggttacgtacgtagaacgtagtaccgtagaacttcgtaaaccggttattaggttactaacggntaacccggttagg

SEQ ID NO: 86112 - DNA, 707 bp, Homo sapiens
  misc_feature: GYAE6OF01DCK45.22.30.C08.1.454.CMB.1.raw
  modified_base (473)..(473): a, c, t, g, unknown or other
  misc_feature (473)..(473): n is a, c, g, or t
tcagacatacgcgtcacgaccggtgctcgatttagtctgacgtcaaagggaaagggggagctcgtggggagtctgcaccatggcttggaccccactcctcttcctcaccctcctcctccactgcacaggtctctctccgaggttgtactgactcaactccgtccctctcgcctctcgtccctccgtgggacgtccgtcggtaccaacctcctaccgttcgtcgtttacgttagtacgtaccaaccgtacgttacttaccaaccgtccgtcggtcggtcgtacaacgtaccaaaccgaacgacggaccggaacggaaccggacccttacgtaccttaattaacgtagaacgttagtcgtacgttagtttcggcgaccggacccaccggtaaggtacgggggtaccgtctacccggagtacgttccgtacgttccgtccggcctcgacgtcgtcggcggccgcgtcaccctaccncgacctacgtccacgccgtaccctcgtagtacgacgtacgagtcggacgtcgtattaccgtagtttacagtacgtaacgtacgtacgggccggtacgtacgtcgggttccgtggtacggttcggtacgggtccggacggacggacgtcgcgttaccggcgtacgtcggacaccggtccgacgccgtcccgtccgtcgtcctccgtcctaccctacccgtccacgccgtagtccg

SEQ ID NO: 86113 - DNA, 775 bp, Homo sapiens
  misc_feature: GYAE6OF01BWY2U.22.30.C08.1.454.CMB.1.raw
  modified_base (542)..(542): a, c, t, g, unknown or other
  misc_feature (542)..(542): n is a, c, g, or t
tcagacatacgcgtcacgaccggtgctcgatttagtctgacgtcaaagggaaagggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatcgtggggggccttggtccagccgtgggggtccctgagactcgcctgtgcagcctcgtggattcgagtttggagcctactgtctgacttgggtcccgcaggcctccgaggggaacgggcgtgggaggtgggtcggcccaggcacgtaccgaaacggaaggaaccggtacaaggttaaaggttaattttagtggttacgggtaccttcgtgggttacggaaacgggggtccctaagtttaccgaacccgtagttaccccgttacccgaaagggacgtaaacccgtaaccggttaacaaaacggttaaccttcccgtaacgtttacgggtttttaccncggtaccaaagggttactacgggaacccgtcgtaccgttacgggaaccggtacggacccggggtaaacggaacccgttacccggggtccgttttaagggttccctttaacggttttccgttacgggttaaccggttaaccgaacgggtaaacggtaacccggtaagttaaccgttaaacccgttaacgttaagttttacggttatttaaccggtaggtaaacgtttaaaccgg

SEQ ID NO: 86114 - DNA, 812 bp, Homo sapiens
  misc_feature: GYAE6OF01BIVXR.22.30.C08.1.454.CMB.1.raw
  modified_base (221)..(221): a, c, t, g, unknown or other
  misc_feature (221)..(221): n is a, c, g, or t
  modified_base (437)..(437): a, c, t, g, unknown or other
  misc_feature (437)..(437): n is a, c, g, or t
tcagacatacgcgtcacgaccggtgctcgatttagtctgacgtcaaagggaaaggggctcagagaggagccttagccccggactccaaggcctttccacgttggtgatcagcactgagcacagaggacctcaccatgggtagttcgggctgaggcggttcggtcgtttttacccgtaggttcgacgttaattttaggaaggtgtccgagttgtggaggtcncggtcctggtccggtaatcgggcggggggtccttggaccgcggtccggtcggggggtaccctggaacgtccgtcgtccgttggttctacggactccggttacgtgtagttccggtaaggttttcggacggttaccctttaccgtcgtccgttagtaccggtttccgggtaacgccgaccggccgttacccggacggggtaagggccgttaaggggngggtttccgggcgacccgagaccgttacgtaccggaaacgaaggaccggagtaagtaaacggttattagtcggtcggacttcggtaacggtgggaacgtcgacttacgaccttagcctacgacgactacgaaccgttacgaagtaccgttacgaacgttcgttacgtacgagtacgtagtacgacgaacccggttggcccgtaacgtacccggacgggttaaccggaccccggtaagggtcgttacccgtacgttttacggttccgtaaacgggttcccaaagggtttacgaaaacggggttttcccgaggttaaaccctaggtaacctttaaccgttaactttacgttaaaggtcggttaaaacgttaacccgg

SEQ ID NO: 86115 - DNA, 773 bp, Homo sapiens
  misc_feature: GYAE6OF01EGZAR.22.30.C08.1.454.CMB.1.raw
  modified_base (97)..(97): a, c, t, g, unknown or other
  misc_feature (97)..(97): n is a, c, g, or t
  modified_base (163)..(163): a, c, t, g, unknown or other
  misc_feature (163)..(163): n is a, c, g, or t
  modified_base (368)..(368): a, c, t, g, unknown or other
  misc_feature (368)..(368): n is a, c, g, or t
tcagacatacgcgtcacgaccggtgctcgatttagtctgacgtcaaagggaagggggagctctgggagtctgcaccatggcttggaccccactcctnttcctcacctcctcctccactcgcacaggtctactcctcccgaggttgactgactcaatcgccctntcgcctctcgccctccgtgggactcctcggtcaaccgtcaccgtgacgtttctagacgtcaacgacgtacttacacgaccggtcgcgtggaccatacaacgtaacgcggaccggtaagaccggacctcgctaacgttaacgacgtaagtagttcggactagtttcggacacgcctaaccgacggaacgggggttcgaccgtccgngtacgtcgtcgtacgtcgggtctccgacgtcgtaccggtcgggaccgtacgtccgtacctaccgtactacccgtacgcccgttaccaccgtccccgtaccgtacgttcgtacggaacgtacggttacggtacggtaccgttacgttaacgttaaccgtttacggtacgttacgtaacggaacgttaccggtacggggacctaccgggttcgggtccgttaccgggttccgggtacgttacgggttaccggaccgggtacgggtaaccgttacggtacccgtacggtacccgttcggtaacgaccgtaacccgtaccggtaaccggtcccgtaccggtccccgtcgtaaccgtccgttacccgttcccggttacccctacccggttcctccggtacccgttaccgg

SEQ ID NO: 86116 - DNA, 725 bp, Homo sapiens
  misc_feature: GYAE6OF01BW0PY.22.30.C08.1.454.CMB.1.raw
  modified_base (203)..(203): a, c, t, g, unknown or other
  misc_feature (203)..(203): n is a, c, g, or t
tcagacatacgcgtcacgaccggtgctcgatttagtctgacgtcaaaggggaaaggggagctctgggagtctgcaccatggcttggaccccactcctcttcctcaaccctcctcctccactgccaacgagggtctcgtcctcccgaggttcgtactgactcaagtccgccctcgtcgcctctcgcccttcccgtagggggacncccgtcgggtacaaccctcgaccgtggtccgttcttaggtagcaaacacgtattacactacgtcgagtgcatacaacgacacggtccggaagaaccggcctacgtactaactaagtagtaacgtagttcggacgtagttttcggacacggacccgaaccgacggaacggggggtaccgacgtacccgtgtacgtcgtccttcgtaccggctaccgacgtcgtcggtcgggaccgcgaccgtccaacctccgaccactccgacaccgtcctaacctcggtacaggaacgtacgagggtaccgacgtacgtaacttaacgttaacgtacggtacgtaaggtaaccgtaggtcgggaccggtcgtaacggtcggtacgttggtaccggttcgggttaccgggacgggaacggtaccgaacgtaccgtacggaccccgtgacgggtacgaccggacgtaccggctaccccggcccggtcggtcctacgttcgtacccggtcctccggacccttcggacgtacccgg

SEQ ID NO: 86117 - DNA, 892 bp, Homo sapiens
  misc_feature: GYAE6OF01EQNQL.22.30.C08.1.454.CMB.1.raw
  modified_base (166)..(166): a, c, t, g, unknown or other
  misc_feature (166)..(166): n is a, c, g, or t
tcagacatacgcgtcacgaccggtgctcgatttagtctgacgtcaaaagggaaagggggagctctggggagtctgcaccatggcttggaccccactcctcttcctcaccctcctcctccactgcacgagggtctctctcccaggttgtactgactcaatcgccctntgcctctcgcctccgtagggacgtccgtcggtaccaacctccaccgttgtcgttcgttagtacgtacaaactacgtattacctacgaccgtcgcgtgcactacgaacaacgacggaccggaacggtaaccggtcccgtacgtaccgttaaacctttaaaggtacgaaaaggtaacgtttcggaccgtttaacggtttttcggaccgtaaccggtacccggaaaccccggaaaggggggtaaacccggggggggttaccggggtaaccgttcccggttacggtaacgttacccgttaccggttttaccccgggtttccgggtaccgtacccgtaaccggtaccgtttaccggggttccgggggacccggtaaaccggtccggtaaccccgttaacccccgtacctaaccccgtaccttacccgtacccgtaccgtacccgttaccgtaaccggtttcgaacggtaacggtaggtacggtacgtacgttaacgttacgttacgtttacgtacgtacaacgtacgtagggtaccggcggtacggttcggtaccggttcggtaccgggtggtttaccgggtaccgggtacggggaacggaaccgtacggtaccgttacgttaccgtacgttcgggaaccaccggtacccggacggtcccgtacccgggtccccgtacgtcccgacccgtttcccgtcccgttccccgtacccgtccctaccgcgttacgg

SEQ ID NO: 86118 - DNA, 666 bp, Homo sapiens
  misc_feature: GYAE6OF01AU1DM.22.30.C08.1.454.CMB.1.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (509)..(509): a, c, t, g, unknown or other
  misc_feature (509)..(509): n is a, c, g, or t
  modified_base (524)..(524): a, c, t, g, unknown or other
  misc_feature (524)..(524): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccagtgggtagttggggctgagctggtcttttcttgttgcttatttagaggtgtcgagtgtgaggtgcgcgtggtggagtcgggtgggggtccttggtccgacggtccgggttcgggggtcctggacgctcgcctgngcncgtcctgtggtnttcggtaggtttggtcgcctagttgtcgtgtacggttcggccgccgtacggcgtaccgggaggggacggggtcgtgggtgggtgggcggccgngaccagtacgaaggaacgacggtaanaagtaagttaatttgtcgtcgtctaggtggtacgggtacggtctacttcccgactactccgtacgagaacgtaaccacgtaacaagtacctactaacgttcgttacgngagtagtcgtggacncggtcgtacggacggaccggaccggtacgggtaccgtccggttaccttagttaccgtttaggttctaggtcgttaagcggtaggaacgtagtaacctttaacgacgttaacgtttatttaacgttaggtagtaaatttcggg

SEQ ID NO: 86119 - DNA, 751 bp, Homo sapiens
  misc_feature: GYAE6OF01AFEBF.22.30.C08.1.454.CMB.1.raw
  modified_base (115)..(115): a, c, t, g, unknown or other
  misc_feature (115)..(115): n is a, c, g, or t
  modified_base (718)..(718): a, c, t, g, unknown or other
  misc_feature (718)..(718): n is a, c, g, or t
  modified_base (723)..(723): a, c, t, g, unknown or other
  misc_feature (723)..(723): n is a, c, g, or t
  modified_base (735)..(735): a, c, t, g, unknown or other
  misc_feature (735)..(735): n is a, c, g, or t
  modified_base (743)..(743): a, c, t, g, unknown or other
  misc_feature (743)..(743): n is a, c, g, or t
tcagacatacgcgtcacgaccggtgctcgatttagtctgacgtcaaagggaaaggggagctctggggagtctgcaccatggcttcggacccactcctcttcctcaccctcctccncctactgcacgagggtctctcctccgtaggttgtactgactacgaacgtccgccctgtcgtccgttctacgcccttccgtaggggactccgtaccggtaccaacctcaccgtggtcctttcttaagtacgtacaactacgtactttaacacctccgtcgcgtggtcactaaccaaacacgtacggacggaggaaccggtcctcgattacgtaagtagaagtgtcgtacttacgttggacacgtaccaaccggaacgggtacggggttacggacttcccgtacggtactccggttaccgtttccgggtacggtcccgcctaacggttccggtcggtaaccgggggcctaaccggggtaacccttcccgtaacctcccgtaaaccgtcggaccctaccggtacccggttacctccgtacgtccggttaaacggtagaccggtttacggaccgttagacggttaaaccttacgttcgtaacttacggactaaaggggttcccggagggtcccgagggtttcgcggttggtccgtaacggtcgggttaacggcccgggtagaccggtcgtacgtcggtacgtcgtacggcaaacgcgacgtcgcccncgtcncgtactccgtcncctccgcnctggtacg

SEQ ID NO: 86120 - DNA, 817 bp, Homo sapiens
  misc_feature: GYAE6OF01BURXU.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccagtgggagttggggctggagtcgtggtctttttccgttgttgcttagtttagaggtgtcagtgtgagtgcgccgtggtgtagtcggtcggggggtccttggtccgacggtccggttcggggggtccctggacgtaccgtccgccgttggtacgaccgtaccgtccgtcgttaggtacgtttccggtaagggttttcggacggtcccttacgtcggtacgttggtacccggtttcggggtaccccgtaccgtacgggtcccgtaacccgggtaggggggaacgggtccggtagggggtcggttacgggggtccggacccgaggaccgttaacgtaaccgaaaaccggtaacgggaaccgaacgtaaggttaaaggtttaagtttaggtacgttcggaccttcggtaggtacggggaaccggttactacgtaccgtaacctacgttaccgtaccggaaggtaaccgaacccgtaacgtacgaaacgtacgttacctacgtttcggttaccgtacgacgtaagtcgtacgggaacctccggtaccgaccggtaccggaaccggtaccggtaagggtcccctaacggttccgttaagttcccgtttagtttccgtcggtacgtacgacggtaaacgagtaccgtacgtacttaacggtacttttagtacccgttatacggtacgttagg

SEQ ID NO: 86121 - DNA, 824 bp, Homo sapiens
  misc_feature: GYAE6OF01CTWBC.22.30.C08.1.454.CMB.1.raw
  modified_base (175)..(175): a, c, t, g, unknown or other
  misc_feature (175)..(175): n is a, c, g, or t
tcagacatacgcgtcacgaccggtgctcgatttagtctgacgtcaaaggggaaaggggggagctctggggagtctgcaccatggcttggaccccactcctcttcctcaccctcctcctccactgcacagggtctctctccaggttgtactgactcaagtccgccctctcgcctcncgcctccgtgggacgtcctcggtaccaacctccacctgtcgtttacttagttacgaccaacgacgtacttacctacctaccggtcgtcggttgcaactaccaaaacgaaccgacggaccgggtaagggaaccgggtcccgtaccgtacgttaacttaaagtaggtaaaggttacgttacggaccttacggttttacgggccaaccgggacccaacccggtaaccggggtaaacgggggggtaccgggtaccgtaccccggtacggtaaccgtccggttccgttaccgggttcccgggtcctacccggtaccggtccggttcgggtccgggggtaccggtccgtacccgtaccgtaacccgtaccgacccttaccgttccgtaacccggcccgtccgtaccgtacggttaccggtaaggtacgtacggtacggtacggtacgttacgtacgttactttacggtacgtaacgacggacgtacgggtacgggccgtaggtcggttccgtcgggtggtcggttcggtaccggggtacggacggtacgacgtcgtaccggtcggtcgtacggtccaccggtacgccggtccggtccgtccccgtcgtacccgtcgttcccgtcccgttaccctacccgtccctcggtctacggg

SEQ ID NO: 86122 - DNA, 967 bp, Homo sapiens
  misc_feature: GYAE6OF01BLW9Y.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccatgggagttggggctgagctggtcttttccttgttgtcttattttagaaggtgtccagtgtgaggtgcgctggtggatcgtggggggccttggtccaggccgtgggggtccctgagactcgcctgtgcacgcctcgtggtacgttcggtaggtttggacgtccttacgttgttcgttcggtacgttccgggtccccgccgacggtccgtaccgggtaagggggaacggggtcgggttaggggtacgggttcgggggtaccgggacccgacgggtaccgtaacgtaacccgggaaaaacgggtaaacggaaaccgggtaaaccgtaaaacggtttaaaagggttttaaacgtttttaacggttacggggttaccgggttacccgtttacgggttacgggttaaacgggggtaaaccggggttaacccgttaaaccggtttacccctaaacccgttaaccgtttaaccccggtaaccggaaaacgggtaaccgtaaaaccccggtaaaaccggtttaaaccgaaaaaccgggttaaccctttaccgttaaaccgttttaccgggtttttacgaccggtaccgttaaagggtaccgttaccggggaaccgtaaccgggttccgggttacgggaacccgggttaaccggggaaccccggggtaacgggtaacccgttccggggttaccgtttacggttaaccctttttaggtttccggttcggtaaccggttacggaaacgggttacggaaccgggttaaacgtaaacgttttaaccgtaacgtttaacgtttttaacccgttagtttttaaaccgtacggggttaaactttaaacggg

SEQ ID NO: 86123 - DNA, 715 bp, Homo sapiens
  misc_feature: GYAE6OF01BCZKS.22.30.C08.1.454.CMB.1.raw
  modified_base (346)..(346): a, c, t, g, unknown or other
  misc_feature (346)..(346): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
  modified_base (628)..(628): a, c, t, g, unknown or other
  misc_feature (628)..(628): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccagtgggagttggggctggagctggtctttttccttgttgcttagttttagaaggtgtccagtgtgaggtgcgcgtggtggatcggtggggggtccttggtccaggtccggtcgggggtccctggacgtaccgtcgtccgtggtcgcgacgtccgtcgtggtagttcggtaggtttcggacgtccttacgtgtcgtggttccgttcggggccccnccgacggtccgtacggagggggtagggcgtgggagggtgggcgccgagacacgtacgaaacgggaacgacggtaanaacgttaaaggttaagttttagngtcggtacctggtaggtacggaacgggtcctaacttcccaaccgtacttccgtacgaacggtaacgtaacgaaccgtaccaaacgtaacctccgttacgtttcgttacgtacgacgtagacggtacgtacgacgtccgtcggaaccggtacggaccggtaacggacggtcgttcgttacgttntttccgttcgtacgttacggtacgaggtaacgtaacggtaactaacgtaacttacgtagttacctttataggtagtaacgttaacgg

SEQ ID NO: 86124 - DNA, 950 bp, Homo sapiens
  misc_feature: GYAE6OF01D3209.22.30.C08.1.454.CMB.1.raw
  modified_base (209)..(209): a, c, t, g, unknown or other
  misc_feature (209)..(209): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccagtgggattggggctgagctggtcttttccttgttgctattttagaaggtgtccagtgtgagtgcgctggtgatcgngggggcctgtcagcgtggggtcctgagctcgcctgtgcagtcctgtggtattcggtaggttttggacgtcccttactggttctggtacgtttcggggtcccgccgtacgggtccttaccggaaggggggtaacgggggccgttaggggtacgggttcgggggtcggtaccccgaagggtacctacggttaaccgaaaacgggtaaacggaaccggggtaaaccgtaaagggtttaaaaacggggttaaactttttttaaacgggtcgggttttaccgggtacccctttacggtttacggggttaaccgggggtaaaaccgggggttccccggttaaacttttaccccgaaaccccgttaacgtttacccccggttaacccgaaaccgggtaaacgtaaacccccggttaaaacccgggtttaaccgtaaaaaccggtaacccgtttacccgttaaaccggttttccggttttttaccctaacggaaccccgttaagggtaaccggtttacgggaaacccgttaccggggtaccccgtagggtacccggaacgggtaccccgggtaagggtaacccgaccgggttcttacggttttcccgttaagtttttcccgacgggtttaccgttaaccggtaacgggttaaacggtaacccggtaaacgttaaccgttaaacccgttaaccgtttaacggttttaacttttaaccggtttaaccgtagggttaacccggttaaaacgg

SEQ ID NO: 86125 - DNA, 880 bp, Homo sapiens
  misc_feature: GYAE6OF01BK7W0.22.30.C08.1.454.CMB.1.raw
  modified_base (165)..(165): a, c, t, g, unknown or other
  misc_feature (165)..(165): n is a, c, g, or t
  modified_base (188)..(188): a, c, t, g, unknown or other
  misc_feature (188)..(188): n is a, c, g, or t
tcagacatacgcgtcacgaccggtgctcgatttagtctgacgtcaaagggaaagggggagctctggggagtctgcaccagtggcttggaccccactcctcttcctcacctcctcctcactgcacagggtctctctcccgaggttgtactgactcaactcgccctntcgcctctcgcctccgtgggacncctcggtacaacctcgacctgtccgttcttaggtagtaccaacgtacgtattactacgtacgtgtcgcgtggctatacaacacgaggccggtaaggaacgggccctcgacttacgttaacgtagaaagtagttcggtacctagtttttacgggccgacgacccgaacccgaacgggtaacgggggggtaccggggtacgtcccgtacggacgttccgtcgtttccggtaccgggccgttaccgacggtccggtccggggttacggggcccgtacgggccgtccgttacccgtccaacccgtaccttcccgtaaacccgtcggtaccccttaccggtaaaccgttcggttaacgtaaagggtaccgttaacgggaccggtacgggtttaacctaaacgggttttaactttaccgggttacgtaaccggtaacggtaacggttaaacgggccgggggttaacggtcccgggttcgggttaacccggggttcgtcggggttacccggtttggggttacccgggggaacgggtaccggggaaccttacccggtacgggtaccggtaaccggttccgtttaccgggcaacccgggcccgggtaacgtcccggtaccccggtcccccgtaacggggttccctaccgttccccggtttacccgtcccccttaaccccgttccggtccccgtaacccggg

SEQ ID NO: 86126 - DNA, 783 bp, Homo sapiens
  misc_feature: GYAE6OF01CRK6F.22.30.C08.1.454.CMB.1.raw
  modified_base (199)..(199): a, c, t, g, unknown or other
  misc_feature (199)..(199): n is a, c, g, or t
  modified_base (217)..(217): a, c, t, g, unknown or other
  misc_feature (217)..(217): n is a, c, g, or t
  modified_base (328)..(328): a, c, t, g, unknown or other
  misc_feature (328)..(328): n is a, c, g, or t
tcagacatacgcgtcacgaccggtgctcgatttagtctgacgtcaaagggaaagggggagctctggggagtctgcaccatggcttggaccccactcctcttcctccaccctccctcctccactgcacgagggtctcctctcccaggttcgtactgacctacaactccgccctctcgcctcgtcgccctcccgtgggacnccctcggtacctaacccnctaccgtggtctttcgttagactaccaacacgtacttaccgtaccgaccgttcgcgtaggcctacacgaacacgacggacggtacggaacgcctacgtacctaagttaagngtaaagtcgttacggtccgttagtttcggctaacgacccaacgggaacgggtaccggggtggtacctccgtcgtaccgtccgtcgtttccggaccgtcccgtcgaccgtccggttcgggccggggaaccgtccggaccggtaccctttaacccggcctaaccctccttcgttacccgaccgttacccacgtagtaccggtacgaagcggttaaccggaggtcctaagttaccgttacgttaaccgttcgtaaacgcgtaacggacgggttccggacggtacggtggtaccggtgtacgggttccgggttaacggtccggggtaacggaccgggtagacccgtaggtccgttaccggtactcggaccaccggtccgacggttcccgggcccttaccccggtccgtaaccttcccgttccggtcccttccccggtacccttcgcccggtacgttacg

SEQ ID NO: 86127 - DNA, 696 bp, Homo sapiens
  misc_feature: GYAE6OF01DX1A4.22.30.C08.1.454.CMB.1.raw
  modified_base (268)..(268): a, c, t, g, unknown or other
  misc_feature (268)..(268): n is a, c, g, or t
  modified_base (560)..(560): a, c, t, g, unknown or other
  misc_feature (560)..(560): n is a, c, g, or t
  modified_base (590)..(590): a, c, t, g, unknown or other
  misc_feature (590)..(590): n is a, c, g, or t
  modified_base (621)..(621): a, c, t, g, unknown or other
  misc_feature (621)..(621): n is a, c, g, or t
  modified_base (685)..(685): a, c, t, g, unknown or other
  misc_feature (685)..(685): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccagtgggagttggggctgagcgtggtctttttccttgttgtcttattttagaggtgtcagtgtgaggtgcgcgtggtggagtcggtggggggtccttggtccaggccggtcgggggtccctgagcgtcgcctgtgcncgcctgtggtagttcggtaggtttggacgtcccttacgttgtcgtgtacggtttcgggccccgccgacggtccgtacgggaagggggtaggggcgtgggagggttggggcggaccgagcgtaacgtaaccgaaaggaaacggaaccggaagtaaaggttaaaaggtttaaagtttttagtacggttcggtcccgttagttacgggtacgggaaccggggtaccgtaacttacccgaccttacgtcccgtaacccgaagggaacctaaccgaaacgttacaaacgtaaccctntaccgtttgttctacgacgagtactggacnccgcgtgacggcgacgggacgaccgtcggtnttgttacttgtttgcgtgacgacggagaacgataactaacgtacgttagttaattcgttaaagngtacggttaag

SEQ ID NO: 86128 - DNA, 965 bp, Homo sapiens
  misc_feature: GYAE6OF01A8YJI.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaactccgccctcgtcgtcctactcgtccctcccgtggggacgtccgtaccggtaccaacctctacccgtggtccgtttaccgttaaggtagtaccgaaacgtaccggtaactttaacctaaccgacccgggttcggaccgttcggggacctaacgttaaccgaaaacccgtaaaccggtacggggtaccccgggggtaaaggaaaacccggggtcccccgttacccgggtacccttaaacgttttaaaacgtacgggtaaaagttacggttacgggtacccgttaacggtttttacgggacctaccggtaaccccgaaccccggtaaaccggggtaaaaccgggggggttaccggggtaacccgttaccccggttaacggtaccggttacccgggttacccgtttacccgggttcccgggggtacccttacccggtaaccgggttcgtttacccggggtaccggggggtaccccgggaacggtcccggtaacccgttaccccggtaactaaccccgtacgttccttacccggaaccgtacccgtacccgtacggtacgtacggaacgtacgtagggacggtctacggtaaccttacgttaccgtacgtacctaaccggtacgtaacggtcggggacctcgggttcgggtaccgtcgggttacggttcggtacgggtaccgggttacgggaacgggtaccgtaacgtcggtccggtaaccgttcgcggtaccgtcgaccggacgtcccgttcccgacccggtccgttaccgccttaccgttacccgtaccctaccctcccgtacgtccgtcgg

SEQ ID NO: 86129 - DNA, 929 bp, Homo sapiens
  misc_feature: GYAE6OF01BU5KL.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccatgggagttggggctggagcgtggtcgtttccttagttgcttatttagaggtgtccagtgtgaggtgcgccgtggtggaacgtcggtcgggggggtccttacgggtccgacggcccgggttcgggggtccctggacgtctccgtccgtgtgcgtacgcctcgtggtatttcggtaggtttacggacgtccgtacgttgttacgtccggttaccggttcgggtccccgccgacgggtacccgtaccgggtaacgggggtaggggcggttacgggacgggtttcggggccggaccgaagtccgtaagtaccggaaacggaacggtaacggtaaaccgaaggttaaacggttaaagttttacggtggttcggttaccgttacggttagggtacggggtaaaccgggtaccgttaacggttaccctaacccggtaattacccggtaacccgtaacggtaaaccggaaccctaaacccgggttaaccgaaaacggttaaccgttaaccgtttaacccgtttcgttttaccggtaacggtaccgtaaacgggttcgtaacgggaaccctaaccggtacccggggttaccgaacggggttaaccccgggaaccgggttacccgggtaaacgggtcccgggttaccgtttacgggttaaccccttttaaggttttcccgtttcggggtaaacgtttaccggaaagggttaaccggttaacgggtaaacccctaaagggtttacccctaaagggtttaacctttacgtttttaaaccgttagttaacggtaaaaccggttaaacgg

SEQ ID NO: 86130 - DNA, 910 bp, Homo sapiens
  misc_feature: GYAE6OF01BKZ9U.22.30.C08.1.454.CMB.1.raw
  modified_base (776)..(776): a, c, t, g, unknown or other
  misc_feature (776)..(776): n is a, c, g, or t
tcagacatacgcgtcacgaccggtgctcgatttagtctgacgtcaaagggaaagggctcagagaggagccttagccccggactccaaggcctttccacttggtgatcagcactgagcacagaggactcaccagtgggagttggggctgagctggtcttttccttgttgcttatttagaagtgtcagtgtgaggtgcgtctggtgacgtcggtgggggtccttggtccgacggccggttcggggggtccctacggacgtaccgtccgtccgtcgtcggaccgacgtcctcgtgggtacgtttaccggtacggttttgggaccgtcccgttagttcggtaccgttcggtaccggtttcgggtccccgtaccggtaacgggtccggttacccgggaaggggggaacggggtccggtagggggtacgggttcgggggtaccggacggtacggacgtaaaccggtaaacggaaaaccgggtaacggaaacgggtaaacgttaaaggttaaaacggtttaaaggtttttaacgtcgggtacggttcccttacggttaagggtaccggggtaaaaccgggtaccggttaccgttaaccgtaaccgttaaccgttacccgtaaccggtaaacgggtaaccgtaaaccgaaaccggttaacggaaaaaaccgttaccgttaaccgttaccgtttggttttaaccgaccggtagtaacggtaaggttaaccggacgtaaccgggttccgtaagggaccggaacgggccccggaaagggttaacccncggttacgtaccgtttactttacgggttactcgggttaaacgtacgaacggacgggttaacgtaaacgttacttaaacccgacggtttaacgttttaactaccgttaaaggtagggtaaaccgttttaaacggg

SEQ ID NO: 86131 - DNA, 933 bp, Homo sapiens
  misc_feature: GYAE6OF01CRNFQ.22.30.C08.1.454.CMB.1.raw
  modified_base (164)..(164): a, c, t, g, unknown or other
  misc_feature (164)..(164): n is a, c, g, or t
  modified_base (188)..(188): a, c, t, g, unknown or other
  misc_feature (188)..(188): n is a, c, g, or t
tcagacatacgcgtcacgaccggtgctcgatttagtctgacgtcaaaggggaaagggggagctctggggagtctgcaccatggcttggaccccactcctcttcctcaccctcctcctccactgcacgagggtctctctccaggttgtactgactcaatcgcctntcgcctctcgcctcccgtgggacnccgtcggtaccaacctcaccgtgtccgtttacttaggtacgtaccaaacgtaacgtactttaaccgtaccgacccggttcggcggttcggacactacaaacaacgacggccggaaggaacggccctacgacttaactaagtaggaagtagttcggtaccttagtttcggactacgacccgaaccgaacgggtaacggggggtaccggtaccgtcccgtaggtacgtaccgtccgtttccggtcgggtacctaccgtacggtccgtaccggtcgggggaccgtacgggccgtaccgttaacccgtaccgtaacctaccgttaccgtaccccgtaccggtccccgttaacccggtacggtttaccgtacggtaacgggtaccgttacgggtaaccggtaccgtttaacggttaacgtttaaaccgttttacgtaccggtaacgtaacggttaaccgtaacggggttaccgggtaccggttaccgggttccgggtcccggttaacgggttccgggttacgggtttccgggggttaaccggggaacgggggtaacccgggtaaccggtaaccggttaccggttaccgggtaacccgggttaccgggttacgggtacccggtaacccggtacccgggtaacccgggttccccggtaccccggttaccccggttccggttacccgttacccgttccccgttaccccgttacccccgtaacccgttcccgtacccgggtaccggttacccgg

SEQ ID NO: 86132 - DNA, 760 bp, Homo sapiens
  misc_feature: GYAE6OF01CPSSP.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcaacgagaggactcacagtgggagttggggcctgacgcgtggttctttttccttggttgtcttaagttttaggaacggttgtccaggttcgtggtagggttgccggtccgttggggtaggtaagttccggggtcgggggggtcccttcgggtccgaccgggtccggtcgggggtccctggagtacctcggccgtgtcgcgacgtccctgtaggtattcggtaggttacgtacgtccttagtcgttacgtggttaccgttccgggcccgacggttaccggccggttaccggaggggtacgggtcgtaggggtaggtcgggtccgacctagcgtaacgacgaaaacggaggtaccgggaataaggtaaagtttagtttagtcggtacgtccgtcgtagggtaacggaccggtacgtactaccgactagtaccacgtacgacgtaacctacgaactaacgacttacgtagttcgtacgttacgacgagtagtccggaacgtcgggtacgtaacgtacgaccggtacccgggtagaccggtacgttacgtcgttacgtttaccgttgtacgttcggtacggacggagttaacggtacgtacttaaccgttgtaagtttacttaccggttatcggttaacgttaacgg

SEQ ID NO: 86133 - DNA, 538 bp, Homo sapiens
  misc_feature: GYAE6OF02JNUPF.22.30.C08.1.454.CMB.1.raw
  modified_base (388)..(388): a, c, t, g, unknown or other
  misc_feature (388)..(388): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagacatacgcgtcacgaccggtgctcgatttagtctgacgtcaaagggaaaggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccgagaaggccctcgctactaatgaagattggccattttggcagccaccacaagggggtcggatccctgatcgcttctcgggctccagctctggggccagcgctacctcacatctccagcctccagtctgaagntgagctgactntactgtcagacngtggacnctggcgtctggctgttcggcgacgggaccaagcgtgaccgtcgtagtccagtcccgaaggcctacgcccccgtcgggtccaccgttccgtccggttccccacccctcctccgacgtccgg

SEQ ID NO: 86134 - DNA, 530 bp, Homo sapiens
  misc_feature: GYAE6OF02HTWNH.22.30.C08.1.454.CMB.1.raw
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (516)..(516): a, c, t, g, unknown or other
  misc_feature (516)..(516): n is a, c, g, or t
tcagacatacgcgtcacgaccggtgctcgatttagtctgacgtcaaagggaaagggggagctctggggagtctgcaccatggcttggaccccactcctcttccctcaccctcctcctcccactgccacagggtctctctcccaggttgtacctgactcaatcgccctctgccctctgcctcccctgggacgcctcggtcaaccgtcacctgcgttcgttagtagtcaacacgattacctacgacccgtcgcgtggcatcaacacagccgagaaggccctcgctactaatgaagattggccattttggcagccacacaaggggtcggatccctgatcgcttcgcgggctccacgctcgtggggccagcgctacctcaccatcnccgagcctccagtctgaagatgaggctgactatactgtcagacagtgggacncgtggctgnggcttggtcggcgggaggaccagctgacctcgtaggcagccgaggctcggcccctggtcactctcggtccccncccttctcacgtcg

SEQ ID NO: 86135 - DNA, 514 bp, Homo sapiens
  misc_feature: GYAE6OF02HV40P.22.30.C08.1.454.CMB.1.raw
  modified_base (153)..(153): a, c, t, g, unknown or other
  misc_feature (153)..(153): n is a, c, g, or t
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (456)..(456): a, c, t, g, unknown or other
  misc_feature (456)..(456): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcggngtgttcctaggtcgctatttagagtntcagtgtgngtgcgctgtgatctgggggcttggtccagcctgggggtcctgagctcgcctgtgcagcctntggattgagtttggncctatgtctgcttgggtccgccaggctccgagggaaggggctggagtgggtggccgagcatcgaacgaagacggacagtaaggaatttatgtggctcgtgtgaggcgatcacatctccagagacaacgtcaagaacncactnttcttcgcagatgacgagcgtcgcgacgcgacgacgacgccgtgtctttnttcttgtcgtcgtagagacgacgtacgtacgtacgtacgtattacttatagtagtacg

SEQ ID NO: 86136 - DNA, 517 bp, Homo sapiens
  misc_feature: GYAE6OF02J0UNO.22.30.C08.1.454.CMB.1.raw
  modified_base (152)..(152): a, c, t, g, unknown or other
  misc_feature (152)..(152): n is a, c, g, or t
tcagacatacgcgtcacgaccggtgctcgatttagtctgacgtcaaagggaaaggggctcagagaggagccttagcccggactccaaggcctttccacttggtgatcagcactgagcacagaggactcaccatgggattggggctgagcggngtgttcctaggtcgctatttagagtgtcagtgtgaggtgcgcctggtggaatcgtggggggccttggtccagcctggggggtccctgagactcgcctgtgcagcctctggattcgagtttggagcctatgtctgactgggtccgccaggctccagggagggctggagtggtggccgagcatcgacgaagacggacgagtaaggaatttatgtggtctctgtgaggacgagttacacactctccacgagacaacgtacaacgaactacactgttcttgcagatgacagcgcgcgagcgacggacgacgcgtcgtctagttctgtgtcgcgacgagagactatactagtattacttatagtagtaag

SEQ ID NO: 86137 - DNA, 539 bp, Homo sapiens
  misc_feature: GYAE6OF02JZ8BT.22.30.C08.1.454.CMB.1.raw
  modified_base (379)..(379): a, c, t, g, unknown or other
  misc_feature (379)..(379): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgcgtttcctaggtgctatttagagtgtcagtgtgaggtgcgcctggtggaatcgtgggggggccttgggccaggcctggggggtccctgagactcgcctgtgcagcctctggattcgagtttggagcctactgtctgcttgggtccgccaggctccagggaagggcgtggagtgggaaaaggccgaggcatcaacgaagacggacataaggaatttaatgtggcctntgtgaaggccgattcacatctccagagacaacgtcaaagactacactgttaccttgccagatgacagcgtcgcgagccgaggacaacggctcgtctattccgtgtgttcgaggtacgacggaagtagtaactacctaggttattcttaatgaagttaacg

SEQ ID NO: 86138 - DNA, 651 bp, Homo sapiens
  misc_feature: GYAE6OF02IQOAS.22.30.C08.1.454.CMB.1.raw
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
tcagacatacgcgtcacgaccggtgctcgatttagtctgacgtcaaagggaaagggggaaggcgtcgtggggaggtctgcaccatggcttggacccactcctcttcctcaccctcctcctccactgcacagggtctctctccaggttgtactgactcaatcgcctctgcctctgcctccctgggagcctcggtcaacctcacctgcgttcttagtagtcaacacgattactacaccgtcgcgtggcatcaacaacagccggagaagggccctgctactaatgaagattggccattttggcagccaccacaagggggtcggatccctgatcgcttctcggggcttccagctctgggggccagcgctacncaccgatcncctanccctccgtagctgaagatgtagggctagactactttaagcgtactacganagtaggggccgctgggcgtcctgggtccgtgtttcccggggcgggaacgggggtacctaaacgggtctcggggaaacccggttcccgtaacgggttccgaccgtaaccccggaacgggtcctccccgggtccccccctttagggggttaccccaaccggttccttcccgggttttccccccgggaacccccctttcctttcccgggaacccgtcccggg

SEQ ID NO: 86139 - DNA, 516 bp, Homo sapiens
  misc_feature: GYAE6OF02G9OAO.22.30.C08.1.454.CMB.1.raw
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtggcgtttctgtgctatttagagtgtcagtgtgaggtgcgcctggtggaatcgtgggggggccttggtccagccgtggggggtccctgagactcgcctgtgcagcctctggattcgagtttggagcctactgtctgacgttgggtccgccagggctccgaggggaaggggctgggagtgggtgccagcatcaacgagacggacagtaaggattttangtgcctntgtgaaggcattccacatccacaganacaacgtcaagactcactgtttcngcagatggacngcctggacgagccgaggacacggctgtcttagtttctgtgtcgaggagacgagtactactacgagttattctatgatacg

SEQ ID NO: 86140 - DNA, 569 bp, Homo sapiens
  misc_feature: GYAE6OF02GOF4V.22.30.C08.1.454.CMB.1.raw
  modified_base (427)..(427): a, c, t, g, unknown or other
  misc_feature (427)..(427): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagattggccattttggcagccaccacaagggggtcggatccctgatcgcttctcgggctccagctctggggccgagcgctacctcaccatctccagcctccagtctgaagatgaggctgactattactgtcagactagtgggacncgtggcgtctgggccttggtttccgggcgggtacgggacccaaggtcctaggacccgttccgtaggtccacggcccaagggcctcggcccccgttcggtccacgtccttcggttcccccgcccctccgtccgaccgtaccgg

SEQ ID NO: 86141 - DNA, 515 bp, Homo sapiens
  misc_feature: GYAE6OF02HERWK.22.30.C08.1.454.CMB.1.raw
  modified_base (424)..(424): a, c, t, g, unknown or other
  misc_feature (424)..(424): n is a, c, g, or t
  modified_base (510)..(510): a, c, t, g, unknown or other
  misc_feature (510)..(510): n is a, c, g, or t
tcagacatacgcgtcacgaccggtgctcgatttagtctgacgtcaaagggaaaggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccagcgctacctcaccatctccagcctccagtctgaagatgaggctgactattactgtcagacatgggacnctggcgtctggctgttcggcggaggaccaagctgaccgtcgtagtcagcccaaggcctgcccctgtcactctcgtcccacctctcncgtcg

SEQ ID NO: 86142 - DNA, 522 bp, Homo sapiens
  misc_feature: GYAE6OF02HNA55.22.30.C08.1.454.CMB.1.raw
  modified_base (336)..(336): a, c, t, g, unknown or other
  misc_feature (336)..(336): n is a, c, g, or t
  modified_base (423)..(423): a, c, t, g, unknown or other
  misc_feature (423)..(423): n is a, c, g, or t
  modified_base (458)..(458): a, c, t, g, unknown or other
  misc_feature (458)..(458): n is a, c, g, or t
  modified_base (509)..(509): a, c, t, g, unknown or other
  misc_feature (509)..(509): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttcncgggctcagctctggggccagcgctacctcaccatctcagccctcagtctgaagatgagctgactattactgtcagacagtgggacncgtggcgtgtggctggttcggcggagggccaagcngaccgtctaggtcacgccgaaggctcgcccctggtcacgtctcggtccccncctcctcacgtcg

SEQ ID NO: 86143 - DNA, 556 bp, Homo sapiens
  misc_feature: GYAE6OF02FFT4O.22.30.C08.1.454.CMB.1.raw
  modified_base (548)..(548): a, c, t, g, unknown or other
  misc_feature (548)..(548): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattacctacaccgtcgcgtggcatcaacaacagccggagaagggccctcgctacttaatgaagattggccattttggcagccaccacgaaggggtcggatccctgatcgctctcgggctccagctcgtggggccgagcgctacctcaccactctccagccctccagtctgaagatgaggctgactatactgtcagacagtggacgtcgtggcgtcgtgggcgttggttcgggcgggagggaccaagccgtgacccgtcgtaggtccgacgcccgaagggcctcgcccccgtcggtccaccttcgtcgttccccgccctcccgtcncgtaccgg

SEQ ID NO: 86144 - DNA, 543 bp, Homo sapiens
  misc_feature: GYAE6OF02G7OSG.22.30.C08.1.454.CMB.1.raw
  modified_base (396)..(396): a, c, t, g, unknown or other
  misc_feature (396)..(396): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctgctacttaatgaagattggccattttggcagccaccacgaagggggtcggatccctgatcgcttctcgggctccagctcgtggggccgagccgctacctcaccatctccagccctcagtctgaagntgaggctgactatactgtcagacagtggacgcgtggcgtcgtggctggttcggcggagggaccaagcgtcgaccgtccgtaggtcacgccgaaggtcctcgccccgtggtccacgtccgtcgttccccgcccttcctccgacgtccg

SEQ ID NO: 86145 - DNA, 526 bp, Homo sapiens
  misc_feature: GYAE6OF02FFTS3.22.30.C08.1.454.CMB.1.raw
  modified_base (375)..(375): a, c, t, g, unknown or other
  misc_feature (375)..(375): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaaggggtcggatccctgatcgcttctcgggctccagctcgtggggccgagcgctacctcaccatcnccagccctccagtctgaagatgagctgactatactgtcagacagtgggacgctggcgtctggctgttcggcggagggaccaagctgaccgtctaggtcagcccgaggctcgccccctggtccacgtctcgttcccaccctcctcgacgtcg

SEQ ID NO: 86146 - DNA, 563 bp, Homo sapiens
  misc_feature: GYAE6OF02JCNVT.22.30.C08.1.454.CMB.1.raw
  modified_base (436)..(436): a, c, t, g, unknown or other
  misc_feature (436)..(436): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctccctgggagcctcggtcaacctcacctgcgttcttagtagtcaacacgattactacaccgtcgcgtggcatcaacacagccggagaagggccctcgctacttaatgaagattggcccattttggcagccaccacgaagggggtcgggatccctgatcgcttctcgggctccagctcgtgggggccgagccgctaccgtcacccatctccagccctccagtctgaagatgaggctgactattactgtcagacagtgggacncgtgggcgtctggctggttccggcgggagggaccaagctcggacccgtcgtaggtccagcccgaaggcctccggcccccgtcggtccaccgtccgttccggttccccgccctcctccgaccgtccgg

SEQ ID NO: 86147 - DNA, 565 bp, Homo sapiens
  misc_feature: GYAE6OF02HQ42P.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaagggggtcgggatcccgtgatcgcttctcgggctccagctcgtggggccgagcgctacctcaccatcctccagccctccagtctagaagatgaggctgacttattactgtcagacagtgggacgcgtggcgtcgtggcgttggttcgggcgggagggaccaaggctggaccgtccgtagggtcacggcccaagggcctccggcccccgtcggtcctaccgtccgttcgttccccacccctcctccaccggtccg

SEQ ID NO: 86148 - DNA, 609 bp, Homo sapiens
  misc_feature: GYAE6OF02HHDAI.22.30.C08.1.454.CMB.1.raw
  modified_base (450)..(450): a, c, t, g, unknown or other
  misc_feature (450)..(450): n is a, c, g, or t
tcagacatacgcgtcacgaccggtgctcgatttagtctgacgtcaaaagggaaagggggagctctggggagtctgcaccatggcttggaccccactcctcttcctcaccctcctcctccactgcacagggtctctctcccaggttgtactgactcaatcgcctctgcctctgcctcctgggagcctcggtcaacctcacctgcgttcttagtagtcaacacgtattactacaccgtcgcgtggcatcaacaacagccggagaacggccctcgctacttaatgaagattggcctagttttggcagccacacgaaggggtcgggatccctgatcgcttcgtcgggctccagctcgtcggggccgaggcgctacctcacccatcctccacgtccctccgacgtctcggaagatggaggtctagacttattactgtacagactagtcggggacncgtcggcgtcgtggtcgtggttccgggcgggacgggaccaaggcgtcggaccgtccgtacggtaccacggcccgaacgggtcctaccggtcccccgtaccgggtccctaccgttccgttaccgttccccctaccccgttcccgtcccgtacgtacccgg

SEQ ID NO: 86149 - DNA, 503 bp, Homo sapiens
  misc_feature: GYAE6OF02FNRS3.22.30.C08.1.454.CMB.1.raw
  modified_base (300)..(300): a, c, t, g, unknown or other
  misc_feature (300)..(300): n is a, c, g, or t
  modified_base (360)..(360): a, c, t, g, unknown or other
  misc_feature (360)..(360): n is a, c, g, or t
  modified_base (427)..(427): a, c, t, g, unknown or other
  misc_feature (427)..(427): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggctttccttgttgctattttagaaggtgtccagtgtgaggtgcgcctggtggaatctgggggggccttggtccagcctgggggtccctgagactcgcctgtgcagcctctggattcgagtttggagcctactgtctgacttgggtccnccaggctcaggagggctggagtgggtgccagcatcaacgagacggacataaggaatttangtggcctctgtgaagggccgattcaccatctccagacgacaacgtcaagaactcactgttctgcagntggacagcctgcgagccgaggacacggctgtctattctgtgtcagagacgagactactacagtattctatgatacg

SEQ ID NO: 86150 - DNA, 572 bp, Homo sapiens
  misc_feature: GYAE6OF02GMECW.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctaattaatagaagattggccattttggcagccaccacgaagggggtcggatccctgatcgcttcgtcgggctccagctcgtggggccgagcgctacctcaccatcctccacgccctcacgtctagaagatgaggctggacttattactgtcaagacagtcgggacgtcgtgggcgtcgtgggcttcggttcggggacggacggggaccaaggccgtacggacccgtcgtagggccacggcccgaaggtctccgcccccgtcggtccaccgttctccgtccccaccctccgtccacgtcg

SEQ ID NO: 86151 - DNA, 519 bp, Homo sapiens
  misc_feature: GYAE6OF02HDS16.22.30.C08.1.454.CMB.1.raw
  modified_base (389)..(389): a, c, t, g, unknown or other
  misc_feature (389)..(389): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccacacaaggggtcggatccctgatcgcttctcgggctccagctctggggccagcgctacctcaccatctcagcctcagtctgaagntgagctgactattactgtcagacagtgggacgctggcgtctggctggttcggcggaggaccaagctggaccgtctaggcagcccaaggcctcgcccctggtccacgtctcgtcccaccctcctcacgtcg

SEQ ID NO: 86152 - DNA, 541 bp, Homo sapiens
  misc_feature: GYAE6OF02HQGZ9.22.30.C08.1.454.CMB.1.raw
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctcgtggggccgagcgctacctcaccatcctccagccctccagtctgaagntggagctgactattactgtcagacagtgggacncgtggcgtntggctggttcgggcggagggaccaagctggaccgtcgtaggcacgccgaaggcctcgccccgtggtccacgttcctcgttccccgcccttcctcgacgtcg

SEQ ID NO: 86153 - DNA, 557 bp, Homo sapiens
  misc_feature: GYAE6OF02JDPSK.22.30.C08.1.454.CMB.1.raw
  modified_base (392)..(392): a, c, t, g, unknown or other
  misc_feature (392)..(392): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggccctcgctacttaatgaagattggccattttggcagccaccacgaagggggtcggatcccgtgatcgcttctcgggctccagctcgtggggccgagcgctacctcaccatctccagcctccagtcngaagatgaggctgactattactgtacagacagtgggacgcgtggcgtcgtggctggttccggcgggacgggaccaggctcggaccgtccgtaggtccacgaccgaggctccgccccgttcggtccacgttccgttcgttccccacccttcctaccgtaccgtccg

SEQ ID NO: 86154 - DNA, 545 bp, Homo sapiens
  misc_feature: GYAE6OF02G28Z9.22.30.C08.1.454.CMB.1.raw
  modified_base (338)..(338): a, c, t, g, unknown or other
  misc_feature (338)..(338): n is a, c, g, or t
tcagacatacgcgtcacgaccggtgctcgatttagtctgacgtcaaagggaaagggggagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaatgaagattggccattttggcagccacacgaagggggtcggatccctgatcgcttcncgggctccagctcgtggggccgagcgctacctcaccatctcagcctcagtctgaagatggagctgactattactgtacagacagtgggacgcgtaggcgtctgggcttggtcgggcgggacgggaccaagctacggaccgtcgtaggtcacgcccgaaggcctcgcccccgtggtcaccttcgtcgttcccgccctcctcaccgtcg

SEQ ID NO: 86155 - DNA, 580 bp, Homo sapiens
  misc_feature: GYAE6OF02HOT4M.22.30.C08.1.454.CMB.1.raw
  modified_base (340)..(340): a, c, t, g, unknown or other
  misc_feature (340)..(340): n is a, c, g, or t
  modified_base (402)..(402): a, c, t, g, unknown or other
  misc_feature (402)..(402): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagacatacgcgtcacgaccggtgctcgatttagtctgacgtcaaagggaaagggggagctctgggggagtctgcaccatggcttggaccccactcctcttcctcaccctcctcctccactgcacagggtctctctcccaggttgtactgactcaatcgccctctgcctctgccctccctgggagcctcggtcaacctcacctgcgttcttagtagtcaacacgattactacaccgccgcgtggcatcaaacaacagccggagaacggccctcgctacttaatgaagattggccattttggcagccaccacgaagggggtcggatccctgatcgcttcncgggctccgagctcgtggggccgagccgctacctcaccatcctccagccctcagtctgaagntgaggctgaacttagttactgtcaagtanagtgggacnctgggctcgtggcttggtcggacgggacgggtaccaaggtcgtacggaccgtccgtaggtaccacgcccgaaggccttccggccccctcgggtccaccgttccgttcggttacccccgcccttaccctccgacggtaccg

SEQ ID NO: 86156 - DNA, 560 bp, Homo sapiens
  misc_feature: GYAE6OF02HNMT1.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggccctcgctacttaatgaagattggccattttggcagccacacaaggggtcgggatcccgtgatcgcttctcgggctccagctctggggccgagcgcgtacctcaccatctccagcctccagtcctgagatgaggctgactattactgtcagacagttgggacgcttgggcgtcgtggctggttcggcgggagggaccgaaggctcgaccgtccgtaggtcacgcccaagggcctaccgcccccgttcggtccaccgttccgttcgttcccctacccctccctaccgccgtaccg

SEQ ID NO: 86157 - DNA, 520 bp, Homo sapiens
  misc_feature: GYAE6OF02I6JWI.22.30.C08.1.454.CMB.1.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgctggtgaatcgtggggggccttggtccagccgtgggggtccctgagactcgcctgtgcagcctcgtggattcgagtttggagtcctactgtctgacttcgggtccncaggctccgagggacgggctggagtgggtcgccagcatcgaaacgaagacggacaagtaaggatttangtgcctgtgtgaaggcatcacatctcaganacacgtanaagacncactgttcnggcagactgacncgtctggcagccgagacncgcttgactatttcggtcgtacagganacgagtaactacgtacngttactttcgtagtcgagtacg

SEQ ID NO: 86158 - DNA, 689 bp, Homo sapiens
  misc_feature: GYAE6OF02I9YRQ.22.30.C08.1.454.CMB.1.raw
  modified_base (278)..(278): a, c, t, g, unknown or other
  misc_feature (278)..(278): n is a, c, g, or t
tcagacatacgcgtcacgaccggtgctcgatttagtctgacgtcaaagggaaaggggagctctgggagtctgcaccatggcttggaccccactcctcttcctcaccctcctcctccactgcacagggtctctctcccagttgtactgactcaatcgccctctgcctctgcctccctgggagcctcggtcaacctcacctgcgttcttagtagtcaacacgattactacgaccgtcgcgtggcatcaacgacagccgagaaggccctgctactaatganattggcctatttgcagccacgacgaaggggtcggaatcccgtagattccgaccttcgtacgggctaccgagtcctgtcggggccgacgcgcctacctccgaccacgttctcccaagccctccgacgttcagaacgagttgacgggtccttggaaccttaagttcctaggttaccaaggtaaccagggttacgggaccgaccggtggtacccgttcgttacgggccgtttcggggtttacccgggacggggtacggtaaacccggtaaacgttccggaaaccggtacccgtccggttaagggtaccctaacggggcccctaacggggcctttaacccggcccccggttaacggtcccgtaacgttcccgtccgttaccccccgtccgttacccccgttagacccggtaccgg

SEQ ID NO: 86159 - DNA, 532 bp, Homo sapiens
  misc_feature: GYAE6OF02F9O5L.22.30.C08.1.454.CMB.1.raw
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgcgtttcctagtgctattttagagtgtcagtgtgaggtgcgcctggtggaatcgtgggggggccttgggtccagccgtggggggtccctgagactcgcctgtgcagcctctggattcgagtttggagcctactgtctgacttgggtcccnccaggctccgagggagggctgggagtgggtgccagcatcaagagacggacaataaggtaattttangtggacttctggtgaaggtccgtattccactatctaccagacgacaacgtcaaagactcactgtttcngcagntggacagctgacgagccgaggacacggtctggtctagtttctgtcgtctaaggagacggatactactacagttattcgttagtacgagtac

SEQ ID NO: 86160 - DNA, 568 bp, Homo sapiens
  misc_feature: GYAE6OF02HT1OB.22.30.C08.1.454.CMB.1.raw
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (338)..(338): a, c, t, g, unknown or other
  misc_feature (338)..(338): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcggcgtgttctaggtcgctatttagagtntcagtgtgngtgcgctggtgatcgtgggggctggtccagccgtggggtcctgagctcgctgtgcagcctntggattcgagtttggngtcctatgtctgtacttgggccncaggctccgagggacgggctgggagtcgggtgccagcatcaacgagacganagtaaagtatttagcgttgactgtagtgaacggcgtattcncctattcncgagagaacacggtcaagtactctactgtttnacgcagtcgagacncgtcgngacgacgaccgtacgaccgtacgtcttacgttcgttagtttcgtagttacgtacggaaggtacgtaacggtaagtaacgttaacgtaacgttagttttaacgttacgttaacgttacggtaacgtaacg

SEQ ID NO: 86161 - DNA, 624 bp, Homo sapiens
  misc_feature: GYAE6OF02JDEMQ.22.30.C08.1.454.CMB.1.raw
  modified_base (186)..(186): a, c, t, g, unknown or other
  misc_feature (186)..(186): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctccctgggacncctcggtcaacctcacctgcgtttcttagtagtcaacacgtattactacaccgtcgcgtggcatcaacacagcggagaaggccctgctactaatgaagattggccattttggcagccacacgaaggggtcggatccctgatcgcttcgtcgggctccagctcgtggggccgagcgtctacctcaccatctaccacgtccctccgacgttctgaacgtagtcgacgggctggtaacttagttacctgtcaagactaggtcgggaccgtcgtagggcttcgtgggtccttggttaccgggcgggaacggggaccaaggtccgtaggtaccccgttccgtaggtccgacggaccccgtacgggccttacggccccccgttgggtacctaccggttccttcccggttaccccctaccccggttctacccgtacgggtacccg

SEQ ID NO: 86162 - DNA, 563 bp, Homo sapiens
  misc_feature: GYAE6OF02I1O82.22.30.C08.1.454.CMB.1.raw
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgaactggcttttcctcgttgctattttagaaggtgtccagtgtgaggtgcgcctggtggaatcgtgggggggccttggtccagccgtggggggtccctgagactcgcctgtgcagcctcgtggattcgagtttggagcctactgtctgacttgggtccgcaggctccgaggggagggcgtgggaggtggggtggccagcatcaacggaagacggacaagtaaggtaattttagngtggccctntggtaggaaggggccgatttaccgacctaatcctacccgagacgaaccaacgtacaagaactcacttgttctgcagtactgacacgcctgcgaggccgaggaccgcggcttgtccttattcgtgtcgtacagaagacgagtaatacgtacagttatttcgtatgtacgataagg

SEQ ID NO: 86163 - DNA, 552 bp, Homo sapiens
  misc_feature: GYAE6OF02G4ICX.22.30.C08.1.454.CMB.1.raw
  modified_base (401)..(401): a, c, t, g, unknown or other
  misc_feature (401)..(401): n is a, c, g, or t
tcagacatacgcgtcacgaccggtgctcgatttagtctgacgtcaaagggaaagggggagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaatgaagattggccattttggcagccaccacaagggggtcggatccctgatcgcttcgtcgggctccagctcgtgggggccagccgctacctcaccatcctccacgcctccagtctgaagntgaggctgactattactgtacagacagtcgggacgcgtggcgtcgtggctggttcggcggacgggacagcgtcggaccgtccgtaggtcacgccgaaggcctcgtccccgtggtccacgtccgtcgttccccgccctcccgtcgaccgtcg

SEQ ID NO: 86164 - DNA, 569 bp, Homo sapiens
  misc_feature: GYAE6OF02IJ03Z.22.30.C08.1.454.CMB.1.raw
  modified_base (379)..(379): a, c, t, g, unknown or other
  misc_feature (379)..(379): n is a, c, g, or t
  modified_base (469)..(469): a, c, t, g, unknown or other
  misc_feature (469)..(469): n is a, c, g, or t
  modified_base (546)..(546): a, c, t, g, unknown or other
  misc_feature (546)..(546): n is a, c, g, or t
tcagacatacgcgtcacgaccggtgctcgatttagtctgacgtcaaaagggaaaggggctcagagaggagccttagccccggactccaaggcctttccacttggtgatcagcactgagcacagaggactcaccatgggattggggctgagcgtggcttttccttgttgctattttagaaggtgtccagtgtgaggtgcgcctggtggaatcgtggggggccttggtccagccgtggggggtccctgagactcgcctgtgcagcctctggattcgagtttggagcctactgtctgacttgggtccgccaggctccgaggggtaaggggctgggagtgggtcggccagcatcaacgaagacggacagtaaggaattttagnggtaggccttcgtggtaggaaggggtccgtattccaacctattcctccaaggacgaaccaaacgtcaaagaacctcgtaacttgtttacnggcagtatggacagcctgcgagccgagacgcgtctgtcttattcgtgtgtcgaaggacgtacgaagtataaccgtanacgttattcgtagtgacgtaacg

SEQ ID NO: 86165 - DNA, 572 bp, Homo sapiens
  misc_feature: GYAE6OF02HKE1O.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagattggccattttggcagccaccacgaagggggtcggatccctgatcgcttctcgggctccagctcgtggggccgagcgctacctcacccatctccagccctccacgtctagaagatggacggctgacttattcgtgtcagacagtgggacgcgtggcgtcgtggtcttgggttccgggcggacgggaccaagccgttacggacccgtccgtagggtccacggcccaagggtcctaccggcccccgtcggtccaccgttcgtccgttccccgcccctcctcgaccgtcg

SEQ ID NO: 86166 - DNA, 531 bp, Homo sapiens
  misc_feature: GYAE6OF02H5WSV.22.30.C08.1.454.CMB.1.raw
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
  modified_base (479)..(479): a, c, t, g, unknown or other
  misc_feature (479)..(479): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggctttccttgttgctattttagaaggtgtccagtgtgaggtgcgcctggtggaatctgggggggccttggtccagcctggggggtccctgagactcgcctgtgcagcctctggattcgagtttggagcctactgtctgacttgggtcccgcagggctccgaggggaagggctgggagtggggtggccagcatcgaacgaagacggacagtaaggattttangtggctctgtgaagggccattcaccatctccagacgacaacgtacaagaactcacttgttcngcagatggacagctgcgagccgaggaccaggctgtctatttcgngtgtcaggacgacggagtactaactagtaagttattacttaagtgaagtacg

SEQ ID NO: 86167 - DNA, 598 bp, Homo sapiens
  misc_feature: GYAE6OF02I8PWZ.22.30.C08.1.454.CMB.1.raw
  modified_base (300)..(300): a, c, t, g, unknown or other
  misc_feature (300)..(300): n is a, c, g, or t
  modified_base (462)..(462): a, c, t, g, unknown or other
  misc_feature (462)..(462): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttcctgttgctattttagaaggtgtccagtgtgaggtgcgcctggtggaatcgtggggggccttggtccagcctggggggtccctgagactcgcctgtgcagcctctggattcgagtttggagcctatgtctgacttgggtccnccaggctccgaggggacgggcgtgggagtgggtcgccagcatcaacgagacggacagtaaggtaattttatgtggcctcgtggtagaagggccgtaattccaaccattcctacccgagaacgaacctaaaccgtacaaacgtaacctcaacttgttttaccngacagtataggacacgcccgtgaccggtagcccggaaggccgtaacggctagttctattttcgtacgtgtcgaaggtaacgtacggaagtacgttaacgtaccgtaagtttactttacgttaagtaggtagtaacg

SEQ ID NO: 86168 - DNA, 535 bp, Homo sapiens
  misc_feature: GYAE6OF02IXWDE.22.30.C08.1.454.CMB.1.raw
  modified_base (379)..(379): a, c, t, g, unknown or other
  misc_feature (379)..(379): n is a, c, g, or t
  modified_base (446)..(446): a, c, t, g, unknown or other
  misc_feature (446)..(446): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (526)..(526): a, c, t, g, unknown or other
  misc_feature (526)..(526): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatcgtgggggggccttggtccagccgtggggggtccctgagactcgcctgtgcagcctctggattcgagtttggagcctactgtctgacttcgggtccgccgaggctccgaggggaggggctggaggtgggtggccagcatcaacggaagacggacagtaaggtaattttagngtggcctcgtgtagaagggccgattccactatcctaccagacgacaacgtcaaagactcactgttcngcagatgacagctaggcgacgccgagaccacgggtctgtctatttcngttncgaganacganactacgtacagttacttntatgatacg

SEQ ID NO: 86169 - DNA, 689 bp, Homo sapiens
  misc_feature: GYAE6OF02HOW8W.22.30.C08.1.454.CMB.1.raw
  modified_base (386)..(386): a, c, t, g, unknown or other
  misc_feature (386)..(386): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgtcgtttcctagtgctatttagaggtgtcagtgtgaggtgcgctggtgaatcgtggggggccttggtccagccgtggggggtccctgagactcgcctgtgcacgctcgtggattcgagtttggagtcctacgtgtctgacgtttgggtccgccgaggcctccgaggggaaggggctggaggtgggcgcccaggccaatcgaaacggaagacggacaagtaaaggtaattttagnggtacggcctgtggtaggaaacgggtccgtattacaccgtatccgtaccgaggtaacgacctaaacggtacgaaaacgtaaccttcgtaacctttgttttaccgagtaccgtaaggtacggttacgggaaccgaacggtcccgttacgggaccggtaacgggaccccggtaaagggacccgtaaccggggtcctttacggttaccttttactttttaccgggtggttacgtacggaaggtaacggacgtaacgtaacttaaccgttagtacgttactttacgtaacgtacggtaacgtaacgg

SEQ ID NO: 86170 - DNA, 533 bp, Homo sapiens
  misc_feature: GYAE6OF02HKJXF.22.30.C08.1.454.CMB.1.raw
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgcgtttcctgtgctattttagagtgtccagtgtgaggtgcgcctggtggaatctgggggggccttggtccagcctggggggtccctgagactcgcctgtgcagcctctggattcgagtttggaaccctactgtctgacttggggtccgccaggctccgagggaagggggctgggagtgggtggccaggcatcaacgagacganataaggattttagngtgctntgtgaaggcatcacatcncagagacaacgtcaaagactnacttgttcngcagtatggacagcctgcgacgccgagacgcggctgtacttatttcgtgttcgtacgaggtaagacgtagaacttaaccgtacaggttactttcttaagtggatacgtag

SEQ ID NO: 86171 - DNA, 663 bp, Homo sapiens
  misc_feature: GYAE6OF02J1ZGJ.22.30.C08.1.454.CMB.1.raw
  modified_base (182)..(182): a, c, t, g, unknown or other
  misc_feature (182)..(182): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacaggtctctctccaggttgtactgactcaatcgccctctgcctctgcctccctgggancctcggtcaacctcacctgcgtttcttagtagtcaacacgattacacaccgtcgcgtggcatcaacaacngccgganaacggccctcgctactaactgaagattggcctattttggcagccaccacgaacggggtcggatccctgactcgacttcgtcgggctccagctcgtcggggccgagccgcgtacctcaccgactcctcgacgtccctaccgagtcgtagaacgatcggacggtactaggacttagttactacgtacaacgactaacggttcgggaccgtacggtcggtccttcgtgggtacgttcgggttccgggcgggtaaccgggaacctaacgggtcctacgggtaacccggtttccgtaacgggtccgtaccggaccgtaaccggtccgtacccggacccccgttcggtaccctaaccgttcccgttaccggttaccccctacccgttccccgtaccgtacccggttaccg

SEQ ID NO: 86172 - DNA, 551 bp, Homo sapiens
  misc_feature: GYAE6OF02H9995.22.30.C08.1.454.CMB.1.raw
  modified_base (375)..(375): a, c, t, g, unknown or other
  misc_feature (375)..(375): n is a, c, g, or t
  modified_base (448)..(448): a, c, t, g, unknown or other
  misc_feature (448)..(448): n is a, c, g, or t
  modified_base (498)..(498): a, c, t, g, unknown or other
  misc_feature (498)..(498): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatcgtgggggggccttggtccagccgtggggggtccctggagactcgcctgtgcagcctcgtggattcgagtttggagcctactgtctgacttgggtccgcaggctccgaggggaagggctaggagtgggtggccagcatcaacgaagacggacagtaaggtaatttangtgctctggtgaagggccgattcacctatcctaccgagtaagaccaaacgtcaaagacctcacttgtttaccngcaagatggacacgctaggcgagccggagccacggctgtcttagtttccngttcgcaggagacgagtaactacctacgagttactttacttaatcggtatacg

SEQ ID NO: 86173 - DNA, 718 bp, Homo sapiens
  misc_feature: GYAE6OF02GYVME.22.30.C08.1.454.CMB.1.raw
  modified_base (184)..(184): a, c, t, g, unknown or other
  misc_feature (184)..(184): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgcctctgcctctcgcctccctgggancctcggtcaacctcacctgcgttcttagtagtcaacacgtattactacaccgtcgcgtgcatcaacacagccgagaacggccctcgctacttaatgaagattggcctattttggcagccaccgacgaagggggtcggactcccgtgactccgcgtttacgtccggggctccgagcgttcgtcgggggccgacgcgccttacctccaccacgtcctccgacgtccctaccagttcctagaacgtacgtaggtacgggtcttacggtaacttaagtttaccgttcggtaccgtaggtaacctagggttacgggaaccggtcgtcgggtcccgttcggtcgggttccgtttcgggttaccggggaccggggtaacggggaaccgtaacgggttaccgtacggtaaccccgttccggttaacgggtccaccgggtaaccccgaagggttccccgtaccggtccccccggttacgggttacccgtaccgttcccgttaccggttcccctaaccccgttcccgttaccgaccgttcccgg

SEQ ID NO: 86174 - DNA, 569 bp, Homo sapiens
  misc_feature: GYAE6OF02GYFR5.22.30.C08.1.454.CMB.1.raw
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgcgtttcctagtgctatttagagtgtcagtgtgaggtgcgcctggtggaatcgtggggggccttggtccagcctggggggtccctgagactcgcctgtgcagcctctggattcgagtttggagtcctactgtctgacttgggtccnccgaggctccgagggtagggctgggagtgggtgccagcagtcaacgaagacggacagtaaggactttanagtgctcgtgtaggaacggtcattccgactagtctccgagagacaacggtcaaagactcacttaggttcctgaccgtaagngtacggacncgcgtagacgacggaccgacggacgtacggtctaggttctttacgttcgtgttcgtagaacggacgtacgaagttactaacgtacgtagtttacttacgtagtacgagtacg

SEQ ID NO: 86175 - DNA, 713 bp, Homo sapiens
  misc_feature: GYAE6OF02HS1MN.22.30.C08.1.454.CMB.1.raw
  modified_base (174)..(174): a, c, t, g, unknown or other
  misc_feature (174)..(174): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggtttcctcgttgctctttaagnggtgtccagtgtcaggtgcagctggtggagtcgtgggggagcgtggtccagccgtgggaggtccctgacgactcttcctgtgcagcgtcgtggattcaccttcgagtggactagtggcatgcacgtcggccctccggcccaggtcccgtcccgggggacgaaacgggggtctaggggtacggttgggggttaggaccttaaagtttagtaggttcggtaagtggaagttaagggtaaaacgtaaagtaaaagtactttaagtcggtacggacctttacgggagggtaaacgggtccgtaactttacccgaacctacgttccgtaccgaagtaccgaactaaacctaccgaaaacgtaaccactttccgttaacgtttaccaaacccgtaaaagttaaccggtaaaccgtacggtacccgttaagggaacggtaccgggacgggtaaacggaacgaacccgggacgtaggttacggttacgtaacgttggaggacgtaaggagttacgccgtaacgagttaggaaccggttaaggtaacg

SEQ ID NO: 86176 - DNA, 692 bp, Homo sapiens
  misc_feature: GYAE6OF02GTI8K.22.30.C08.1.454.CMB.1.raw
  modified_base (254)..(254): a, c, t, g, unknown or other
  misc_feature (254)..(254): n is a, c, g, or t
  modified_base (420)..(420): a, c, t, g, unknown or other
  misc_feature (420)..(420): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacngccggagaacgggccctcgctacttaatgaagattggcctattttggcagcccaccgacgaaggggggtcggactcccgtgatcgcttcgtcgggctccgagctcgtcggggccgagcgcctacctcgacctatcctaccacgtccctccgagttcctagaacgtntacggacggtctaggtacttaattacgtcggttacaacgacgtaaggttacggggaccgtcgttacggggccgttcggtacggggtccgttcggggtttacccggggacggggtaaacggggacccgtaaggtccgttaacggtacccggttaccgtaggtccgaaccggtccccgaagggtcccgtacccggtccccccggttacggtaccctacgttacccgttcccggttaccccccgtccccgttcccgttacccgtaccggtaccgg

SEQ ID NO: 86177 - DNA, 588 bp, Homo sapiens
  misc_feature: GYAE6OF02JENX8.22.30.C08.1.454.CMB.1.raw
  modified_base (392)..(392): a, c, t, g, unknown or other
  misc_feature (392)..(392): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (523)..(523): a, c, t, g, unknown or other
  misc_feature (523)..(523): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgtcgttctagtcgctatttagagtgtcagtgtgaggtgcgcctggtggaatcgtggggggccttggtccagccgtggggggtccctgagactcgcctgtgcagcctcgtggattcgagtttggagtcctctgtctgtccgttgggcccgccgaggcctccgaggggaaggggccgttgggaggtcggggtgcccgagccgtaagtccgaaacgacggacggacaagtaaggtaatttagngtggcctcgtgtgaaggccgattccgacctatcctccgaatacgaactacgacgaaanactcacgttntttaccgngacagngcgancgtctacgacgacgcggaacgcgtaggtctagtcgttagttcgngtacgacgtaggaacgtacgagtacgttaacgtacgttagtttacttacgtagtacggtacgtag

SEQ ID NO: 86178 - DNA, 711 bp, Homo sapiens
  misc_feature: GYAE6OF02JRS5M.22.30.C08.1.454.CMB.1.raw
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (475)..(475): a, c, t, g, unknown or other
  misc_feature (475)..(475): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgctggtggaatcgtggggggccttggtccagccgtgggggtccctgagactcgcctgtcgcagcctcgtggattcgagtttgagcctacgtgtctagtacgttcggtccgccgaggcctaccggagggagggcgtgggagtgggtcgaccgagcatcgaacggagacggacagtaagtattagngtacgcctngtagaggtcctattccgactatccgtaccgaaggtaccgtaaccgtaaccgtacgaaaacgtacctacgtaacgtttggtttaccngggaccttaaggacgtaccggtaccgtaacggtccctaagggtcccgacggggtacccccgaagggtacccccgtaggtaccccgttttaggtaccgtttaaccgttttcgggaggtttacccggtaacgaaccggggttaacgtaacccgggtaagttaaccttttaaaccccgtagggtttaacgtttaaccgttttaaccggttttacggaagggtaacccgttttaaacggg

SEQ ID NO: 86179 - DNA, 534 bp, Homo sapiens
  misc_feature: GYAE6OF02GA0VF.22.30.C08.1.454.CMB.1.raw
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagagtcaacacgattactacaccgtcgcgtggcatcaacaacagccggagaaggggccctcgctacttaatgaagattggccatttggcagccacacaagggggtcgatccctgatcgcttcncgggctccagctctggggccagcgctactcaccntctccagtccctccagtcctgaagntgagctgactatacngtcagacatgggacncgtgcgtctggctggttcgggagggtacggaccagtctggacccgtcgtaggtcacgtcccgaggcctacgcccccgtgtcacgtctcgtccccaccctcgtaccacgtccg

SEQ ID NO: 86180 - DNA, 603 bp, Homo sapiens
  misc_feature: GYAE6OF02IN57N.22.30.C08.1.454.CMB.1.raw
  modified_base (391)..(391): a, c, t, g, unknown or other
  misc_feature (391)..(391): n is a, c, g, or t
  modified_base (463)..(463): a, c, t, g, unknown or other
  misc_feature (463)..(463): n is a, c, g, or t
tcagacatacgcgtcacgaccggtgctcgatttagtctgacgtcaaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgtttcttagtagtcaacacgattactacaccgtcgcgtgcatcaacaacagccggagaacgggccctcgactacttaatgaagattggcctattttggcagccaccgacgaaggggggtcggactcccgtgactcgcttcgtccgggctccgagcctcgtcggggccgagccgtctaccctcaccnctcctccacgccctccagtcctagaagtagtggaacggctagacttattacgtgtcaagacgagtcgggacncgtggcgttgtggtcgttggttcgggacgggacggaccaaggcgtacgaccgtccgtagtcgacgcccgaaggcctccggccccgtggtcctaaccgttccgttcccggttccccgccccttccgtaccgaccggtaccg

SEQ ID NO: 86181 - DNA, 630 bp, Homo sapiens
  misc_feature: GYAE6OF02IV6CA.22.30.C08.1.454.CMB.1.raw
  modified_base (164)..(164): a, c, t, g, unknown or other
  misc_feature (164)..(164): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
tcagacatacgcgtcacgaccggtgctcgatttagtctgacgtcaaagggaaagggggagcgtctggggagtctgcaccatggcttggacccactcctcttcctcaccctcctcctccactgcacagggtctctctcccaggttgtactgactcaatcgccctntgcctctgcctcctgggagcctcggtcaacctcacctgcgtttcttagtagtcaacacgattacacaccgtcgcgtgacatcaacaacaggccggagaacgggccctcgctacttaatgaagattggccattttgcagccaaccacgaagggggtcggactcccgtgatcgcttcgtccggggctccganctcgtggggccgaggcgctaccctcgaccntcnccagtccctcagtcctagaacgngtggacggctaggacttacgttactcgtcagtacagtacgggacgttcgtgggtacgtcgtggtcttcggtttccgggacggaggacccgaagtccgttaacgggacccgttaaccgtacgggttccacggtaccccgaagggcccttaccggcccccggttacggaccgtacccgtttccgttacggttcccccggcccttaccgtacctacggtaccg

SEQ ID NO: 86182 - DNA, 542 bp, Homo sapiens
  misc_feature: GYAE6OF02FQ77Q.22.30.C08.1.454.CMB.1.raw
  modified_base (375)..(375): a, c, t, g, unknown or other
  misc_feature (375)..(375): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatcgtgggggggccttggtccagccgtggggggtccctgagactcgcctgtgcagcctctggattcgagtttggagcctactgtctgacttgggtcccgcaggctccgaggggagggctggaggtgggtggccagcatcgaacgaagacggacagtaaggtaattttanggtggcctcgtgtagaaggggccattcaccatcctcagagacaacgtcaaagactcactgttcngcagntggacagcctggcgaggccgaaggaccacggctgtcttatttcgtgtgtacgaggacgacgagtactacctagtagtttacttacgttatgagtaacg

SEQ ID NO: 86183 - DNA, 587 bp, Homo sapiens
  misc_feature: GYAE6OF02I54CQ.22.30.C08.1.454.CMB.1.raw
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
  modified_base (551)..(551): a, c, t, g, unknown or other
  misc_feature (551)..(551): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgcctctgcctctgcctcccgtgggacgcctcggtcaacctcacctgcgttctagtagtcaacncgattactacaccgtcgcgtggcatcaacacngccggagacggcctgctactangaantggctattgcacgccacacgagggtcgatccgngactcgctcgcggctccgagctcgtcggggcctacgcggtcctacctccaccatccgtcacgtccctccagtctagaacgngtaggcggctcggaacttacgttcgtacgtcgaacgtacgtaggtacgggtaccgcgttcggcgttccgtggtcgttcggttcgggacggtaccggacgaacgtcgtaccgaccgtacgtacgtcgaccgtacgacggtcgtccgtcccgtcggtaccncgttcgttccgtcccctccgtcccgtacgccgtacg

SEQ ID NO: 86184 - DNA, 567 bp, Homo sapiens
  misc_feature: GYAE6OF02FLPRG.22.30.C08.1.454.CMB.1.raw
  modified_base (184)..(184): a, c, t, g, unknown or other
  misc_feature (184)..(184): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaaggccctcgctacttaatgaagattggcctattttggcagccaccacgaagggggtcggatcccgtgatcgcttcgtcgggctccagctcgtcggggccgagccgctacctcaccatctccagccctccagtcctagacgatggaggctgacttatactgtacagacagtcggacgtcgtggtctcgtggcttggtcgggcggaggaccaagctacgccgtcgtagtccacggcccaagggtccctccggcccccttcggtccaccgttcgttccgttcccccgaccttccctaccgaccggtcg

SEQ ID NO: 86185 - DNA, 569 bp, Homo sapiens
  misc_feature: GYAE6OF02HIMEL.22.30.C08.1.454.CMB.1.raw
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaatgaagattggccattttggcagccaccacgaagggggtcggatcccgtgatcgcttcgtcgggctccagctcgtggggccagcgctacctcaccatctccagccctccgagtctgaagntgagctgacttattactgtcagacagtgggacncgtggcgtcgtggcttggttcggcgggagggaccaagcgtcgaccgtccgtagtccgacgcccgaaggcctaccggcccccgtcggtaccaccgttccgttccgttaccccaccccgttccctaccgtaccgtccg

SEQ ID NO: 86186 - DNA, 666 bp, Homo sapiens
  misc_feature: GYAE6OF02G22B4.22.30.C08.1.454.CMB.1.raw
  modified_base (387)..(387): a, c, t, g, unknown or other
  misc_feature (387)..(387): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtggtcttttccttgttgctattttagagtgtcagtgtgagtgcgcctggtggaatcgtggggggccttggtccagccgtggggggtccctggagactcgcctgtgcagcctcgtggattcgaggtttggagtccttactgtctgacttgggtcccgccaggctccgaggggacgggctgggaggtgggtggccaggcagtcgaaacgaagacggaacaagtaaacggtaattttanggtaggccttcgttggtaggaacggggcctagttccaactactctaccagacgtaacgaaccgtacgaaataacctctaaccgtttgtttactcggactaggtacttagggactacggcccgttggaccggacggacccggtaacgggaaccgtacggtctttacggttacctttagtttcccgtaggtgttaccgaaaggtaccggaaagttaacggtactttaaaccgtacgttaacggtttaacgtttacctttaacggtaggtaaccgttaacgg

SEQ ID NO: 86187 - DNA, 535 bp, Homo sapiens
  misc_feature: GYAE6OF02I8OXZ.22.30.C08.1.454.CMB.1.raw
  modified_base (260)..(260): a, c, t, g, unknown or other
  misc_feature (260)..(260): n is a, c, g, or t
  modified_base (350)..(350): a, c, t, g, unknown or other
  misc_feature (350)..(350): n is a, c, g, or t
  modified_base (436)..(436): a, c, t, g, unknown or other
  misc_feature (436)..(436): n is a, c, g, or t
  modified_base (528)..(528): a, c, t, g, unknown or other
  misc_feature (528)..(528): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttctagtagtcaacacgattactacaccgtcgcgtggcatcaacaacagccgganaagggccctcgctacttaatgaagattggcctattttggcagccaccacaagggggtcggatccctgatcgcttctcgggctccaggctntgggggccagcgctacctcacatctaccagcctccagtctgaagatgagctgactattactgtcagacatgggacgctggcgtacnggctggttacggcggaagggacccaagcgttgacccgtcctaggtacagtcccaaggctcgcccctggaccactcgtcttcccacccttccncagtccg

SEQ ID NO: 86188 - DNA, 512 bp, Homo sapiens
  misc_feature: GYAE6OF02HSQB4.22.30.C08.1.454.CMB.1.raw
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (430)..(430): a, c, t, g, unknown or other
  misc_feature (430)..(430): n is a, c, g, or t
  modified_base (469)..(469): a, c, t, g, unknown or other
  misc_feature (469)..(469): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgctggtggatcgtggggggccttggtccagccgtggggggtccctgagactcgcctgtgcagcctcgtggattcgagtttggagtcctactgtctggacttgggtcccgccaggcctcgagggaggggctggagtgggngccagcatcaagagacganataaggatttagngtgctgtgtagagggcattcacatctacagagacaacgtcaaagactcattgtttcagcagtntggacagctgacgagcgagacgacgctgtactatttcgngttcgcaggcgagatatactacagttactttcgtaatgataag

SEQ ID NO: 86189 - DNA, 559 bp, Homo sapiens
  misc_feature: GYAE6OF02FPFCL.22.30.C08.1.454.CMB.1.raw
  modified_base (402)..(402): a, c, t, g, unknown or other
  misc_feature (402)..(402): n is a, c, g, or t
tcagacatacgcgtcacgaccggtgctcgatttagtctgacgtcaaagggaaagggggagctctggggagtctgcaccatggcttggaccccactcctcttcctcaccctcctcctccactcgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaacgggccctcgctacttaatgaagattggcctattttgggcagccaccacgaagggggtcggatccctgatcgcttcgtcgggctccagctcgtggggccgagcgctacctcaccatctccagtccctccagtctgaagntgacggctgacttattactgtcagacagtgggactcgtggcgtctgggcttggttcgggcgggacgggaccaagctacggaccgtcgtacggtcacgcccgaggcctccgcccccgtggtccacgttcctccgttccccgccctccgtcaccgtccg

SEQ ID NO: 86190 - DNA, 557 bp, Homo sapiens
  misc_feature: GYAE6OF02F51A6.22.30.C08.1.454.CMB.1.raw
  modified_base (185)..(185): a, c, t, g, unknown or other
  misc_feature (185)..(185): n is a, c, g, or t
  modified_base (254)..(254): a, c, t, g, unknown or other
  misc_feature (254)..(254): n is a, c, g, or t
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
  modified_base (436)..(436): a, c, t, g, unknown or other
  misc_feature (436)..(436): n is a, c, g, or t
  modified_base (537)..(537): a, c, t, g, unknown or other
  misc_feature (537)..(537): n is a, c, g, or t
tcagacatacgcgtcacgaccggtgctcgatttagtctgacgtcaaagggaagggggagctctggggagtctgcacccatggcttggaccccactccctcttcctcaccctcctcctccactgcacagggtctctctcccaggttgtactgactcaatcgccctctgcctctgcctccctgggancctcggtcaacctcacctgcgttctagtagtcaacacgattacctacaccgtcgcgtggcatcaacacngccggagaacggccctcgctacttaatgaagattggcccattttggcagccaccacgaaggggtcggatccctgatcgcttctcgggctccganctctggggccagcgctacctcgaccatcnccagccctccagtcctgaacgatgacggctacgactattacctgtcagactagtggacnctggcgtcgtggtctgtcggcggagggacccaagcctgaccgtctacggtcacgcccgaaggtcctcggccccctcggcctaccgttcctcggttaccccncccgtccctcgaccgtaccg

SEQ ID NO: 86191 - DNA, 525 bp, Homo sapiens
  misc_feature: GYAE6OF02JE6MY.22.30.C08.1.454.CMB.1.raw
  modified_base (451)..(451): a, c, t, g, unknown or other
  misc_feature (451)..(451): n is a, c, g, or t
  modified_base (485)..(485): a, c, t, g, unknown or other
  misc_feature (485)..(485): n is a, c, g, or t
  modified_base (518)..(518): a, c, t, g, unknown or other
  misc_feature (518)..(518): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatctgggggggccttgggtccagcctggggggtccctgagactcgcctgtgcagcctctggattcgagtttggagcctactgtctgacttgggtcccgccaggctccgaggggaaggggctgggagtgggtggccagcatcaacggaagacggacagtaaggtaattttatggtggcctctgtgaaggggccgattcaccatctaccagagacaacgtcaagactcactgttctgcagatggacngcctgcgagccgaggacacggctgtctatttcgngtgcaggagacgagatacactagtcttagttangagtacg

SEQ ID NO: 86192 - DNA, 1038 bp, Homo sapiens
  misc_feature: GYAE6OF02GEAX4.22.30.C08.1.454.CMB.1.raw
tcagacatacgcgtcacgaccggtgctcgatttagtctgacgtcaaagggaaagggggagctctgggggagtctgcaccatggcttggaccccactcctcttcctcaccctcctcctccactgcacagggtctcctcctccgtaggttgtactgactacaactccgccctcgtcgtcctcgtcgtccctcccgtgggacgtcccgtccggtaccaaccctcctaccgttcggttaccgttttacgttaaggttacgtaaccaaaccgtaacgtaactttaacctaaccgtacccggtcggtcggtacggacctaactaaccaaaaccgaaccgaaccgggacccggggaaagggtaacccgggtcccccgtacggtaccctttaaacgtttaaacgtaggaaaaggttacgttcggtacctttaggttttcggacgacgaccccgaaccggaacggggtaacgggggggtccgggtaacccttcccggtaggtaccgttcggtcccgtttccgggtcccgggtacctcccggtagtccggttccgggtccgggggccgacggtcccgtcccgtaacccgtccaacctaccgtcccgaccctccggtacccctaccgtacggttaccgaaggaacggtagtacgggtaacggtaccgttaacggtttaaccgtttacgtttaccggtacgtaccgtaaggtaaccgggttaaggggttaccgggtacgggttcgggtttaccgggttccggttcggtttccggggttacgggtttaccgggggtacccggggggttaacgggggaaacccgggttaaaccggtaccgggttacccgggtttaaccgggttacccccggtttaacggggttaacccgggtaacccggtaccccgggttaaccccgggtaccgggttacccccgttacccccggggtcccccgggtttaaccccgtcggtttaccccccggtttccccggtaccccggttttccccccgtaccccggttttaccccgtacccgggtacccgtttacccggg

SEQ ID NO: 86193 - DNA, 568 bp, Homo sapiens
  misc_feature: GYAE6OF02F1WDI.22.30.C08.1.454.CMB.1.raw
  modified_base (460)..(460): a, c, t, g, unknown or other
  misc_feature (460)..(460): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgactacttaatgaagattggcctattttggcagccacacgaagggggtcggatccctgactcgcttcgtcggctccagctcgcggggcgagcgctacctcaccatctcacgccctacagtctagaagagtggagctgactattacgtgtacagacagtgggacgcgtggtcgtcgtggcgtggtcggnggacggacagcgagccgtacgtaggtcacgccgaacggtccgtccgtcccccgtcggtcctaccgttccgttacccgttccccaccccttccgtacccgacggtaccg

SEQ ID NO: 86194 - DNA, 646 bp, Homo sapiens
  misc_feature: GYAE6OF02JXAR9.22.30.C08.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
tcagacatacgcgtcacgaccggtgctcgatttagtctgacgtcaaagggaaagggggagctctggggagtctgcaccatggcttggaccccactcctcttcctccaccctcctcctccactgcacagggtctctctccaggttgtactgactcaatcgccctctgcctntgcctccctgggancctcggtaccaacctcacctgcgttcttagagtccaacacgnttacacnccgtcgcgtgcatcaacacagccggagaacggcctcgctacttaatcgaagacgttgcctatttggctacgccaacctaggtaacggggtcggtactccgtgactcgtcttcgtccggtctcctagcgtcggtcggccgagcgcctactcaccgntccncgactcccnccgtagtctacgaacgcgtagacggtctacgacttacttacgtcgtactacgacgtacgtcggtacgtacgtcggcgttacgtcgggtccgtgggtttccgggcgggtaacgggtaaccgacggtccgtacgggtacccgtaccggttacgtacgaccgcccggaacgggtcctaccggtccccgtccgtaccgtaccgttcccgtaccggtttccccaaccccgtccgtacccgtccggtaccg

SEQ ID NO: 86195 - DNA, 799 bp, Homo sapiens
  misc_feature: GYAE6OF02I1TB9.22.30.C08.1.454.CMB.1.raw
  modified_base (207)..(207): a, c, t, g, unknown or other
  misc_feature (207)..(207): n is a, c, g, or t
tcagacatacgcgtcacgaccggtgctcgatttagtctgacgtcaaagggaaagggggagctcgtggggagtctgcaccatggcttcggacccactcctcttcctcacctcctcctccactgcacgagggtctctcctccgaggttcgtactgactcaatccgcctctcgcctctcgcctccgtgggcgtccgtcggtacaacctcnccgtcgtcgtttcgttacgtacgtcaacacgtacttactacgtaccgtcgtcgtcggactactaccaaacgaacgacggaccggaaggaaccggcctacgtactaacttaagtacggaacgtacgttcggtactacgtttacggctacgaccaaccgtaacggtaacgggggtcggtactccgtacgtactcggtcgttcggacgggtctaccgtcgtccgtcgggtcgggaccgtacgcgtaccgtaccgtcgtaacctacgtcctaccgacgtacctcgtacgtcgtaagaacgtacgtcgtacggtacgtacgtacttacgtttacgtcgtacgaacggtacgtaacggtacgggtacgttcggtaccgggttcgttaccggttcgggtaccggttacggggttaccgggaccgggtaacgggtaaccgtacggtaccgttaccggtaaacccgttccgggtaacggttaccgaccgggttaaccggaaccggttcccggtacccggtacccgttaccgggttacccgttaccggttccggtttccccggtccccgttcccgtaccccgtaccggtaacccgttccggg

SEQ ID NO: 86196 - DNA, 585 bp, Homo sapiens
  misc_feature: GYAE6OF02I6XGN.22.30.C08.1.454.CMB.1.raw
  modified_base (184)..(184): a, c, t, g, unknown or other
  misc_feature (184)..(184): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgtttcttagtagtcaacacgattactacaccgtcgcgtggcatcaacaacagccggagaacggccctcgctacttaatgaagattggccattttggcagccaccacgaagggggtcggatccctgatcgcttcgtcggctccagctcgtggggccgagcgctacctcaccatctccagcctccagtctgaagatcgaggctagactattcgtgtacagacagtgggacctcgtgggacgtcgtgggcttggttccggacgggacgggaccaggcgtacggtaccgtcgtaggtccacggtcccgaaggccctccgcccccgttggtaccctaccgttcccgttcgttacccccaccccgttccgttacccgaccggttccg

SEQ ID NO: 86197 - DNA, 741 bp, Homo sapiens
  misc_feature: GYAE6OF02JBDAX.22.30.C08.1.454.CMB.1.raw
  modified_base (190)..(190): a, c, t, g, unknown or other
  misc_feature (190)..(190): n is a, c, g, or t
  modified_base (290)..(290): a, c, t, g, unknown or other
  misc_feature (290)..(290): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctcctcccaggttgtactgactcaatccgccctctcgcctctcgccctccctgggacncctcggtccaacctcgacctgcgtttcttagtacgtcaacacgtattacacaccgtcgcgtgcatcaacacagccgagacggcctcgctactaatgaagntcgcctagtttggcagcccaaccgacggaagggggtccgggaactcccgtagtactcggtccgtttcgtaccgggcctccacgccgttcggtcggggcccggaagccgaccttaccctccaccacttcctacccgtacgtcccttccagttaccgtagtaacgacgtcggacggtccttaacgtacgttaaacgtttctacggttacaacggtaccgtaaggttcgggaaccggtcgtacggtccgttcggtcggttaccggttcgggttaccggggaccgggtacggggtaaacccgaacgggttccgtaaccgggtacccggtaaccggttagggtaacccgaccggacccggaacggtccccgtaccgtccccggttaacccggttccgtaacccgtttcccgtcccgttaaccccctccccgtacccgttcccggtacccgttacgg

SEQ ID NO: 86198 - DNA, 582 bp, Homo sapiens
  misc_feature: GYAE6OF02JA2L6.22.30.C08.1.454.CMB.1.raw
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
  modified_base (529)..(529): a, c, t, g, unknown or other
  misc_feature (529)..(529): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtggtctttctgttgctatttagagtgtccagtgtgaggtgcgcctggtggaatcgtgggggggccttggtccagccgtggggggtccctgagactcgcctggtcgacacgcctcgtggacttcggagtttggagcctacgtgtctgacttgggtccncaggcctccgaggggaagggctggaggtgggtcgccgagcagtcaacgagaccggacaagtaaaggtattttagnggtggacctctagtaggaacgggtccgagttccacctatccgtaccgaaggacgaacctaacgtcaaaggtacctcacgttgtttccagcaggatcgggacacgtcctggccgacgccggagaccacgggtctaggtcttagttcngtcgtacgagtacgacgtagactctaacgtagttacttctagtcgagttaacg

SEQ ID NO: 86199 - DNA, 581 bp, Homo sapiens
  misc_feature: GYAE6OF02GY2W9.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctccctgggacgcctcggtcaacctcacctgcgttcttagtagtcaacacgattactacaccgtcgcgtggcatcaacaacagccggagaacggccctcgctacttaatcgaagattggcctattttggcagccaccacgaagggggtcggactcccgtgagtcgcttcgtcgggctccagctcgtcggggccgagcgctacctcaccactctccacgcctcagtctagaagatgacggctacgacttattacgtgtacagacagtcgggacgtcgtggtcgtcgtcggtcgttgggttccggacgggtacggaccaagccgtcgaccgtcgtaggtccgacgcccgaaggtcctaccggtccccgtcgtcctacgttcctcgttccccaccctcctacgccgtacg

SEQ ID NO: 86200 - DNA, 709 bp, Homo sapiens
  misc_feature: GYAE6OF02FJFQL.22.30.C08.1.454.CMB.1.raw
  modified_base (310)..(310): a, c, t, g, unknown or other
  misc_feature (310)..(310): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtggtcttttccttgttgctattttagaggtgtccagtgtgaggtgcgcctggtggatcgtggggggccttggtccagccgtggggggtccctgagacctcgcctgtgcacgcctctggattcgagtttggagccttacgtgtctgtacgttcgggtccnccaggcctccgaggggaaggggtctgggaggttggggtcggccaggcagtacaacggaaggacggacaagtaaacgggaattttagtggtcggaccttcgtggtacggaacggggcccgtaatttccgaacctacgttccctacccgaaggtaacgaaccctaaaccggtaccaaaacggtaaacccttactaaccgtttcggtttttacctcggacctaaaggtacgtgggaaccacgcccgttaggaccggaggacccggaagggacccgtaccgggctttacggttactttacgttttcgttcgggttataccggtaaagggacgaaaccggtaaggtaacctttaaccgaacgttaggttttaacctttacgtttaagttacggtaagttaacgg

SEQ ID NO: 86201 - DNA, 566 bp, Homo sapiens
  misc_feature: GYAE6OF02GDMXW.22.30.C08.1.454.CMB.1.raw
  modified_base (282)..(282): a, c, t, g, unknown or other
  misc_feature (282)..(282): n is a, c, g, or t
  modified_base (329)..(329): a, c, t, g, unknown or other
  misc_feature (329)..(329): n is a, c, g, or t
  modified_base (408)..(408): a, c, t, g, unknown or other
  misc_feature (408)..(408): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaangaagattggccattttggcagccaccacgaagggggtcggatcccgngatcgcttcgtcgggctccagtctcgtgggggccaggccgctacctcaccctatcctccagccctccgagtctagaagntggaggctgacttatactgtcagacagtcgggcgctgggctcgtcggcttgggtccggacgggtacggaacaggtcctggacccgtcgtaggtcacgccaaggcctccggcccccgtggtccaccgttcgtccgttccccgccctccgtcgaccgtcg

SEQ ID NO: 86202 - DNA, 641 bp, Homo sapiens
  misc_feature: GYAE6OF02JY9G0.22.30.C08.1.454.CMB.1.raw
  modified_base (187)..(187): a, c, t, g, unknown or other
  misc_feature (187)..(187): n is a, c, g, or t
  modified_base (402)..(402): a, c, t, g, unknown or other
  misc_feature (402)..(402): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatccgccctctgcctctcgcctccctgggacncctcggtcaacctcacctgcgttctagtagtcaacacgattacacaccgtcgcgtggacatccaaacaacagccggagaacggccctcgactacttaatgaagattggcctaagttttcggcacgcctaccacgaagggggtcggactccctgactcgcttcgtcgggctccgagtctccgtggggccgagcgctaccgccacctactcctaccncgtccctccagttctacgaacgctggacgtctagacttacttacgtacgtacaagacctgtacgggtaccgacgtcgggccgttacgtgggtcccgttgggtaccgggcggtaacggggacctaggtcctcggtacccgtacgttacggacaccggacgaacggtccgttacccggcccgttcggtaccgtaccgttccgtacccgttccccgacccgttcccgtacgaccggttaccg

SEQ ID NO: 86203 - DNA, 969 bp, Homo sapiens
  misc_feature: GYAE6OF02G39AQ.22.30.C08.1.454.CMB.1.raw
  modified_base (265)..(265): a, c, t, g, unknown or other
  misc_feature (265)..(265): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggtcttttccttgttgctattttagaaggtgtccagtgtgaggtgcgcctggtggatcgtggggggccttggtccagccgtcggggggtccctgagactcgcctgtgcagcctntggtattcgtaggtttcggagtcctacgtgtctgtacgtttcggggtcccgccgacgggtccgtacccggaggggggtacgggggtccgtaggggtacgggttcgggggttccgggcccgagggtaccgaacgttacccggaaaaaccgggtaaacggaacccggggaaccttaaacggttaaaacgggggttaaattttttacggtacggggtttaccggggtccctttacggttacggggtaaccggggtaaaaccgggggtccccggttaaccgttttacccgaaaccccgttacgttacccgttaccccggaaacgggtaaaccggtaaaacccgtaaacccggtttaaccgaaaaacggttaacccctttaccgttaacccgggtttttcgtttttaccgaacgggttaacccctaaagggggttaaccttacgggggtaaccctaaccgggttccccggttaacggggaccccggtaaacggggacccccggggttaaacggggtaaccccttaccccggggggttacctttaccggggtttaaacccttttaacggggttttttccccgtaggggttaacccggttacggtaacggggtaaaccggtaacccgggtaaagttaaaccggttttaaacccgttacgttaacggttttagttttaaccccgtttagggtaccgtaaacgggtttaaccg

SEQ ID NO: 86204 - DNA, 761 bp, Homo sapiens
  misc_feature: GYAE6OF02H6VP1.22.30.C08.1.454.CMB.1.raw
  modified_base (171)..(171): a, c, t, g, unknown or other
  misc_feature (171)..(171): n is a, c, g, or t
  modified_base (192)..(192): a, c, t, g, unknown or other
  misc_feature (192)..(192): n is a, c, g, or t
  modified_base (296)..(296): a, c, t, g, unknown or other
  misc_feature (296)..(296): n is a, c, g, or t
  modified_base (528)..(528): a, c, t, g, unknown or other
  misc_feature (528)..(528): n is a, c, g, or t
tcagacatacgcgtcacgaccggtgctcgatttagtctgacgtcaaagggaaaggggggtaggctctggggagtctgcaccatggcttggaccccactcctcttcctccaccctcctcctccactgcacagggtctctcctccaggttgtactgacctcgaactcgccctntcgcctctcgcctcctggacncctcggtccaacctcacctgcttcttagtagcaacacgacttaacaccaccgtcgcgtggcactacaacacgagccggagacggcctcgctacttatgaacgtntggcctattttcggctacgccacccgacggaacgggggtcggtactcccgtgtacgtcgctttcgtccgggccttccaggtccgtcgtcgggggccgacggccgcgtacccgtcaccctacgtcctaccgtcgccctaccgtacgtctacggtaagtacgtcggtaacggtccgtaagtaacctttaacgttacgtacggtactaacggtaactacggtcgggtaacccggngttacgggtaccgtttacggtcgggttactttacgggggtttacccggtacggggacccggggtaacggaacgtttaccggtaccgggtacccgtttaacccgggtacgggtccgtaccggacccggtaacgggtcccggtaccccggtccccgggttaacggttaccccgtaccgttccggttacccggtttcccccgtaacccggtttccctacccgtaccggttacccgg

SEQ ID NO: 86205 - DNA, 740 bp, Homo sapiens
  misc_feature: GYAE6OF02JZ6E4.22.30.C08.1.454.CMB.1.raw
  modified_base (256)..(256): a, c, t, g, unknown or other
  misc_feature (256)..(256): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctcccgtgggagcctcggtcaacctcacctgcgttcttagtagtcaacacgtattactacaccgtcgcgtggcatcaacaacngccggagaacgggccctcgctacttaatgaagtattcggacctagtttcggcagccacgacggaagggggtccggatcccgtagacgtcgtcgttcgtacggggctccgagcctcggtcgggggccgtagccgtcctacctccgaccgtactccgtccaacggtcccttccgaacggttcctaggaagtagtcggaacggtcttacggaacttacttacgtcgtaccgtagaaccgtagttacggggacgtacgtcgggaccgttcgtacgggtcgttcgggttaccgggacgggaacgggtaaccgaacggtccgttaccggtacccggttaccggtaacgggttaccggacccggtaacccgtaacggggtcccttacccgggtccccccggttacgggttacccgttaaccgtttcccggtttaccccggttaccccccgtaccccggtttacccttacccgggtaacccggttacccggg

SEQ ID NO: 86206 - DNA, 585 bp, Homo sapiens
  misc_feature: GYAE6OF02JEW4K.22.30.C08.1.454.CMB.1.raw
  modified_base (154)..(154): a, c, t, g, unknown or other
  misc_feature (154)..(154): n is a, c, g, or t
  modified_base (174)..(177): a, c, t, g, unknown or other
  misc_feature (174)..(177): n is a, c, g, or t
  modified_base (183)..(184): a, c, t, g, unknown or other
  misc_feature (183)..(184): n is a, c, g, or t
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
tcagacatacgcgtcacgaccggtgctcgatttagtctgacgtcaaagggaaaggggctcagagaggagccttagccccggactccaaggccctttccacttggtgatcagcactgagcacagaggactcaccatgggattggggctgagcggngtggtcaggtcgcattagannnngtgagnngctgtgancgtgggctgcagcngggtcnagcngctgnacgncngtgngtntagtgngctctgtntgtcgtgtcgcgcgtacgtcgaggaggacgtaggaggtaggtggacgcgacgacgtacgaacgacggacgtacgtaagtaagttaagttagttgtcggtcgtacgtaggtacggtacgtacgtacgtactacgtacgtcgacgacgaacgaaccgtaacgtaacgtacgtacgtacgtacgttacgttcgtacgtacgtacgtacgtacgacgtacgtacgtacgaccgacgacggacgacgacgtacgtacgttacgttacgttcgttacgtacgtacggtacggacgtacgtaagttagtagtacgttagttacgttacgtacgtagtacgtacg

SEQ ID NO: 86207 - DNA, 569 bp, Homo sapiens
  misc_feature: GYAE6OF02G5EXI.22.30.C08.1.454.CMB.1.raw
  modified_base (285)..(285): a, c, t, g, unknown or other
  misc_feature (285)..(285): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgcctccctgggacgcctcggtcaacctcacctgcgttcttagtagtccaacacgattactacaccgtcgcgtggcatcaacaacagccggagaacggcctgctactaatgaanttgcctatttggcagccacacgaggggtcgactccgtgactcgcttcgtcgggcctccagctcggtcggggccgagccgcctaccgtcacctatcctaccagtccctaccagtcctagaagactggacggtctagactattacgtgtcagacagtcgggacgcgtcgcgtcgtgccgtgtccgggacggtacggactaggcctacggacccgttcgaggtcacgacccaggctccgcccctaggtccacgttccgttcggtccccgcccgtcctcgtaccgtcg

SEQ ID NO: 86208 - DNA, 539 bp, Homo sapiens
  misc_feature: GYAE6OF02F42UU.22.30.C08.1.454.CMB.1.raw
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtgaatcgtggggggccttggtccagccgtggggggtccctgagactcgcctgtgcagcctctggattcgagtttggagcctactgtctgacttgggtccgcaggctccagggagggctggagtgggtggccagcatcaacgagacgacataaggatttagngtgctntgngaaggccgattcactatctcagagacaacgtacaagactcactgtttcngcagatcgacagctaggcgacgccgaggaccacggtctagttcttatttcgcgttgtacgaggtaacgagtacgaagtttacctacgacgtttagttactttaagtcgaagttaacgg

SEQ ID NO: 86209 - DNA, 694 bp, Homo sapiens
  misc_feature: GYAE6OF02FXAEL.22.30.C08.1.454.CMB.1.raw
  modified_base (383)..(383): a, c, t, g, unknown or other
  misc_feature (383)..(383): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgcctcccgtgggacgccgtcggtccaacctcacctgtcgttcttagtacgtacaacacgtattactacaccgtcgcgtgcatcaacacagccggagacggccctgctacttaatgaagtattggcctagttttcggcagccaaccacggaaggggtcggactccgtgactcgcttcgcggctcgagctcggtcggggccgagcgcctaccnccaccgactcctaccacgtccctcccgagttcctagaacgtacgtacggtacggtaccgtacgtaactttaacgttaccgtgtaaccaacggtaccgtaggtacggggtacgtcgtacggggtccgttcgtacgggtcgttcgggtaccgggcgggtacgggaccgaacggtccgttaccggacccgttaccggtacggtaccgaccggacccgaacgggtccctacccggtacccccgttcggtaccctacccgtttcccgttaccccgttacccccgtaaccccgttcccgtaccgtacccgttaccgg

SEQ ID NO: 86210 - DNA, 655 bp, Homo sapiens
  misc_feature: GYAE6OF02IHE85.22.30.C08.1.454.CMB.1.raw
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (585)..(585): a, c, t, g, unknown or other
  misc_feature (585)..(585): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgctttctagtgctattttagagtgtcagtgtgaggtgcgctgtggatcgtggggggcttggtccagccgtgggggtccctgacgacgtcgcctggtgcgacgcctctggattcgagtttggacgcctactgtctgtacgttcgggtcctacnggcctcggaggggaagggctgggacgtggggtcnccagntagacgaaacgaagaccganagtaaagatttacgtgtggactgtcgtagaacggtcgacgttaccaccgtatacgtaccctaaggaacgtaacgaaacggttacaaaacgtaacctaccttaacgttacgtttacgttgaccgtaagattaggggaccaccgtacgcggtaacgagggaccgtaaacgggacgtaacccggtgttacccgttacgtttagtttcccgtagtttcgtaaccgnggttaaacgacgtaaggtacctttaaacgtcgtttaagttaagtttccttaaggtccgtaagttaaacgg

SEQ ID NO: 86211 - DNA, 599 bp, Homo sapiens
  misc_feature: GYAE6OF02HOHX9.22.30.C08.1.454.CMB.1.raw
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggtctttttccttgttgctattttagaaggtgtccagtgtgaggtgcgctggtggaatcgtggggggccttggtccagccgtggggggtccctgagactcgctgtgcagcctctggattcgagtttggacgtcctactgtctgacttcgggtccgccaggctccgaggggagggctggaggtgggtgccagcatcaagagacggacataaggtatttagngtgctntgagaggcatcactatctacgagacgaactaacgtanaaacgtacctcgacttgtttacncggcaaggtatgggacccacggtccgtagtaccggacgccgggtaaaggaccgtacgggcttcggtacctttattttccgagttcgtaacgaagggtacgtacggtaagttaacttaaccgttacgtaacgtttactttacgtaagtacggtaagttaaccg

SEQ ID NO: 86212 - DNA, 1006 bp, Homo sapiens
  misc_feature: GYAE6OF02HLCCA.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatccgccctctcgcctctcgcccttcccgtggggacgtcccgtcggtaccaaaccctccaaccgttcggtccgttttccgtttaaggtacgttacaaaccgtaaccggtaacttttaacctaaccgacccggttcggccggttacgggcctaaacgttaccaaaaccgaaacgtacgggacccgggaaacggtaaaccggggtcccccgttaccggaccttaaaccgtttaaaacgttacggtaaaaacgtacgtttacggggtaccccttaaaggttttttacggggaccgtaacgggtaccccaaacccccggtaaaccgggtaaaacggggggggggttacccgggggaaccgtttacccccggttaacgggtaaaccgtttccccgggtacccgtttttacccgggttacccggggggttacccttaccccggtaaacggttacccgtttccgggtaaccgggggggtccccggtaacgggtccccggtaacccgttaaccccgtaccgtaaaccccgtaacgttacccgttaccccgaaccggtacccccgttaccgtaaccggttaccgttaacggaaacgtaacggttcggaacggtaccgttaacggtaacctttaagttacggtacgttaccgaacggtaaccgtaacgggttcggaaccggtccgtacgggtaccgtccgtacgggtcgttacggggttccgggacgggaacgggtaaccgtaacgtcgtaccggtacccgttacgtacggtccgaccgaccgtacggtaccctcccggcccgttacgtcccgtacgttcccgtcccggttccccacccgtttcccaccgtacccggttacg

SEQ ID NO: 86213 - DNA, 823 bp, Homo sapiens
  misc_feature: GYAE6OF02HT96G.22.30.C08.1.454.CMB.1.raw
  modified_base (640)..(640): a, c, t, g, unknown or other
  misc_feature (640)..(640): n is a, c, g, or t
  modified_base (752)..(752): a, c, t, g, unknown or other
  misc_feature (752)..(752): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgcctccgtgggacgccgtcggtacaacctcaccgtgtcgttcgttagtacgtacaacacgtacttactacgaccggtcgcgtcgctactacaacaacgacggaccgggaagaaccggggccctacggtaccttaacttaagtacggaaagtagttcggaccttaagttttcgggacctaacggacccaacccgtaaacggggtaaacggggggggttccgggtaaccgttccccggttaggtaaccgttccggttaccgtttccgggttccggggtaccttacccggaacggtccgttccggggtaccgggggggacccggtacgggtacccggtacccgttaaccccgtacccgtaaacccgtaccgttacccgttacccgaacccgttccccgttaaccgtacggttacgtacggaaagtacgtaggacggtacgttacgtacttacttacgtcgtacgagtaacnggttacgggacgtcggtacggtcgttcgcggttcgttcgggtcgggacggtacggaccgtaacgtcgtaccggtaccgtaccggtacgtcgaccggtaccgaccggtccccnccccggttaccgtcccgtacgttccccgttaccgttccctaccccgtccctaccggtaccggtcttaccgg

SEQ ID NO: 86214 - DNA, 733 bp, Homo sapiens
  misc_feature: GYAE6OF02HXULM.22.30.C08.1.454.CMB.1.raw
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgtcgtttcttagtgctatttagaaggtgtcagtgtgaggtgcgccgtggtggaatcggtgggggggccttggtcccaggccgttcggggggtccctgagactcgcctgtgcagcctcgtggacttcggtagtttgggagtcctacgtggtacttggtaccgtttcggggtccgcccgaggtcctacccggaggggaagggcgtagggnggtgggtcggccaggtcaagtcgaacggaagacggactagtaaacggtaattttagnggtacgtcctntgggtagaacgggccgtaagttccgaacctacgttccgtaccaggacgaacgtaacgtcaaagtaacctctaacgttacgtttccaggtacctaaggtaacgtacgggaactaccggtaccgttacgggaccggaacggttacccggaacggggaacctaccggggtccttacggttaccttttacgttcccgttaggtaccggttacgaagggtttaacccgaggtaacccgttaacgtttaaccggaccgtttaagggttacccttttaaacccggtttagggtccggttaaacgttaaacgg

SEQ ID NO: 86215 - DNA, 802 bp, Homo sapiens
  misc_feature: GYAE6OF02G4XA8.22.30.C08.1.454.CMB.1.raw
  modified_base (249)..(249): a, c, t, g, unknown or other
  misc_feature (249)..(249): n is a, c, g, or t
tcagacatacgcgtcacgaccggtgctcgatttagtctgacgtcaaagggaaagggggctcgagaggaggagccgttagcccccggactcccaaaggcctttccacttggtgatcagcactgagcacagaggactcaccatgggattggggctgagctggtcttttccttgttgcttatttagaaggtgtccagtgtgaggtgcgcctggtggaactcgtggggggccttggccagccgtggggtcccngacgctcgcctgtgcgagcctcgtggtattcggtagtttggacgtccttacgtgtctggtacgttcgggtcccgccgtaggtccttaccggaacgggaacggggtctagggaggtgggtaggcccgagcagtaccgaaacgaacggacggaacgtagttaaaggtaattttacgaggtcggtccttagtagggtaacggaacggggacccgtatttacccgaaccctacttcccggtaaccaacggggttacgaaaccccgtaaacggtcccgaaaaacgggtaaccttaccggtaaacgttcggttttaaccagggtaacctaaggtaaccggtagtacggaaccgttacccggttacgacccgggtaacgggtaccggaacgggttaacccgacgggttaccggttacttacccgggttacttttaccgggttggttaccggttacggtaacgggtaaccggttaaaccgaacgggttaaccgttacccggttaaacggttaccggttttaccgtttaacggtttacgttaccgggttaaccctaaccggg

SEQ ID NO: 86216 - DNA, 564 bp, Homo sapiens
  misc_feature: GYAE6OF02F8P1B.22.30.C08.1.454.CMB.1.raw
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
  modified_base (543)..(543): a, c, t, g, unknown or other
  misc_feature (543)..(543): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacagattactacaccgtcgcgtggcatcaacacagccggagaacggccctcgctacttaangaagattggccattttgcagccacagaaggggtcgatcccngatcgcttcgtcgggctccagctcgtggggccaggccgctacctcacatcctcacgccttcagtctagaagatgaggctagactagtactgcagacagttcgggacgtcgtaggtctcgtaggtcgtggttcggcggagggacctaagcgtcgacccgttcgtaggtccacgcccgaaggtccgtccgcccccgttggtaccacgttccttccgttacccccnccttaccctaccgtacgtccg

SEQ ID NO: 86217 - DNA, 595 bp, Homo sapiens
  misc_feature: GYAE6OF02FYRCE.22.30.C08.1.454.CMB.1.raw
  modified_base (382)..(382): a, c, t, g, unknown or other
  misc_feature (382)..(382): n is a, c, g, or t
  modified_base (467)..(467): a, c, t, g, unknown or other
  misc_feature (467)..(467): n is a, c, g, or t
tcagacatacgcgtcacgaccggtgctcgatttagtctgacgtcaaagggaaaggggctcagagaggagccttagcccccggactccaaggcctttccacttggtgatcagcactgagcacagaggactcaccatgggattggggctgagctggtcttttccttgttgcttattttagaggtgtccagtgtgaggtgcgccgtggtggatcgtggggggccttggtccagccgtggggggtccctgacgactcgcctgtgcagcctctggattcgagttttggacgccttacgtgtctggtacgtttcgggtcccgccgaggcctaccggaaggggaacggggctgggaggtgggtcggccagcagtacgaacgagacgganaagtaaggtaatttgtgtgtcctgtgtagacgggcctattccactatcctacgaagaaaccacgtacaaagaactcacttgttcngacagtacgtaggacacgtcctggaccgacggccgacggacgcggtctgtcttagtttcgtcgtcgtacgaggtaacgacgtagaacgttacctagtacttacgtttacttaagtcgtagtacttagg

SEQ ID NO: 86218 - DNA, 583 bp, Homo sapiens
  misc_feature: GYAE6OF02FWY84.22.30.C08.1.454.CMB.1.raw
  modified_base (184)..(184): a, c, t, g, unknown or other
  misc_feature (184)..(184): n is a, c, g, or t
  modified_base (413)..(413): a, c, t, g, unknown or other
  misc_feature (413)..(413): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggancctcggtcaacctcacctgtcgttcttagtagtcaacacgtattactacaccgtcgcgtggcatcaacacagccggagaacggccctcgctacttaatgaagattggcctattttggcagccaaccacgaagggggtcggatcccgtgatcgtcttcgtcgggctccgagctcgtcggggccgagccgcctacctccaccgactcctccacgcctccgagtctagaagntgaggctgtactattactgtacagactagtagggacgcgtggcgtcgtggtcgtggttcgggcgggacgggaccagcgtcgaccgtcgtaggtcacgaccgacggtcctcccgtaccccgtcggtcctaccgttccgttccttaccccgccctcccgtacgccgttaccg

SEQ ID NO: 86219 - DNA, 662 bp, Homo sapiens
  misc_feature: GYAE6OF02IZXPB.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctccctgggagcctcggtcaacctcacctgcgttcttagtagtcaacacgattactacaccgtcgcgtggcatcaacaacagccggagaacgggccctcgctacttaatgaagattggcctatttgcagccaccacgaagggggtcgggatcccgtgactcgcttcgtccgggctccagctcgtcggggccagcgctacctcaccatcctccacgccctccacgtcctagaacgtacgtggacggtccgtgaaccgtttattaccgtgtaccaggactaggtcgggacgtccgtggccgtcgtgggtcgttaggttcgggaccgggtacgggtaccaaggtccgttacggtacccggttaccgacgggttaccgaccgtacccgtaagggtcccgtcccggtacccccggtaccggttcccgtaaccgttccccggtttaccgtttccccccgtaccccgttcccgttaccgtacccggttaacccgg

SEQ ID NO: 86220 - DNA, 705 bp, Homo sapiens
  misc_feature: GYAE6OF02JS9H5.22.30.C08.1.454.CMB.1.raw
  modified_base (187)..(187): a, c, t, g, unknown or other
  misc_feature (187)..(187): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (502)..(502): a, c, t, g, unknown or other
  misc_feature (502)..(502): n is a, c, g, or t
tcagacatacgcgtcacgaccggtgctcgatttagtctgacgtcaaagggaaagggggagctctgggagtctgcaccatggcttggacccactcctcttcctcaccctcctcctccactgcacagggtctctctcccgtaggttgtactgactcaatccgccctctgcctctcgccctcccgtgggntccctcggtaccaaccctcacctgccgtttcttaggtactcaacacgtattacctacaccgtccggcgtaggctacacaaacacgacgccggaaggaacggccctgtaccttaacgttaaacgtggtaatacgttcggacccttagttttcgggacaacgccaccacggaacgggggttcggactcccgtnactcgccttcgcggcctcgtagtccgtgcggggccacggcgtacnccgtaccacgactccgtaccncgtacctccgtagtaccgtgaacgtacgtagcggttactcgaattactcgtatccganaaccgtgggttacgacggcgtacgggtccgttactcggggtcttaccgggtcgggaccggggtaaccgaagttaccgacgtccggttacccggtccgttacgggtccaccggacccgaccgtaccgggttcccgcccccgtcggttacccgtaacttcccgggtaacccttccccgtcccgttccctacggtacccggttcgg

SEQ ID NO: 86221 - DNA, 552 bp, Homo sapiens
  misc_feature: GYAE6OF02ISRA2.22.30.C08.1.454.CMB.1.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
  modified_base (532)..(532): a, c, t, g, unknown or other
  misc_feature (532)..(532): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttcctgttgctattttagaaggtgtccagtgtgaggtgngcctggtggaatcgtggggggccttggtccagccgtgggggtccctgngactcgcctgtgcagcctctggnttcgagtttggagccctatgtctgacttgggtccnccaggctccagggaaggggctgggagtgggtgaccgtagcatcaacgaagacgganataaggtaattttanggttggcctctggtgaagggcattccacgatcctaccagtaacgacaacggtacaagtaactcgacttgtttcngtcaagngtagacagcctgaccgagccgaaggcacggtntacgtctatttntgtgtcgaagagacgtgaacttactacgtaagttnttactaggttacgagtaacg

SEQ ID NO: 86222 - DNA, 711 bp, Homo sapiens
  misc_feature: GYAE6OF02JZXMA.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattacacaccgtcgcgtggcatcaacacagccggagaaggccctcgctacttaatgaagtatcggcctagttttggctacgcccaccacggaacgggggtcggactcccgtgactcggtcttccgtcgggctccgagcctcgtcggggccgtagccgctacctcacccgtactcctaccgtacgccctacccgtagttccgtagaacgtacgtcggacggtccgtaggtaacttagttaacctgtaccgacgtaacgcggttaagggccgtacgtcgggtacgttccggtggttccgttcgggttaccgggaccgggtaacggggaaccgtaacggtccgttaacgggtcccgtaccggttacgggtaccgacgggtacccgtaacgggtcccgttacccggtcccccttacgggttccctaacccggtttccggttacccggttacccccttaccccggtcccgttaccgtaccccggtttaacgg

SEQ ID NO: 86223 - DNA, 757 bp, Homo sapiens
  misc_feature: GYAE6OF02FZEZF.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgccgtggtggaatcgtggggggccttggtccagccgtgggggtccctgagactcgcctgtgcagcctgtggacttcgaggtttggagccttacgtgtctgacgttgggtccgccgaggcctccggaggggaacggggcctgggaggtggggtcggaccgaggcacgtacgaacggaacggaacggacaagttaaaggtaacttttaagtggtacggtcttcgtaggtacggaacggggtaccgtacgtttaccgaacctactttcccgtaccgaaggaacgaaccgtaaaccgttaacaaacggtaaacctaccgtaaccgtttcggttttacctcggtaaccgtaaggtaacgttacgggaaccgtacggtcccgtacgggaccgggtacgacccggggaacggtaacccgtaccggggtaccttacgtttacccgttttacgtttccgggttagtttcggtaaccggtaacgggtaacggtaacgggtaacgttaaccgttaaccgtacggttaacgttttaaccgttttacgtaaggtttaccggagtttaaaccggg

SEQ ID NO: 86224 - DNA, 690 bp, Homo sapiens
  misc_feature: GYAE6OF02H3I44.22.30.C08.1.454.CMB.1.raw
  modified_base (186)..(186): a, c, t, g, unknown or other
  misc_feature (186)..(186): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgcctctcgcctcccgtgggacncctcggtacaacctcacctgcgttacttagtacgtcaacacgtattacaacnccgtcgcgtgcatcaanacgngcgagacgccncgctactangagtntcgctgttcgctacgccacgacggacggggtcgtctccgtgactccgtcttcgtccggtcctacgacgtccgtacggtcggggaccgacgtccgtacctaacccgtcgtaacccgtacgtacccgttacccgaacccggtccccttacccggtacgttaccgtaacggtaaacggtagtacgggacggtcgttaaccggtaacttttaacgttaccgtacgtaacgacggtaacgtacgggtacgggtaccgtcggtacggtcgtcggtcggtacgttcgggtcgggaacgggtacggaaccgtcggtccgtacggtaccgttacgtacgtcgaccgtccggacggtacccgtcccgtccgtcgtacctccgttccgtcccttaccctcccgtcctacgtcgtacg

SEQ ID NO: 86225 - DNA, 674 bp, Homo sapiens
  misc_feature: GYAE6OF02HX02Y.22.30.C08.1.454.CMB.1.raw
  modified_base (312)..(312): a, c, t, g, unknown or other
  misc_feature (312)..(312): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattgggctgagcgtgctttctgtgctatttagagtgtccagtgtgagtgacgctggtaggatcggtgggggtccttggtccagccgtcgggggtccctgagactcgcctgtgcgactccgtctgggtattcggtaggtttaggcgtcctactgttcgtagtccgtttgggacccnccgacggctaccggaggggtacgggctagggtacggtgggtcgccgtagctacgtacaacggacgacganagttaagtattagngtacgccttagtgaggtacggctattaccgacttactcctacgtaggaccgtaacctacgtaacgaaacgttaactccgtaacgttggtttaccgaacgcgtaaaggtacgtacgaccgtacgtcccgtacgggaccgtaccggaccggaacgtacccgtacgggttacctacggttactttaccgtttgttacggttacggtaagtaccgtaacggctaaacggttaacttcccggtaacggttagttacgtttacggtaataccggtattaaccgg

SEQ ID NO: 86226 - DNA, 792 bp, Homo sapiens
  misc_feature: GYAE6OF02F478Z.22.30.C08.1.454.CMB.1.raw
  modified_base (206)..(206): a, c, t, g, unknown or other
  misc_feature (206)..(206): n is a, c, g, or t
  modified_base (487)..(487): a, c, t, g, unknown or other
  misc_feature (487)..(487): n is a, c, g, or t
  modified_base (628)..(628): a, c, t, g, unknown or other
  misc_feature (628)..(628): n is a, c, g, or t
tcagacatacgcgtcacgaccggtgctcgatttagtctgacgtcaaaagggaaagggggagctctggggagtctgcaccatggcttggaccccactcctcttcctcaccctcctcctccactgcacagggtctctctcccaggttgtactgactcaatccgccctctcgcctctcgccctccgtgggcgccttcggtccaacctcnccttcgcgttcttagtagtacaaaccgtacgtacttacctaccgaccggtcgcggtggaccaactacaaaccaaacgacggccgggaaaggtaaccggggccccttacggaccttaacgtttaaagtcggaaagtagtttcgggaccttaaagtttttcggacacgtacccaaccgaaccgggtaacgggggggtccgggtacctacccggtggtaactccggtacttccggtcgggtccctaccgagccgtcggtcggggacccgaggccgtccttaccncgaacctacttccgtcccaacggtccctaccgtacggttcgtagaaaggtcgttaggaccgggtactacgtaactttacgttacggttcgtaaccgaccggtacgtaagttcggggaacctccgggttaggtacgttccgngggttaccggttgggttaccgggacgggaccgggtacaaccggttccgttccggaccggttaccgtacggtccgaccgtaccgaccgggtcgtacccgttcccggtacggtccctaccggttccttaccccggtccccgtaccgtcccgtaacgtcccggtcgg

SEQ ID NO: 86227 - DNA, 684 bp, Homo sapiens
  misc_feature: GYAE6OF02GF5KI.22.30.C08.1.454.CMB.1.raw
  modified_base (331)..(331): a, c, t, g, unknown or other
  misc_feature (331)..(331): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgcctccctgggacgcctcggtcaacctcacctgcgttcttagtagtcaacacgtattacacaccgtcgcgtggcatcaacaacagccggagaacggcctcgactacttaatgaagattggcctattttggcagccacacgaagggggtcggactcccgngactcgcttcgtcgggctccgagctcgtcggggccgagcgcctcctcgaccattcctccacggtccctcctacgttccgtaaggaacgtacgtacggacggtcgtacgtaccttattacgtcgtacgaacgtacgagttacggggacctcggtcgggacgttcgtcgggtacgttcgggtacgggaccgggtacgggaaccgacggtccgttcggtaacccggttaccgttacggggtaccgtaccggtacccgaacgggtccggttacccggcccccggttcgggtacccgtaccgtttacccggttccgttaaccccccgtcccgttacccgttaccacccgggttacccg

SEQ ID NO: 86228 - DNA, 783 bp, Homo sapiens
  misc_feature: GYAE6OF02H5E3R.22.30.C08.1.454.CMB.1.raw
  modified_base (194)..(194): a, c, t, g, unknown or other
  misc_feature (194)..(194): n is a, c, g, or t
  modified_base (497)..(497): a, c, t, g, unknown or other
  misc_feature (497)..(497): n is a, c, g, or t
  modified_base (533)..(533): a, c, t, g, unknown or other
  misc_feature (533)..(533): n is a, c, g, or t
  modified_base (560)..(560): a, c, t, g, unknown or other
  misc_feature (560)..(560): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacgagggtcctctcctcccgtaggttgtactgactacaatccgccctctcgcctctcgcctccgtgggacnccgtcgtcaacctcacctgccgtttacttagtacgtaccaacgacgtacttactacgaccggtcgtgtcggactataccaaacgaaccgacggtaccgggaacggaacgggtcccctaccggtacttaaccgttaaagtggaaacgtacgtttcgggaccttaggttttcggaacgacgacccaaaccgaacgggtaaggggggttccgacttcccgtagtacgtccggtcgtttcggtaccgggcctaccacggtccgtcgggttcgggggacccaggttccgccttaccgccaacgttacnccttaccgacgtccctaacgtcgtacgtagaagtcncgggtactcgtacgtacttacttacgngactacgtacacggtcggactcgtcggacgttcgtacggtccgttcggggttaccggacgggtaacggacccggtaacgttccggtacccgggtacccttacggaaccgttaccggaccgtaacccggtacggcccgttaaccccgtcccgggtaccggttaccctaccggtttcccgtacccgggttccccttaccccggtaccgttccgaaccgtttcggg

SEQ ID NO: 86229 - DNA, 662 bp, Homo sapiens
  misc_feature: GYAE6OF02I3DIR.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccagtgggattggggctgagcgtggcttttcctgttgcttattttagaggtgtccagtgtgaggtgcgcctggtggatcgtgggggccttggtccagccgtgggggtcctgacgactcgcctgtgcagcctcgtggtattcgagtttggacgtcctactgtcgtgtacgttcgggtccgccgaggtccgtaccggaaggggtacgggtccgtgggtaggttcggggtggttacgacgtcgaacgtaccgaaacggaacggaccggaacgtaacgttaaaggggttaaatttttacggcggtacggtccttacgtaggtacggaacggggtccctacgttaccgacctagtccctaccgaagacgaaccaacgtacaaacgtactctacgttgttcgtagaccgtagtagtacgtacgacgtccgtagccgtacggaccggagaccggtacggtctagttccttagtttcgtgtacgtcgaagtacgtagtaagtacttacgtacgtacgttacttacgtagtagacttaacg

SEQ ID NO: 86230 - DNA, 637 bp, Homo sapiens
  misc_feature: GYAE6OF02G6HEN.22.30.C08.1.454.CMB.1.raw
  modified_base (270)..(270): a, c, t, g, unknown or other
  misc_feature (270)..(270): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (439)..(439): a, c, t, g, unknown or other
  misc_feature (439)..(439): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacgagggtctctcctccaggttgtactgactcaatccgccctctgcctctcgccctcccgtgggacgccttcggtaccaaacctcgacctcggcctttcgttagtagtcaacacgtattacctacaccgtcgcgtgcatcaacaacngccgagacggcctgactactatgaagattcggctagtttgcagccacacggaaggggtcggactaccgtgatccgtcttcggtcggcgtccagcgtgtcggcgtagcgctacctcacactcnccgacncctacngtcctagaagacgtgaggctagacttacgttacgngtacagtacgaaggttcgggaccgtcgtgggtccgtcgttacggccgttcgggttaccggggcgggtaaccggaccgtaacggtcgtccggtaccgtccggttaagcccgacgaccggtacgtcccggtacccgtccccggtcgtaccgacctttcccggtacccgttaccccaccccgtcgtaccgacccggttacg

SEQ ID NO: 86231 - DNA, 787 bp, Homo sapiens
  misc_feature: GYAE6OF02FXAG7.22.30.C08.1.454.CMB.1.raw
  modified_base (166)..(166): a, c, t, g, unknown or other
  misc_feature (166)..(166): n is a, c, g, or t
  modified_base (447)..(447): a, c, t, g, unknown or other
  misc_feature (447)..(447): n is a, c, g, or t
  modified_base (496)..(496): a, c, t, g, unknown or other
  misc_feature (496)..(496): n is a, c, g, or t
tcagacatacgcgtcacgaccggtgctcgatttagtctgacgtcaaagggaaagggggagctctggggagtctgcaccatggcttggaccccactcctcgttcctcaccctccgtcctccactgcacagggtctctctcccgaggttgactgactcaatcgccctntgcctctcgccctcccgtagggacgcctcggtccaaacctccgaccctgtccgtttacttacggtacgtccaaaccgtacggtaattttaaccctaacgccggttccgacggtcggcctaattaccaaaacaacgccggccgggaagtaaacggggcccctacgtactaccttaaagtagaaacgttagttcggtacccttaagttttcgggactacgccctaaccgaacgggaacgggggttcgggaactccgtagtactcgacgttcgtcggtctaccngtcgtcgtcggggcctagcccgtactaccgtcaccacgttccgtaaccncgtccctcgtaacgtcgtaagactgtcggaggtctgaactttacgtaccgtgtaacacggacgtacgttcgggtaccgtctaccgggggttctaccggtcgggaaccttttcgggggtacgggccggggtaaccggacccgttaaggacccgttcccgtaaacccggttcgtaaaggttccccgacgttaccccgtaacggggtcccgtaaccccggtccccggttccgtacccgtaccgttccctttacccggtaccccgtcctaaccccgttcccgaaccggtttccgg

SEQ ID NO: 86232 - DNA, 760 bp, Homo sapiens
  misc_feature: GYAE6OF02JKS3E.22.30.C08.1.454.CMB.1.raw
  modified_base (293)..(293): a, c, t, g, unknown or other
  misc_feature (293)..(293): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctcctgggagcctcggtcaaccttcacctgccgtttcttagtagtcaacacgtattactacaccgtcgcgtggcatccaacacagccggaagaacgggccctcgctacttaatcggaanagttggcctagtttttggcacggacccacccgaagtaacggggggttacgggacttccccgtgaacgtcgccttcgtccggggtctcccgacgtcgtccgtgggggacccgaggccgtacctacccttccgaacctcgtaccctccgaacgtccctaccgcggtcctagtaagacgttggacggtcgtntaaccggttnttaccgtgtacgtacgactagggtacgggaccgtccgggtaggccgtttacgtccgggtacgtccggggttttccgggaaccgggaaggggtacccaaacgggtccgttaggaaaccctttcccggggtttccgtaacgggttccccggtaacgtaaccccgggtaaacgggtcgggttaaccccgtccccccgggttgggttaacccctcgtttccggttcccccggtttaacccccggtccccttacccggtaccctaccccgggg

SEQ ID NO: 86233 - DNA, 815 bp, Homo sapiens
  misc_feature: GYAE6OF02IJDPZ.22.30.C08.1.454.CMB.1.raw
  modified_base (271)..(271): a, c, t, g, unknown or other
  misc_feature (271)..(271): n is a, c, g, or t
  modified_base (660)..(660): a, c, t, g, unknown or other
  misc_feature (660)..(660): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggagttggggctgagctggggggtcttttccttgttgctattttagaaggtgtccagtgtgaggtgcgcgtggtggtagcgtgggggctggtccgagccgtcgggggtccctggacgtactcgtccgtggtcgacncgtccgtcgtaggtattcggtaggttggtacgccttacgtgttacgtggtaccgtttcgggtaccccggtccggacggtcccgttaccgggaacgggggtaacggggtaccggtaggggttaggtcgggggttaacgggccccggaagtaccgacgtaccggaaacggaaacggtaacggaaacgtaagttaaaggtaacgttttaggttcgttacggtccgtcgtcggtttacggaacggggtaccgtaacgtccgtaaccgtactaaccgtccgaaaggaaccggtaaaaccgtaaccggtaaccgtaaaacgtaaccgttacccgttaggttttaccgtttaccgtaccgttacgaaccgttacgggttaacgaaccggttaccgnggtaccggaccgtaaccggaccggaaggtacccgtaaccgccgtttacggtaacttcgtttacgcgttaggtaccgaaggtaaccgacggtaaacgttagtaacccttaggttaaccttagtttaaccggttaagtacccggaaggtttaaccgg

SEQ ID NO: 86234 - DNA, 641 bp, Homo sapiens
  misc_feature: GYAE6OF02FUV65.22.30.C08.1.454.CMB.1.raw
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgcctctgcctctcgcctcccgtgggacgcctcggtcaacctcacctggccgtttcttagtacgtcaacacgtattacctacgaccgtcgcgtgcatcaacacngcggagacggcctcgctatangagatgctattggcngccacacgaggggtcgactccgtagatcgcttcgtcggctcgacgctcgnggggccagccgtctacctcaccacgtcctaccactccctcagtctagaacgactgacggctacgtaacttgttacncgtacacgcgttagacgggcctcgtcgggtcgtacgtcggtacgtgggttaccgggacggtaagggaccacggtccgtacggtccgttacggtaccggtacctaccggaccgtaacgggttcctaccccggtccccgttacgggtaacccttcccgttacccgggttcccgtttacccccctacccggtttccccgtaacccggtccggttaacccgg

SEQ ID NO: 86235 - DNA, 873 bp, Homo sapiens
  misc_feature: GYAE6OF02JZ15X.22.30.C08.1.454.CMB.1.raw
  modified_base (281)..(281): a, c, t, g, unknown or other
  misc_feature (281)..(281): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtggtctttccttgttgtcttatttagagtgtccagtgtgaggtgcgcgtggtgagtcgtgggggtccttggtccgagtccggtcgggggtccctggagtacgtcgccgtggtcgcacgtcctcgtaggtnttacggtagtttggacgtaccgttagtcggttcgttcgtacggttcgggtcccgacgacgggtccgtaccggacggggtaacgggcgtgggtagggtcggggtcggaccgagacgtacgtaccgaacggtaacggaaccggaactaagttaaacggttaagtttaggtcggtcggtaccgtacgttacggtaacgggtaacgggtccgttacgttaccgtaaccgtactacccgttaccgaagtaaaccgaacccgttaacggaaccgtaaacgtaaccttacgttaaccgtttcgtttaccgagtaccgtaaggtaccggttacgggtaaccgaaccgggtcccgttaacgggaccgggtaacccgggaaccgggaaccggtaacccgggttaccgttacccggttttacggtttaacccgttttaaccgttttccgggtttaaccggtcggtttaaacccggtacggggtaaaaccttccgggggttaaaccttaaaccggttttaaacccggtttaaacggtttaaccggttttaaacgtttaaccgggttttaaccgggtacggtttaaacccggtttaaacccgggg

SEQ ID NO: 86236 - DNA, 845 bp, Homo sapiens
  misc_feature: GYAE6OF02FGYKU.22.30.C08.1.454.CMB.1.raw
tcagacatacgcgtcacgaccggtgctcgatttagtctgacgtcaaagggaagggggagctctggggagtctgcaccatggcttggacccactcctcttcctcaccctcctcctccactgctacagggtctctctcccaggttctactgactcaatcgcctcgtgccgtctcgcctccgtgggactccgtaccggtccaaccttcaccgttcgtaccgtttcttaaggtacgtaccaaacctacgtaacttaccctaccgccgttcggccgttggactaacgtacaaaaccgaaccgacgggtaccgggaagtaaccggggtcccctacggtaacctttaacgttaaaacggtacggaaacggtttacgttaccgggtacccttttaaggttttccggaccgaaccggtaccccaacccgggtaacgggtaacggggggtccgggtaaccttcccgtagggtacgtccgttaccgttccggtaccggtcccggttaccctaggtccttacgggtaccggggacgtccggtccgttaacccgacccgttacctaaccgttaccttaccgacccggtaaccgttaccccgtaccggttaacgttaccgaacgaaggttaaccggtcgtaacggtcgtaaaccggttaactttacgtaacgtacgttaacgaacggttacgacggtacgggtactcgggtcggtccttaggtcgttcgggtacggtacggtacggtagaccgtacgtaccgtacctacggtcgtacgaccgacgtaccggcgtaacccgtccgtacctcggtacctccgttacccgtcccgtaccctcgttaccgccggtcgtaccgg

SEQ ID NO: 86237 - DNA, 724 bp, Homo sapiens
  misc_feature: GYAE6OF02GFEJX.22.30.C08.1.454.CMB.1.raw
  modified_base (305)..(305): a, c, t, g, unknown or other
  misc_feature (305)..(305): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgcctcccgtgggacgcctcggtccaacctccacctgcgtttcttagtacgtcaacacgtacttaactaccaccggtcgcgtcggacatacaaacaacgacggccggaaggaacgggccctcgacctacttaanacgtaagacgttcggccctaagttttcggacacgcccacccgaacggtaacggggggtcgggactacccgtgacgtccgtccgtttccgtcgggtcctaccgacgtcctacggtcggggccggacgccggtactacccgtccaacctaccgtcctaccgcgaccctccgacgttcgtacgaacgtagtacggtaacggcgtagtaaccttacgtttacgtcgtacgaacgagtacggtcgggacgtcgtcggccgttacggcgggttacgtcggttcggggacgggacgacgaacggcgtacgtaccggttccgtacgggtaccgaccggaccgacggtcccgtccggtcccccggttacggtcccgtaccgttcttaccccgttacccctacccgtcccgtaccgtacccggttccgg

SEQ ID NO: 86238 - DNA, 749 bp, Homo sapiens
  misc_feature: GYAE6OF02GNV7Y.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctcgcctcgtcgcccgttcccgtggggacgtcccgttccgggtaccaaccctccaccttggtccgtttacttagtacgtacaacacgtacttaacctaaccaccggtcgccgttggccactaccaaacaacgaggccggaaggaacggtccgtcgtaccttaacttaagtacgtaagtacgttcggtaccttagtttcggactacgacccgaaccggaacgggtaacgggggtacggtaccgttccgtacgtaccgtccgtccgttccggtcggtcctccgacgtccgtcggcgggaccgacgccgtacctacctcgtaccgtctccgtaccgaccgtcccgtaccgtacgtacgtacgacgtacgtacggtacgtacgtaacgtacttacgttacgtacgtacgtacgtacgtacggtacggtacgtcgtccggtcgtcgtcggtcggtcggtaccgggacggacggtacgtacgtcgtaccggtaccgtacgtacgtacgaccgaccgtacggtccgtcccggtcccggtccgtaccgtccgttcccgttcccgttccccgtcccgtacccgtaccgtaccgtcg

SEQ ID NO: 86239 - DNA, 668 bp, Homo sapiens
  misc_feature: GYAE6OF02GOZZZ.22.30.C08.1.454.CMB.1.raw
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
  modified_base (561)..(561): a, c, t, g, unknown or other
  misc_feature (561)..(561): n is a, c, g, or t
tcagacatacgcgtcacgaccggtgctcgatttagtctgacgtcaaagggaaaggggctcagagaggagccttagccccgggactccaaggcctttccacttggtgatcagcactgagcacagaggactcaccatgggattggggctgagctggcttttcctgtgctatttagaggtgtccagtgtgaggtgcgctggtggaatcgtgggggggccttgggtcaggccgtggggggtccctgagactcgcctgtgcagcctntggtattccgagtttggagcctactgtctgtacttgggtccncgaggctccgaggggtaggggcctgggaggtgggtcgccagcacgtcaaacggaaggaccggtacagttaaacggtaattttagnggtacggtacctgttaggtaggaaacggggtcccggtaattcccgaacactccgttacccaaaggaccggaaccaaacgggttaacaaacggttaaacctacgtacgtttaggtttccttcggataacgtagtcgggaaccagtccccgtggaccgagtcccggaaggaccncgggtaatcggttacttacgttccgtgttgtaccggtaagtacgaacgggataacgttacccgttaagtacggttaacctttacggttaatccgggtaattaaccgg

SEQ ID NO: 86240 - DNA, 669 bp, Homo sapiens
  misc_feature: GYAE6OF02JBPZF.22.30.C08.1.454.CMB.1.raw
  modified_base (125)..(125): a, c, t, g, unknown or other
  misc_feature (125)..(125): n is a, c, g, or t
  modified_base (273)..(273): a, c, t, g, unknown or other
  misc_feature (273)..(273): n is a, c, g, or t
  modified_base (427)..(427): a, c, t, g, unknown or other
  misc_feature (427)..(427): n is a, c, g, or t
  modified_base (539)..(539): a, c, t, g, unknown or other
  misc_feature (539)..(539): n is a, c, g, or t
  modified_base (669)..(669): a, c, t, g, unknown or other
  misc_feature (669)..(669): n is a, c, g, or t
tcagacatacgcgtcacgaccggtgctcgatttagtctgacgtcaaagggaaagggggagctctggggagtctgcaccatggcttggacccactcctcttcctcaccctcctcctccactgcacnggtctctctcccaggttgtactgactcaatccgccctctcgcctctgccctcccgtgggacgcctcgggtaccaaccctcgaccttcgcgtttacttagtacgtcaacgacgtacttactaccaccgtcgcgtggcactacaacaacncgccggaagacggcccgtcgactacttaaatgaaacgtattcgggacccttaagttttcggacaacgcccaaccgtacggaacgggggttccggtactcccggttagacgtcgtccgttcgtaccgggcctcgacgtacctcggcggacgcgcnctacctaccgactcgtaccctcgaccgtctacccgaagtcgtagaagtacgtgtcgacgttacgacttaagtacctcgtaactacggactggttacggacgtcgtacggtcncgttcgtacgtcggtacggacggtaaggaccctaaggtccgaacgtaccgtacgtagtccgacgtaccgacggccggttccctcccgtaccgtactccgtcgtccgtacccacccgtctacgtacccgtn

SEQ ID NO: 86241 - DNA, 781 bp, Homo sapiens
  misc_feature: GYAE6OF02HBMJK.22.30.C08.1.454.CMB.1.raw
  modified_base (192)..(192): a, c, t, g, unknown or other
  misc_feature (192)..(192): n is a, c, g, or t
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
tcagacatacgcgtcacgaccggtgctcgatttagtctgacgtcaaaagggaaagggggagctctgggtagtctgcaccatggcttggaccccactcctcttcctcaccctcctcctccactgcacagggtctctctcccaggttgtactgactcaatccgccctctgccctctcgccctcccgtggggacncccgtcggtccaaccctcgacctgtcgtttcttagtagtcaaacacgattacacaccgtcgcgtgcatcaacacaggccggagacggcctcgctacgtaatgaagnttgcctagtttggcagccacgacggacgggggtcggactccgngactccgtcttcgtcggctccgacgcgtcggtcggggaccgacggccgtaccctaccgtacctacctactcccttacccgaccgtccccgtacccgtaacggttaccgttaacgaaacggtagtacgggtacggtaccgttacgtaaacgtttaactttacgtacggttacgaaaccgtaaccgtagggttcggggtaccgtccggttacgggtaccggttccgtacgggttccgtttcggggttccggggaacggggtaccgggtaacccgtaacggtcccggttaccgggtacccccggttacgttaaccgggtacccgaccggtacccggtaacgggtccccgttaccccggtcccccgggtacgttacccgtaccgtttccccgttaccccgttcccccgtaaccccgtttcccgtacccggaccggtttacccgg

SEQ ID NO: 86242 - DNA, 862 bp, Homo sapiens
  misc_feature: GYAE6OF02IL7WX.22.30.C08.1.454.CMB.1.raw
  modified_base (61)..(61): a, c, t, g, unknown or other
  misc_feature (61)..(61): n is a, c, g, or t
  modified_base (128)..(128): a, c, t, g, unknown or other
  misc_feature (128)..(128): n is a, c, g, or t
  modified_base (275)..(275): a, c, t, g, unknown or other
  misc_feature (275)..(275): n is a, c, g, or t
tcagacatacgcgtcacgaccggtgctcgatttagtctgacgtcaaaagggaaaggggganctctgggggagtctgcaccatggcttggacccccatcctcttcctcaccctcctcctccactgcacngggtctctcctcccaggttgtactgactcaatccgccctctgcctctgtccctcccgtgggcgtccgtcggtacctacctcacctggtctttacttagtacgtcaaacacgtacttaactaccgaccgtcggtcgtaggcaacctanaaccaacgaggaccggtaaggaaccgggtcccctaccggtacttaacgttaacgtaggtaaagtacgttcgggacctttaagttttacggaaccgaacgtacccccaaccggtaaacgggtaaacggggggggtaccgttaaccgtacccggtgtaaccgttccggttactttccgggaccggtccgttacccgacgttcggttccgggacgggggtccgacgtaccgtaccctacgtacccaactctacccgtccgtaacctcccgtccgtacggtacgtaagtaaggagtaacggtacggtaaccgtttaaggtaacccttaaggtttaaccgacggttaaccgaacgtaaacggttacgggttaccgggtaccggtacggttacggtaccgggttcggtccggttagggttaccgggtacggggtccggggtaaacgggtaacccggtaacgtccggtttacccgaacgggttaccgttacggaacggtaccgaacccggtaccggtcctacccggtccccggttaacgttacctaccggttaccgtcccgtaccccttcccgtaaccgtccggtacgttaccg

SEQ ID NO: 86243 - DNA, 688 bp, Homo sapiens
  misc_feature: GYAE6OF02FZVL4.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtacgtcaacacgattactacaccgtcgcgtggcagtcaacacagccgagaacggccctgctacttaatgaagattggcctagttttggctaacgccaaccacggtaagggggtcgggtactcccgtaggtactcggtcttaccgtcggggcttccgagtccgtcggtcgggggaccgtaacgccgtcctaacctccgaacccgaactccgtaccgaacgtccctaccgtaggtaccttacggaaacgtagttacggaacgggtcctacggtaacttattaccgtgttacacgactaggtcgggaacgcgtgggccttcggcggtcgttacggtcgggaccggtaggggacccaaggccgtacgtacccgttccgttacgggtccacggacccgtaaggtccgtccggtcccccgtcgggtacccttacgttccgttaccggttacccctaccccgtccgtacccgtacgttaccgg

SEQ ID NO: 86244 - DNA, 754 bp, Homo sapiens
  misc_feature: GYAE6OF02F93ZF.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgcctcccgtgggacgcctcggtccaacctcacctgcgttcttagtagtcaacacgattactacaccgtcgcgtggcatacaacaacagccggagaacgggccctcgactaacttaatagaagtagttcggcctagtttggcacgccaccgacggaagggggtcggactccgtgactcgcttcgtcgggcctcgacgctcgtcggggccgacggccgtcctaccctccgaacctactccgtaccacgtacccgtccgagttcctaaggtaacgtacgtacggagggtcctaggttaacttaacgtttacgtacggtacaacggtaacgacggttacgggaccgtcggttcgggtaccgttacgttcgggtccgtttcggggttaccggggaccggggtaaaccgggtaccgtaacggtccgttaccggtacccggttacccggttaagggtacccgtaccggaacccggtaacgggtcccggttaccccggtccccccggttaaccgggttacccttaccggtttccccgtttaccccggttacccccctaccccgtccccgttaccgtacccggttacccgg

SEQ ID NO: 86245 - DNA, 807 bp, Homo sapiens
  misc_feature: GYAE6OF02IX2PP.22.30.C08.1.454.CMB.1.raw
  modified_base (182)..(182): a, c, t, g, unknown or other
  misc_feature (182)..(182): n is a, c, g, or t
tcagacatacgcgtcacgaccggtgctcgatttagtctgacgtcaaaagggaaagggggagctctgggggagtctgcaccatggcttggaccccactcctcttcctcaccctcctcctccactgcacgacgggtctctcctccaggttgtactgactacaagtcgccctcgtcgcctcgtcncccgtccgtgggacgtcctcggtaccaaccgttcaccgtgtcgttcttaggtacgtccaaacgtacgtaacttacgtaccgaccgtcgcgtggcactacaacacgaggccgagaacggcctcataacttagacgaagtagtcgtactagtttcgacacaccaaccgagggaacgggggttcggtactcccggtagacgttcgccttcggcgtacgtaccacggtcgtcggtcgggccgtacgtccgtaccgtaccacaccgtactcctaccgtaccgtacccgttaccgaacggttcgtaaaccgaaggtaccggtaggtaacggtcgtaaccgtacgtttaaacgtttcccggtagacgtaaggaaccgttaaggggtacgggtaccgttaccggtcggtacccgttcggttaccgggtcggtttaccgggggtccggtaacgggggtaaacccggaaccggtacgggttccgttaaccgggtaccttccgggtaaccggtacccgtacggcccggtaaaccgggttccggtaccccgttaccccgggttacccgtaaccgtacccgtttacccgttacccggttacccccttacccggtcccttaccgggtacccgtaacggg

SEQ ID NO: 86246 - DNA, 665 bp, Homo sapiens
  misc_feature: GYAE6OF02F2A11.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgccctcccgtgggacgcctcggtacaacctcacctgccgttcttagtagtcaacacgtattactacaccgtcgcgtggcatcaacacagccgagacggcctcgctactaatgaagtatcggcctattttcggactagcctacacggagggggtcggacgtccctgactcgtcttcgtcgggtcctcgacgctcgtcgggcgagcgctacctccaccactcctccgacgccctccagtctagaagtacgtggagtctcgtaacttagttacctgtacgaacgacgtaggtacgggaccgtcgtacggtcgtcgtacgggtccgttcgggtaccgggtaccggggaacgggaacccgaacgggttcccgtacgtacccggttacccgtacggtaccgacggtacccggtaacggtcccgtacccggtccccggtaccggtaccgtaccgttccggttccgtcccccgtcccctacccgttcccgacgttacccgg

SEQ ID NO: 86247 - DNA, 630 bp, Homo sapiens
  misc_feature: GYAE6OF02GG4TJ.22.30.C08.1.454.CMB.1.raw
  modified_base (178)..(178): a, c, t, g, unknown or other
  misc_feature (178)..(178): n is a, c, g, or t
  modified_base (503)..(503): a, c, t, g, unknown or other
  misc_feature (503)..(503): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcggtgtgttctagtcgctactttagagtntcagtgtgacgtgcgcctggtgaatcgtgggggtccttggtccagccgtgggggtccctgcgactcggcctgtgcgagcctcgtggaactttcggagtttggacgccttactggtctgaccgttgggtccgaccaggtcctaccgagggaacgggcgtagggacggttcgggtcggccacggctacgtacgaaccgaacgacgacgtaagtaagggttactttaagtcgtacgccttgtaggtcgtaacggccggtattaccgaaccgtgtaccctacgaagtacgaacgtaaccgtacgaaacgtactctacgttcgtttacgngactacgatcgtagcctcgtacgccgacggtccgacgacgacggttctcggtactttacgttctgtacgacgtagacgtaagtacgtacttaacgtacgtagttacgttacgttgtacgtacgtacg

SEQ ID NO: 86248 - DNA, 839 bp, Homo sapiens
  misc_feature: GYAE6OF02IOC5Z.22.30.C08.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (273)..(273): a, c, t, g, unknown or other
  misc_feature (273)..(273): n is a, c, g, or t
tcagacatacgcgtcacgaccggtgctcgatttagtctgacgtcaaaagggaaaggggctcagagaggagccttagccccggactccaaggcctttccacttggtgatcagcactgagcacagaggactcaccatgggattggggctgagcgtcgtcgtttcctaggtgctattttagagtntccngtgtgagtgcgcgtggtggagtccgtggggggtccttcggtcaggtccgtgggggtccctggacgacgtccgtcctgtgcgcgtccncgtgtattcggtagtttggacgtcctactcgtctggtcgttcgggcccgtcgagggtccgttaccgggagggggaacgggggtcggtaggggtacgggggttcgggttccgggaccaagacgtaccgttaaccgaaaacgggtaaaccggaaccggtaaacgaaaggttttaaaaggggtttaaattttaacggtcgggttacgggtacgtttccggttagggtacggggaacggggtcccgtaccgtttaccaaaccggttcctaacccggttacccgaaggaaaccgtaaacccggtaaccgtaaacggtaaaccgtaaacctttaccgttaacgtttccgttacgtacgtaaccgtaacggttaacgtacggtaaccgtaccggaccgtacgggaccggaccgggtaccggtaacgggacccggttaacgggtcccttcggtttacctttcgggtttttacctccgggtttataacgggaaaggaccggttacggtaaaagtccttaaaaccggttagttaccgggttttaactttcgtttaacggttacgtaagggtttaac

SEQ ID NO: 86249 - DNA, 686 bp, Homo sapiens
  misc_feature: GYAE6OF02FTSUQ.22.30.C08.1.454.CMB.1.raw
  modified_base (619)..(619): a, c, t, g, unknown or other
  misc_feature (619)..(619): n is a, c, g, or t
tcagacatacgcgtcacgaccggtgctcgatttagtctgacgtcaaaagggaaagggggagctctggggagtctgcaccatggcttggaccccactcctcttcctcaccctcctcctccactgcacagggtctctctcccaggttgtactgactcaatccgccctctgcctctcgccctcccgtgggacgccctcggtaccaaccctcacctgtcgtttcttagtgtaccaaacacgtacttactacaccgtcggcgtggcatacaaacaacgacgcggaagacgggccctcgctacttaagtgaagtattcggctaagttttcggacacgaccaaccaccgggtaaacggggggtcgggtacgtcccgtgtacgtccggttcgttaccggtccgggtccgtccgacgtccgtccggtccggggtaccgaacgggccgaccgtaccctcgaaccactcctaccaccgtccctaccgtacgttaccgtagaacgtagtacgggacgttacgtaacgtaacttacgttaacgtcgtacgtaagacgtagggtacggtacgtcggtcggtcgtcgtggtacgtcggtacggtacggaggtacgacgcgtcgacgtcgtgacncgtaccgacggcgtccgtcccgtcgtaccgtcttcgtcccgttaccccaccgtccacgtaccgtacg

SEQ ID NO: 86250 - DNA, 509 bp, Homo sapiens
  misc_feature: GYAE6OF02GN91C.22.30.C08.1.454.CMB.1.raw
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (421)..(421): a, c, t, g, unknown or other
  misc_feature (421)..(421): n is a, c, g, or t
  modified_base (464)..(464): a, c, t, g, unknown or other
  misc_feature (464)..(464): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatctgggggggccttggtccagcctggggggtccctgagactcgcctgtgcagcctctggattcgagtttggagcctactgtctgacttgggtccgccaggctccgagggaaggggctggagtgggtggccagcatcaacgagacggacataaggaatttangtgctntgtgaggcattcacatctcagacgacacgtcaaagactcactgttcngcagatgacagcctgcgagccgaggacacggctgtctatttcngtctgagacgacgagactaactacagttattacttagtgagtacg

SEQ ID NO: 86251 - DNA, 876 bp, Homo sapiens
  misc_feature: GYAE6OF02GXBQQ.22.30.C08.1.454.CMB.1.raw
tcagacatacgcgtcacgaccggtgctcgatttagtctgacgtcaaagggaaagggctcagagaggagccttagccccggactccaaggcctttccacttggtgatcagcactgagcacagaggactcaccatgggattggggctgagctggtcttttcctgttgcttattttagaaggtgtccagtgtgaggtgcgcctggtgaatcggtgggggccttggtccagccgtgggggtccctgacgactcgccgtgtgcacgcctctggtattcggtaggtttggacgtccctacgtgtccgtaggtaccgttcggggtccccgaccgtacgggtcccttccggaagggggtaacgggggtccgttaggggtaggttcgggggttacggcccgaaggtccgtaacgttaccgaaaaccgggaacggaacccgggaaccgtaaaggttaaacgggtttaaattttttaacggtcgggttaccggtaccccgtttcggttacgggttaacggaaaccgggggtcccgttaaacgttttacccgaacccttagttcccgtaacccgaaggtaaccggaaccgtaaacccgtaacgaaacggttaacctccgtaaccgtttggttttacctacggacgtaaaggtacgttacgggaacctaaccggtcccgttaacgggaccgtaaccggggtacccgaaacgggtacccgttaccggggtaccgtttacgggttttaaccgtttaaccggtttcgttacgggttaccgttaaccggtaaagggtaaccggtaaaccggtaacggttaactttaacccgggttaacctttaagggtttttaaccttaacccgttttaaggtaccggtaaccgtttaaacgg

SEQ ID NO: 86252 - DNA, 821 bp, Homo sapiens
  misc_feature: GYAE6OF02F8ONE.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctcctccgaggttcgtactgactcaactccgcctctacgcctctcgcccttccgtgggacgtccgtcggtaccaacctcaccgtgtcgtttcttagtacgtacaacgtacgtacttaacctaccgaccggtcgcggtcggacactaccaaacgaacgacggaccgggaaggaaccggggtcccctacggtacttaacgttaagtaggaaacgtgttacggaccttaggttttcggacctacgccctaaccgaacggggtaacggggggtccgggtaccttcccgtagtacgtccggtacctttcggtccgggtaccttccgacggtccgtcgggtccgggggaccgacggtccggtacctacccgtcctaacccgtacgttcccgtaccgaccggtccccttaccggtaacggttccgtaaggaacggtacgtacgggtaacggtccgtaggttaaccgtttaacgttaccgttacgtaccgtaacgaaccgttacgggttaccgggaccgttccgtacggtccggttcgttcgggcgtttacgggtccgggacgggtaccggtaccgtacgggtccgttaaccgacccggttcgtacggaccgaccgtaccgtacggtcccgtcccggttaccccgtggttaacctccgttccgttcccggtacccgccctaccggtacgtaccgtcg

SEQ ID NO: 86253 - DNA, 858 bp, Homo sapiens
  misc_feature: GYAE6OF02HH6IF.22.30.C08.1.454.CMB.1.raw
tcagacatacgcgtcacgaccggtgctcgatttagtctgacgtcaaagggaaaggggcgtcagagaggagccttagccccggactccaaggcctttccacttggtgatcagcactgagcacagaggactcaccagtgggattggggcgtgagcgtggtcttttccttgttgtcttagttttagaggtgtccagtgtgtaggtgccgtccgtggtggtaagtcggtcggggggtccttcggtccgacggtccggttcggggggtccctaggtacgtaccgtccgtccgttcggtcgccgtacgtccttcggtacggttacgttacggtaggttttacggacgttacccttaacgtcgttcgtcggtaccggttcgggtcccgaccgtacggtccgtacccgggagggggaacgggtcggtacgggtaggtcggggttacggaccggtaggtaccgtacgttaaccggaaaaccggaacgggtaacggtaacgtaaacggtaaaggttttaagtttacgttacggtacggtaaccgttggttacggtaacgggtaccggggtaccgtaccgttaaccgacccgttacgtacccgtaccggtaacgaaacgttaacccgaaacggttaacgtaaacccgtacgtaccgttaaccgttttcgtttaaccggcgtaacgttacgacggttaacgacgtaccgtcggaacggttacggaaccccgggcgggttaacggaaccggttaccgtaccggttacgtttaccctttagggtttcccgaggtttaccggtcgaaacgggtttacgacggttaactaaccgttataaccggttacttagttacctttaggtaccagttacg

SEQ ID NO: 86254 - DNA, 570 bp, Homo sapiens
  misc_feature: GYAE6OF02F1F4W.22.30.C08.1.454.CMB.1.raw
  modified_base (258)..(258): a, c, t, g, unknown or other
  misc_feature (258)..(258): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgcgttctagtgctatttagagtgtcagtgtgagtgcgcctggtggaatcgtggggggccttggtccagccgtgggggtccctggagactcgcctgtgcagcctcgngattcgagtttggagcctactgtctgacgttggtccgccaggctccgagggagggctgggaggtgggcgcagcgatcaacgagacgacaagtaagtatttangtgcctgtgtagaaggcctagttcacntctcagtagactaacgcaagtaactcactgtttcngacagtacgtcgacacgtcgtcgacgtacggaccgacggaccgacgtcgtcggtactttacgtttcgttcgttcggtacgtaagggaacgtacggaactacgttaactacgttacgtttaagttaccgttagttaggaccgttaacgg

SEQ ID NO: 86255 - DNA, 722 bp, Homo sapiens
  misc_feature: GYAE6OF02JF9RK.22.30.C08.1.454.CMB.1.raw
  modified_base (152)..(152): a, c, t, g, unknown or other
  misc_feature (152)..(152): n is a, c, g, or t
  modified_base (269)..(269): a, c, t, g, unknown or other
  misc_feature (269)..(269): n is a, c, g, or t
  modified_base (314)..(314): a, c, t, g, unknown or other
  misc_feature (314)..(314): n is a, c, g, or t
  modified_base (393)..(393): a, c, t, g, unknown or other
  misc_feature (393)..(393): n is a, c, g, or t
tcagacatacgcgtcacgaccggtgctcgatttagtctgacgtcaaagggaaaggggctcagagaggagccttagccccggactccaacggtcctttccacttggtgatcagcactgagcacagaggactcaccagtgggagttggggctgngctggtcttttcctgttgcttagtttagtaaggtgtccagtgtgaggtgcggcgtgtcggagtcggtcgggggtcttcggccacgccggtcgggggtccctgaacgcgtcgccgtgngccacgtcctgtcggtcgtttcgaggttcggacgtaccctgttcncgtgtaccggttcgggtcccaccggtaggaccttaccgggaggggtacggtcggtggtagggttccggggtccggacgngtaccgtacgtaacggaaaggtacgaacggtacgtaagttaaacgttagttttacgaggtcgtacgtcgtaggtacggacggtcctacgttcacgtacgtactacgagtacgaaccgacgtaacgacgtacttaccgtacgtcgttacgtcggtacgagtacggtcacgtacggccgtacgggaccggtacggaccgggttacggaacccgttgaccgtttccgttaacgttacgtttcgtacggttacgtacggaaacggtaccggtaacgtaacgttacgttaacccgtacgttaacgttccttagttacggtacggtaattacggg

SEQ ID NO: 86256 - DNA, 709 bp, Homo sapiens
  misc_feature: GYAE6OF02JJAJZ.22.30.C08.1.454.CMB.1.raw
  modified_base (184)..(184): a, c, t, g, unknown or other
  misc_feature (184)..(184): n is a, c, g, or t
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
tcagacatacgcgtcacgaccggtgctcgatttagtctgacgtcaaagggaaagggggagctctggggagtctgcaccatggcttggaccccactcctcttcctcaaccctcctcctccactcgcacagggtctctctccaggttgactgactcatcgcctctcgcctctcgcctcctgggacncctcggtccaaccctcacctcgtcttacttagtacgtccaacgtacgtattacacctccgtccgtcggtcggactacgtacaaacgaacgacggccggtaacggaacggggtccctcgaccttaacgtagtagaacgtagttcggcttacgtttcggacgacgtcccaaccgacggtagggggtccggtactcccgtgacggtcctcgtcgtcgggcctaaccgngtccgtcggtcgggaccgtacgccgtcaccgttaaccncgtctaccgtcgaccgtccctccgacgtctacgaaacggtctcggtacggtaccttaacgacgtacgttcgtacggtacaacggtcaggttccggacggtcgtcggtcgtcggtactcgttcgggtacggacgggacggtacgacgtccgtacggtaccgtcgtaccgtacggtaccaccgggtagcccggtcgtcccccgtacgggtaccttaccgtcccgtttaccgaccccgttaccccgtcgtacccgtacgttccgg

SEQ ID NO: 86257 - DNA, 876 bp, Homo sapiens
  misc_feature: GYAE6OF02JX1KU.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggttcttttccgttgttgtactattttagaaggtcgtcctagtgtggtaggtcgcgccgttggtaggaacgtcgggttcgggggggtccttcgggtccgacggtcccgggttcggggggttcccctggaacgtccggttcccggcccggtagtcgaccgccgttccgttcggtacggttacgttacggttaggtttacggaccgttaccgttaacgttccgttcggtacggttaccgggtttccgggtacccgaccggttccggtaccgggtaacgggtaacgggggtaacggtcgggttaggggtaacggggttcgggtccgaccggtacgaacgtacgtaacggaacgggaacgtaacggtacgtaaaggttaagtttaagttacggtacggtcgtacgttggtacgggttacgacggtaccgtacgtacctaaccgtcgtaccgtaacggaacgtactaaaccgtaaacgtaacgtaaaccttccgtaaacgtttcgttaccgttaccgtaggtactaacgggtaccttacggaacctttaccggacggttcgggacccgtaaaccgggtccggtaaccgggtaccttaccggttacgtttaccgttagtttccgtttacggtacgttcggtaacggtcggttaaccgtaaccggtacgttaagttaaccggacccgttttagttaacctttaagtcggttaaccgttaacggttaaccggg

SEQ ID NO: 86258 - DNA, 854 bp, Homo sapiens
  misc_feature: GYAE6OF02GHCTJ.22.30.C08.1.454.CMB.1.raw
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacgagggtctctctcccaggttgtactgactcaatcgccctctcgcctctcgccttcccgtggggacgccgtcggtcaaccctcacctgtccgttcttagtacgtcaacacgattacctacgaccgtcgcgtggcatacaacacacggccggagaacgggccctgctaacttacgngaacgtnttcggtactagttttcggacacgcccaaccgacggtaacgggggggtacggacgtcccgtaggacgtccgtccgttacggccggggtcctaccgaggtccgtccggtcggggggtacccgacgggccgtacctacccgtaccaaccctacttcccgtacccaacggtccccttacccgtacggtcccgtaggaacggtagtacggggtacgtaccggttaggtaactttacgttccgtttacgacccggttacgacggttaacgggttaccgggggaaccttcgggttacccggggtcgttacgggttcgggtacccgggtttacggggttaccgggggttaccggggaaaccgggtaccgtaaacggggtcccgttaccgggttaaaccccggttgttaaaccggtcccggtaaccggtaccgggtaaccggtccccggttaccccggttaccccccggtacggttaccccgtaccggtttccccggtttacccgggttacccccccgtccccttacccccggttaccgggacccgtttaacccggg

SEQ ID NO: 86259 - DNA, 823 bp, Homo sapiens
  misc_feature: GYAE6OF02I6DK7.22.30.C08.1.454.CMB.1.raw
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
  modified_base (662)..(662): a, c, t, g, unknown or other
  misc_feature (662)..(662): n is a, c, g, or t
tcagacatacgcgtcacgaccggtgctcgatttagtctgacgtcaaagggaaagggggagctctgggggagtctgcaccatggcttggaccccactcctcttcctcaccctccctcctccactgccacgtagggtcctcctcctccgtaggttcgtactcgactacaactcccgtccctntcgtcctcgtccgtccctccgngggcgtccgtccgtaccacctcaccgtgtccgtttactagtacaccaactaacgtcttaaccaccgtccggtcgtccgtagctaactacaaaccgtaacgacggaccggtagtaccggtccctacgtacttaacgtaaggtagtaacgtcgttacgtacttacgttggacaaccggtacccgtaaccggtaaacgggtacggggtaccgtccaccgtagaccgtcgtccgtcgcggtccgacacggtcgtacgggtcggccgtcgaccgtccgtaacctccggtacctccgtccgtacctaccggtcctacgtacgtgtaacgtacgtgtacgacgttacgtacctaggttacctacgtaacgtcggaacgtacgggtcgtaaccgggtccgttaggtcccggtcgttccggtaccgggtccgtagggtaaccggaccgggtaacccgtacggaccggtntaccccgggtaacgtcccggttaacgggtaccccggtaccggccggttaccggtaccccggttccccgggtacccgttaacccggcccgtttacccggttaccccggttaccccttccccccgggttaccgtcccccgttaccgtacccgggttaacccgg

SEQ ID NO: 86260 - DNA, 176 bp, Homo sapiens
  misc_feature: GYAE6OF01BH2ST.1.89.I01.1.454.CMB.1.raw
  modified_base (114)..(114): a, c, t, g, unknown or other
  misc_feature (114)..(114): n is a, c, g, or t
  modified_base (169)..(176): a, c, t, g, unknown or other
  misc_feature (169)..(176): n is a, c, g, or t
tcagacgagtgcgtcacgaccggtgctcgatttagtatgctagtatcgcggggtggttcggcggaggaccgaaactagaccgtcctaggtcagcccaaggctgcccctccggtnactctgttccaccctcctctactgctagtctgagcgggctggcaaggcgcatagnnnnnnnn

SEQ ID NO: 86261 - DNA, 162 bp, Homo sapiens
  misc_feature: GYAE6OF01CAUXK.1.89.I01.1.454.CMB.1.raw
tcagacgagtgcgtcacgaccggtgctcgattagtatgctagtatcgcggggtgttcggcggaggaccaaactgaccgtcctaggtcagcccaaggctgcccctcggtcactctgttccgccctcctcatagcgtactctgagcggctggcaaggcgcatag

SEQ ID NO: 86262 - DNA, 159 bp, Homo sapiens
  misc_feature: GYAE6OF01C4OO6.1.89.I01.1.454.CMB.1.raw
  modified_base (158)..(159): a, c, t, g, unknown or other
  misc_feature (158)..(159): n is a, c, g, or t
tcagacgagtgcgtcacgaccggtgctcgattagtatgctagtatcgcgggtgttcggcggaggaccaactgaccgtcctaggtcagccaaggctgccctcggtcactctgttccacctcctctgtcgagcgtctgagcggctggcaaggcgcatagnn

SEQ ID NO: 86263 - DNA, 163 bp, Homo sapiens
  misc_feature: GYAE6OF01DSNTL.1.89.I01.1.454.CMB.1.raw
  modified_base (163)..(163): a, c, t, g, unknown or other
  misc_feature (163)..(163): n is a, c, g, or t
tcagacgagtgcgtcacgaccggtgctcgatttagtatgctagtatcgcgggtgttcggcggaggaccaactgaccgtcctaggtcagcccaaggctgccctcggtcactctgttcccgccctcctctgtcgagcgtctgagcgggctggcaaggcgcatagn

SEQ ID NO: 86264 - DNA, 165 bp, Homo sapiens
  misc_feature: GYAE6OF01C5JDM.1.89.I01.1.454.CMB.1.raw
  modified_base (164)..(165): a, c, t, g, unknown or other
  misc_feature (164)..(165): n is a, c, g, or t
tcagacgagtgcgtcacgaccggtgctcgatttagtatgctagtatcgcggggtgttcggcggaggaccaactgaccgtcctaggtcagcccaaggctgcccctcggtcactctgttcccaccctcctcatagcgtactctgagcggctggcaaggcgcatagnn

SEQ ID NO: 86265 - DNA, 169 bp, Homo sapiens
  misc_feature: GYAE6OF01DNDH7.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctccgtgtctgatctgagcgggctggcaaggcgcatagnn

SEQ ID NO: 86266 - DNA, 167 bp, Homo sapiens
  misc_feature: GYAE6OF01BFCT3.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctctactgctagtctgagcgggctggcaaggcgcatagn

SEQ ID NO: 86267 - DNA, 165 bp, Homo sapiens
  misc_feature: GYAE6OF01A8VR6.1.89.I01.1.454.CMB.1.raw
  modified_base (165)..(165): a, c, t, g, unknown or other
  misc_feature (165)..(165): n is a, c, g, or t
tcagacgagtgcgtcacgaccggtgctcgatttagtatgctagtatcgcggggtgttcggcggagggaccaactgaccgtcctaggtcagcccaaggctgcccctcggtcactctgttcccacctcctcgagtgcgtctctgagcgggctggcaaggcgcatagn

SEQ ID NO: 86268 - DNA, 170 bp, Homo sapiens
  misc_feature: GYAE6OF01CAZLH.1.89.I01.1.454.CMB.1.raw
  modified_base (166)..(170): a, c, t, g, unknown or other
  misc_feature (166)..(170): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccatctgaatagcgtactctgagcggctggcaaggcgcatagnnnnn

SEQ ID NO: 86269 - DNA, 191 bp, Homo sapiens
  misc_feature: GYAE6OF01CZPL5.1.89.I01.1.454.CMB.1.raw
  modified_base (166)..(191): a, c, t, g, unknown or other
  misc_feature (166)..(191): n is a, c, g, or t
tcagacgagtgcgtcacgaccggtgctcgatttagtatgctagtatcgcgggggtgttcggcggaggaccaaactgaccgtcctaggtcagccaaggctgcccctcggtcactctgttcccgccctcctcatagcgtactctgagcgggctggcaaggcgcatagnnnnnnnnnnnnnnnnnnnnnnnnnn

SEQ ID NO: 86270 - DNA, 185 bp, Homo sapiens
  misc_feature: GYAE6OF01CKYA9.1.89.I01.1.454.CMB.1.raw
  modified_base (183)..(185): a, c, t, g, unknown or other
  misc_feature (183)..(185): n is a, c, g, or t
tcagacgagtgcgtcacgaccggtgctcgattagtatgctagtatggatgacagcctgagtgcccttatgtcttcggaactgggaccaaggtcaccgtcctaggtcagcccaaggccaacccactgtcactctgttccaccctcctctctctcgactctgagcgggctggcaaggcgcatagnnn

SEQ ID NO: 86271 - DNA, 170 bp, Homo sapiens
  misc_feature: GYAE6OF01A4B2O.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcctacagtgctctgagcgggctggcaaggcgcatagnn

SEQ ID NO: 86272 - DNA, 167 bp, Homo sapiens
  misc_feature: GYAE6OF01BCLAE.1.89.I01.1.454.CMB.1.raw
  modified_base (166)..(167): a, c, t, g, unknown or other
  misc_feature (166)..(167): n is a, c, g, or t
tcagacgagtgcgtcacgaccggtgctcgatttagtatgctagtatcgcgggaatgttcggcggggaccaagctgaccgtcttaggtcagcccaaggctgcccctcggtcactctgttcccgccctcctctgtcgagcgtctgagcgggctggcaaggcgcatagnn

SEQ ID NO: 86273 - DNA, 168 bp, Homo sapiens
  misc_feature: GYAE6OF01B1C9E.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcccaccctcctcacgtagcgtgctgagcgggctggcaaggcgcatagn

SEQ ID NO: 86274 - DNA, 167 bp, Homo sapiens
  misc_feature: GYAE6OF01DZSOA.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctcatagcgtactctgagcgggctggcaaggcgcatagn

SEQ ID NO: 86275 - DNA, 169 bp, Homo sapiens
  misc_feature: GYAE6OF01D8GDS.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcatagcgtactctgagcgggctggcaaggcgcatagnn

SEQ ID NO: 86276 - DNA, 169 bp, Homo sapiens
  misc_feature: GYAE6OF01EMQN7.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctagtctgagcgggctggcaaggcgcatagnn

SEQ ID NO: 86277 - DNA, 168 bp, Homo sapiens
  misc_feature: GYAE6OF01DPOO1.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcacgtctactgctgagcgggctggcaaggcgcatagnn

SEQ ID NO: 86278 - DNA, 196 bp, Homo sapiens
  misc_feature: GYAE6OF01EOP4V.1.89.I01.1.454.CMB.1.raw
  modified_base (187)..(196): a, c, t, g, unknown or other
  misc_feature (187)..(196): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctctctctcgactctgagcgggctggcaaggcgcatagnnnnnnnnnn

SEQ ID NO: 86279 - DNA, 167 bp, Homo sapiens; identical to SEQ ID NO: 86274
  misc_feature: GYAE6OF01BW4II.1.89.I01.1.454.CMB.1.raw
  modified_base (167)..(167): a, c, t, g, unknown or other
  misc_feature (167)..(167): n is a, c, g, or t

SEQ ID NO: 86280 - DNA, 181 bp, Homo sapiens
  misc_feature: GYAE6OF01DL47G.1.89.I01.1.454.CMB.1.raw
  modified_base (170)..(181): a, c, t, g, unknown or other
  misc_feature (170)..(181): n is a, c, g, or t
tcagacgagtgcgtcacgaccggtgctcgatttagtatgctagtatcggcgggggtgttcggcggagggaccaaactgaccgtcctaggtcagcccaaggctgccccctcggtcactctgttcccgccctcctctcgtactgcgctgagcgggctggcaaggcgcatagnnnnnnnnnnnn

SEQ ID NO: 86281 - DNA, 167 bp, Homo sapiens
  misc_feature: GYAE6OF01EHGFC.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcacgtagcgtgctgagcgggctggcaaggcgcatagn

SEQ ID NO: 86282 - DNA, 168 bp, Homo sapiens
  misc_feature: GYAE6OF01DZ6V7.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcatagcgtactctgagcgggctggcaaggcgcatagn

SEQ ID NO: 86283 - DNA, 169 bp, Homo sapiens
  misc_feature: GYAE6OF01AUANV.1.89.I01.1.454.CMB.1.raw
  modified_base (167)..(169): a, c, t, g, unknown or other
  misc_feature (167)..(169): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctctgtcgagcgtctgagcgggctggcaaggcgcatagnnn

SEQ ID NO: 86284 - DNA, 167 bp, Homo sapiens
  misc_feature: GYAE6OF01D0RI2.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccatctgaatagcgtactctgagcgggctggcaaggcgcatagn

SEQ ID NO: 86285 - DNA, 169 bp, Homo sapiens
  misc_feature: GYAE6OF01EME2B.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagn

SEQ ID NO: 86286 - DNA, 171 bp, Homo sapiens
  misc_feature: GYAE6OF01CTB9B.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctttcgtactgcgctgagcgggctggcaaggcgcatagnnn

SEQ ID NO: 86287 - DNA, 168 bp, Homo sapiens
  misc_feature: GYAE6OF01E0QBB.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgcatagn

SEQ ID NO: 86288 - DNA, 223 bp, Homo sapiens
  misc_feature: GYAE6OF01CZMJM.1.89.I01.1.454.CMB.1.raw
  modified_base (221)..(223): a, c, t, g, unknown or other
  misc_feature (221)..(223): n is a, c, g, or t
tcagacgagtgcgtcacgaccggtgctcgatttagtatgctagtatgggcacgaccgacctgagctcaggaggcagcagagcgagggaggaggagaggcccaggtgaacggaggggcttgtccaggccggcagcatcaccggagcccagggcagggtcagcagtgctggccgtggggccctcctctctctcgactctgagcgggctggcaaggcgcatagnnn

SEQ ID NO: 86289 - DNA, 189 bp, Homo sapiens
  misc_feature: GYAE6OF01CROAB.1.89.I01.1.454.CMB.1.raw
  modified_base (185)..(189): a, c, t, g, unknown or other
  misc_feature (185)..(189): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaacccactgtcactctgttccgccctcctctctctcgactctgagcgggctggcaaggcgcatagnnnnn

SEQ ID NO: 86290 - DNA, 147 bp, Homo sapiens
  misc_feature: GYAE6OF01BPOQR.1.89.I01.1.454.CMB.1.raw
  modified_base (146)..(147): a, c, t, g, unknown or other
  misc_feature (146)..(147): n is a, c, g, or t
tcagacgagtgcgtcacgaccggtgctcgatttagtatgctagtatgggagagggccaccatcaattgaactgtggctgcaccatctgtcttcatcttcccgccatctgaacgcactcgtctgagcgggctggcaaggcgcatagnn

SEQ ID NO: 86291 - DNA, 167 bp, Homo sapiens; identical to SEQ ID NO: 86274
  misc_feature: GYAE6OF01EPLQR.1.89.I01.1.454.CMB.1.raw
  modified_base (167)..(167): a, c, t, g, unknown or other
  misc_feature (167)..(167): n is a, c, g, or t

SEQ ID NO: 86292 - DNA, 167 bp, Homo sapiens
  misc_feature: GYAE6OF01DU1P2.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtcttcggagctgggaccaaggtcaccgtcctaggtaagcccaaggccaacccactgtcactctgttcccaccctcctcacgtctactgctgagcgggctggcaaggcgcatagn

SEQ ID NO: 86293 - DNA, 204 bp, Homo sapiens
  misc_feature: GYAE6OF01CE8JM.1.89.I01.1.454.CMB.1.raw
  modified_base (168)..(204): a, c, t, g, unknown or other
  misc_feature (168)..(204): n is a, c, g, or t
tcagacgagtgcgtcacgaccggtgctcgatttagtatgctagtatcgcgggggtggttcggcggagggaccaaactgaccgtcctaggtcagcccaaggctgcccctggtcactcctgttcccacctcctctactgctagtctgagcgggctggcaaggcgcatagnnnnnnnnnnnnnnnnnnnnnnnnnnnnnnnnnnnnn

SEQ ID NO: 86294 - DNA, 146 bp, Homo sapiens
  misc_feature: GYAE6OF01DUEU4.1.89.I01.1.454.CMB.1.raw
  modified_base (146)..(146): a, c, t, g, unknown or other
  misc_feature (146)..(146): n is a, c, g, or t
tcagacgagtgcgtcacgaccggtgctcgatttagtatgctagtatgggagagggccaccatcaattgaactgtggctgcaccatctgtcttcatcttcccgccatctgaacgcactcgtctgagcgggctggcaaggcgcatagn

SEQ ID NO: 86295 - DNA, 200 bp, Homo sapiens
  misc_feature: GYAE6OF01D0GMM.1.89.I01.1.454.CMB.1.raw
  modified_base (186)..(200): a, c, t, g, unknown or other
  misc_feature (186)..(200): n is a, c, g, or t
tcagacgagtgcgtcacgaccggtgctcgatttagtatgctagtagtgggatgacagcctgagtgcccttatgtcttcggaactgggaccaaggtcaccgtcctaggtcagcccaaggccaacccactgtcactctgttcccgtcctcctctctctcgactctgagcggctggcaaggcgcatagnnnnnnnnnnnnnnn

SEQ ID NO: 86296 - DNA, 170 bp, Homo sapiens
  misc_feature: GYAE6OF01DXQ6Y.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctctactgctagtctgagcgggctggcaaggcgcatagnn

SEQ ID NO: 86297 - DNA, 168 bp, Homo sapiens
  misc_feature: GYAE6OF01B0JF2.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcacgcactcgtctgagcgggctggcaaggcgcatagnn

SEQ ID NO: 86298 - DNA, 169 bp, Homo sapiens
  misc_feature: GYAE6OF01ADEDX.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcacgtagcgtgctgagcgggctggcaaggcgcatagn

SEQ ID NO: 86299 - DNA, 226 bp, Homo sapiens
  misc_feature: GYAE6OF01B5HUN.1.89.I01.1.454.CMB.1.raw
  modified_base (148)..(148): a, c, t, g, unknown or other
  misc_feature (148)..(148): n is a, c, g, or t
  modified_base (177)..(226): a, c, t, g, unknown or other
  misc_feature (177)..(226): n is a, c, g, or t
tcagacgagtgcgtcacgaccggtgctcgatttagtatgctagtatacggcgggggtgttcggcggagggaccaaactcgaccgtcctaggtcagcccaaggctgcccccctggtcactctgttcccgccctcctctgtcgagccgtntgagccgggcttggcaaggcgcattagcnnnnnnnnnnnnnnnnnnnnnnnnnnnnnnnnnnnnnnnnnnnnnnnnnn

SEQ ID NO: 86300 - DNA, 162 bp, Homo sapiens
  misc_feature: GYAE6OF01BO7QO.1.89.I01.1.454.CMB.1.raw
  modified_base (160)..(162): a, c, t, g, unknown or other
  misc_feature (160)..(162): n is a, c, g, or t
tcagacgagtgcgtcacgaccggtgctcgatttagtatgctagtatcgcgggtgttcggcggaggaccaactgaccgtcctaggtcagcccaaggctgccctcggtcactctgttccgcctcctctgtcgagcgtctgagcggctggcaaggcgcatagnnn

SEQ ID NO: 86301 - DNA, 191 bp, Homo sapiens
  misc_feature: GYAE6OF01B04MC.1.89.I01.1.454.CMB.1.raw
  modified_base (169)..(191): a, c, t, g, unknown or other
  misc_feature (169)..(191): n is a, c, g, or t
tcagacgagtgcgtcacgaccggtgctcgatttagtatgctagtatcgcgggggtgttcggcggagggaccaaactgaccgtcctaggtcagcccaaggcctgcccctcggtcactctgttcccgccctcctccgtgtctgatctgagcgggctggcaaggcgcatagnnnnnnnnnnnnnnnnnnnnnnn

SEQ ID NO: 86302 - DNA, 169 bp, Homo sapiens
  misc_feature: GYAE6OF01CWXJA.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctctcatagcgtactctgagcgggctggcaaggcgcatagnn

SEQ ID NO: 86303 - DNA, 169 bp, Homo sapiens
  misc_feature: GYAE6OF01AP20O.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctgtcgagcgtctgagcgggctggcaaggcgcatagn

SEQ ID NO: 86304 - DNA, 170 bp, Homo sapiens
  misc_feature: GYAE6OF01EWF9Y.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgcatagnnn

SEQ ID NO: 86305 - DNA, 201 bp, Homo sapiens
  misc_feature: GYAE6OF01A4K54.1.89.I01.1.454.CMB.1.raw
  modified_base (157)..(201): a, c, t, g, unknown or other
  misc_feature (157)..(201): n is a, c, g, or t
tcagacgagtgcgtcacgaccggtgctcgatttagtatgctagtatcgcgggtgttcggcgaggaccaactgaccgtcctaggtcagccaaggctgccctcggtcactctgttccacctctctactgctagtctgagcggctggcaaggcgcatagnnnnnnnnnnnnnnnnnnnnnnnnnnnnnnnnnnnnnnnnnnnnn

SEQ ID NO: 86306 - DNA, 169 bp, Homo sapiens
  misc_feature: GYAE6OF01EWSWM.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcacgtctactgctgagcgggctggcaaggcgcatagn

SEQ ID NO: 86307 - DNA, 169 bp, Homo sapiens
  misc_feature: GYAE6OF01E4FLF.1.89.I01.1.454.CMB.1.raw
  modified_base (167)..(169): a, c, t, g, unknown or other
  misc_feature (167)..(169): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctctactgctagtctgagcgggctggcaaggcgcatagnnn

SEQ ID NO: 86308 - DNA, 166 bp, Homo sapiens
  misc_feature: GYAE6OF01CA89Q.1.89.I01.1.454.CMB.1.raw
  modified_base (166)..(166): a, c, t, g, unknown or other
  misc_feature (166)..(166): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttccaccctcctctactgctagtctgagcgggctggcaaggcgcatagn

SEQ ID NO: 86309 - DNA, 187 bp, Homo sapiens
  misc_feature: GYAE6OF01ERY2M.1.89.I01.1.454.CMB.1.raw
  modified_base (168)..(187): a, c, t, g, unknown or other
  misc_feature (168)..(187): n is a, c, g, or t
tcagacgagtgcgtcacgaccggtgctcgatttagtatgctagtatcgcgggggtggttcggcggagggaccaactgaccgtcctaggtcagcccaaggctgcccctcggtcactctgttcccaccctcctctcgtactgcgctgagcgggctggcaaggcgcatagnnnnnnnnnnnnnnnnnnnn

SEQ ID NO: 86310 - DNA, 230 bp, Homo sapiens
  misc_feature: GYAE6OF01DAG9J.1.89.I01.1.454.CMB.1.raw
  modified_base (185)..(230): a, c, t, g, unknown or other
  misc_feature (185)..(230): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccatgtcactctgttccgccctcctctctctcgactctgagcgggctggcaaggcgcatagnnnnnnnnnnnnnnnnnnnnnnnnnnnnnnnnnnnnnnnnnnnnnn

SEQ ID NO: 86311 - DNA, 147 bp, Homo sapiens; identical to SEQ ID NO: 86290
  misc_feature: GYAE6OF01DJPFH.1.89.I01.1.454.CMB.1.raw
  modified_base (146)..(147): a, c, t, g, unknown or other
  misc_feature (146)..(147): n is a, c, g, or t

SEQ ID NO: 86312 - DNA, 184 bp, Homo sapiens
  misc_feature: GYAE6OF01BR1O1.1.89.I01.1.454.CMB.1.raw
  modified_base (169)..(184): a, c, t, g, unknown or other
  misc_feature (169)..(184): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctaggtctgagcgggctggcaaggcgcatagnnnnnnnnnnnnnnnn

SEQ ID NO: 86313 - DNA, 232 bp, Homo sapiens
  misc_feature: GYAE6OF01CEHDO.1.89.I01.1.454.CMB.1.raw
  modified_base (225)..(232): a, c, t, g, unknown or other
  misc_feature (225)..(232): n is a, c, g, or t
tcagacgagtgcgtcacgaccggtgctcgatttagtatgctagtatcggcggggcccaggcagatgatgagtctacttactattgtgtccttacttgcgtgatggcatttggctgttcggcggaggaccaaagtgaccgtcctgggtcagcccaaggctgccccctggtcactctgttcccgcctcctctgtcgagcgtctgagcgggctggcaaggcgcatagnnnnnnnn

SEQ ID NO: 86314 - DNA, 187 bp, Homo sapiens
  misc_feature: GYAE6OF01BCAL3.1.89.I01.1.454.CMB.1.raw
  modified_base (187)..(187): a, c, t, g, unknown or other
  misc_feature (187)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctctctctcgactctgagcgggctggcaaggcgcatagn

SEQ ID NO: 86315 - DNA, 126 bp, Homo sapiens
  misc_feature: GYAE6OF01CDAPC.1.89.I01.1.454.CMB.1.raw
  modified_base (116)..(126): a, c, t, g, unknown or other
  misc_feature (116)..(126): n is a, c, g, or t
tcagacgagtgcgtcacgaccggtgctcgatttagtatgctagtatggggccctgggctgcctggtcaaggactacttccacgcactcgtctgagcgggctggcaaggcgcatagnnnnnnnnnnn

SEQ ID NO: 86316 - DNA, 170 bp, Homo sapiens
  misc_feature: GYAE6OF01D1GR5.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcgagtgcgtctctgagcgggctggcaaggcgcatagn

SEQ ID NO: 86317 - DNA, 168 bp, Homo sapiens
  misc_feature: GYAE6OF01AHFIM.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctccgtgtctgatctgagcgggctggcaaggcgcatagn

SEQ ID NO: 86318 - DNA, 169 bp, Homo sapiens
  misc_feature: GYAE6OF01D9QQK.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcgagtgcgtctctgagcgggctggcaaggcgcatagnn

SEQ ID NO: 86319 - DNA, 169 bp, Homo sapiens
  misc_feature: GYAE6OF01CG92B.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctcgtactgcgctgagcgggctggcaaggcgcatagn

SEQ ID NO: 86320 - DNA, 250 bp, Homo sapiens
  misc_feature: GYAE6OF01C6CBV.1.89.I01.1.454.CMB.1.raw
  modified_base (226)..(250): a, c, t, g, unknown or other
  misc_feature (226)..(250): n is a, c, g, or t
tcagacgagtgcgtcacgaccggtgctcgatttagtatgctagtatcggtcggggacgaggccgacttattactgcggacctgggataccagtctgagttcgtcgtggtgttcggcggagggaccgaagctgaccgtcgcaggtcagcccaagtctgccccctggtcactctgttcccaccctcctctagacgacaccgcctgagcgggctggcaaggcgcatagnnnnnnnnnnnnnnnnnnnnnnnnn

SEQ ID NO: 86321 - DNA, 202 bp, Homo sapiens
  misc_feature: GYAE6OF01DMMGN.1.89.I01.1.454.CMB.1.raw
  modified_base (166)..(202): a, c, t, g, unknown or other
  misc_feature (166)..(202): n is a, c, g, or t
tcagacgagtgcgtcacgaccggtgctcgatttagtatgctagtatcgcgggggtgttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnn

SEQ ID NO: 86322 - DNA, 169 bp, Homo sapiens
  misc_feature: GYAE6OF01DRVZU.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcgagtgcgtctctgagcgggctggcaaggcgcatagn

SEQ ID NO: 86323 - DNA, 169 bp, Homo sapiens; identical to SEQ ID NO: 86285
  misc_feature: GYAE6OF01DA3Z2.1.89.I01.1.454.CMB.1.raw
  modified_base (169)..(169): a, c, t, g, unknown or other
  misc_feature (169)..(169): n is a, c, g, or t

SEQ ID NO: 86324 - DNA, 168 bp, Homo sapiens; identical to SEQ ID NO: 86282
  misc_feature: GYAE6OF01CSCV9.1.89.I01.1.454.CMB.1.raw
  modified_base (168)..(168): a, c, t, g, unknown or other
  misc_feature (168)..(168): n is a, c, g, or t

SEQ ID NO: 86325 - DNA, 168 bp, Homo sapiens
  misc_feature: GYAE6OF01CDBY7.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctagtctgagcgggctggcaaggcgcatagn

SEQ ID NO: 86326 - DNA, 286 bp, Homo sapiens
  misc_feature: GYAE6OF01B85GV.1.89.I01.1.454.CMB.1.raw
  modified_base (281)..(286): a, c, t, g, unknown or other
  misc_feature (281)..(286): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtgggccctcctctcagccaggaccaaggacagcagcctcaccaaggcccatcggtctcccctggcacctcctcacgtctactgctgagcggctggcaaggcgcatagnnnnnn

SEQ ID NO: 86327 - DNA, 170 bp, Homo sapiens
  misc_feature: GYAE6OF01EDY27.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctgtcgagcgtctgagcgggctggcaaggcgcatagnn

SEQ ID NO: 86328 - DNA, 172 bp, Homo sapiens
  misc_feature: GYAE6OF01CBP94.1.89.I01.1.454.CMB.1.raw
  modified_base (167)..(172): a, c, t, g, unknown or other
  misc_feature (167)..(172): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcccgcctcctcacgtagcgtgctgagcgggctggcaaggcgcatagnnnnnn

SEQ ID NO: 86329 - DNA, 240 bp, Homo sapiens
  misc_feature: GYAE6OF01AY8QL.1.89.I01.1.454.CMB.1.raw
  modified_base (224)..(224): a, c, t, g, unknown or other
  misc_feature (224)..(224): n is a, c, g, or t
  modified_base (226)..(240): a, c, t, g, unknown or other
  misc_feature (226)..(240): n is a, c, g, or t
tcagacgagtgcgtcacgaccggtgctcgatttagtatgctagtatcgcggggcccaggcagatgatgaatctaattattactgtttgctttatttgatagtggctgggtgttcggcggcgggaccaagctgaccgtcctaggtcagcccaaggctgtccctcggtcactctgttacccgcctcctctatacgatcgctgagcgggctggcgaaggcgcatagngnnnnnnnnnnnnnnn

SEQ ID NO: 86330 - DNA, 181 bp, Homo sapiens
  misc_feature: GYAE6OF01B5HVH.1.89.I01.1.454.CMB.1.raw
  modified_base (148)..(181): a, c, t, g, unknown or other
  misc_feature (148)..(181): n is a, c, g, or t
tcagacgagtgcgtcacgaccggtgctcgatttagtatgctagtatgggtaggagggccaccatcaattgaactgtggctgcaccatctgtcttcatcttccgcatctgaacgcactacgtctgagcgggctggcaaggcgcagtagnnnnnnnnnnnnnnnnnnnnnnnnnnnnnnnnnn

SEQ ID NO: 86331 - DNA, 202 bp, Homo sapiens
  misc_feature: GYAE6OF01CJFL1.1.89.I01.1.454.CMB.1.raw
  modified_base (187)..(202): a, c, t, g, unknown or other
  misc_feature (187)..(202): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagcggtctggcaaggcgcatagnnnnnnnnnnnnnnnn

SEQ ID NO: 86332 - DNA, 187 bp, Homo sapiens
  misc_feature: GYAE6OF01BR05J.1.89.I01.1.454.CMB.1.raw
  modified_base (168)..(187): a, c, t, g, unknown or other
  misc_feature (168)..(187): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgcatagnnnnnnnnnnnnnnnnnnnn

SEQ ID NO: 86333 - DNA, 203 bp, Homo sapiens
  misc_feature: GYAE6OF01BWGQ7.1.89.I01.1.454.CMB.1.raw
  modified_base (160)..(203): a, c, t, g, unknown or other
  misc_feature (160)..(203): n is a, c, g, or t
tcagacgagtgcgtcacgaccggtgctcgatttagtatgctagtatcgcggggtgttcggcggaggaccaactgaccgtcctaggtcagccaaggctgccctcggtcactctgttccgcctcctctactgctagtctgagcggctggcaaggcgcatagnnnnnnnnnnnnnnnnnnnnnnnnnnnnnnnnnnnnnnnnnnnn

SEQ ID NO: 86334 - DNA, 170 bp, Homo sapiens
  misc_feature: GYAE6OF01EK9EE.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagnn

SEQ ID NO: 86335 - DNA, 168 bp, Homo sapiens; identical to SEQ ID NO: 86325
  misc_feature: GYAE6OF01CVNR9.1.89.I01.1.454.CMB.1.raw
  modified_base (168)..(168): a, c, t, g, unknown or other
  misc_feature (168)..(168): n is a, c, g, or t

SEQ ID NO: 86336 - DNA, 175 bp, Homo sapiens
  misc_feature: GYAE6OF01D6WJD.1.89.I01.1.454.CMB.1.raw
  modified_base (169)..(175): a, c, t, g, unknown or other
  misc_feature (169)..(175): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcatagcgtactctgagcgggctggcaaggcgcatagnnnnnnn

SEQ ID NO: 86337 - DNA, 169 bp, Homo sapiens
  misc_feature: GYAE6OF01C37S8.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgcatagnn

SEQ ID NO: 86338 - DNA, 171 bp, Homo sapiens
  misc_feature: GYAE6OF01A0JKP.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcacgtctactgctgagcgggctggcaaggcgcatagnnn

SEQ ID NO: 86339 - DNA, 241 bp, Homo sapiens
  misc_feature: GYAE6OF01BHGGB.1.89.I01.1.454.CMB.1.raw
  modified_base (240)..(241): a, c, t, g, unknown or other
  misc_feature (240)..(241): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccactgtcactctgttcccaccctcctcacgcactcgtctgagcgggctggcaaggcgcatagnn

SEQ ID NO: 86340 - DNA, 349 bp, Homo sapiens
  misc_feature: GYAE6OF01BBG59.1.89.I01.1.454.CMB.1.raw
  modified_base (342)..(349): a, c, t, g, unknown or other
  misc_feature (342)..(349): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtcttccccctggcaccctcctccaagagcacctctggggcacagcggccctgggctgcctggtcaaggactacttccgagtgcgtctctgagcgggctggcaaggcgcatagnnnnnnnn

SEQ ID NO: 86341 - DNA, 167 bp, Homo sapiens
  misc_feature: GYAE6OF01CFNCG.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctagtctgagcggctggcaaggcgcatagn

SEQ ID NO: 86342 - DNA, 168 bp, Homo sapiens
  misc_feature: GYAE6OF01DHS6V.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcacgtagcgtgctgagcgggctggcaaggcgcatagn

SEQ ID NO: 86343 - DNA, 169 bp, Homo sapiens
  misc_feature: GYAE6OF01CXBSV.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctctcgtactgcgctgagcgggctggcaaggcgcatagn

SEQ ID NO: 86344 - DNA, 170 bp, Homo sapiens
  misc_feature: GYAE6OF01CCBBX.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctccgtgtctgatctgagcgggctggcaaggcgcatagn

SEQ ID NO: 86345 - DNA, 192 bp, Homo sapiens
  misc_feature: GYAE6OF01A5R63.1.89.I01.1.454.CMB.1.raw
  modified_base (170)..(192): a, c, t, g, unknown or other
  misc_feature (170)..(192): n is a, c, g, or t
tcagacgagtgcgtcacgaccggtgctcgatttagtatgctagtatcggcggggaatgttcggcgggggaccaagctgaccgtcttaggtcagcccaaggctgccccctcggtcactctgttcccaccctcctctgtcgagcgtctgagcgggctggcaaggcgcatagnnnnnnnnnnnnnnnnnnnnnnn

SEQ ID NO: 86346 - DNA, 169 bp, Homo sapiens
  misc_feature: GYAE6OF01EKU4C.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccatctgaatagcgtactctgagcgggctggcaaggcgcatagn

SEQ ID NO: 86347 - DNA, 170 bp, Homo sapiens; identical to SEQ ID NO: 86334
  misc_feature: GYAE6OF01CRPKQ.1.89.I01.1.454.CMB.1.raw
  modified_base (169)..(170): a, c, t, g, unknown or other
  misc_feature (169)..(170): n is a, c, g, or t

SEQ ID NO: 86348 - DNA, 165 bp, Homo sapiens
  misc_feature: GYAE6OF01C1RSA.1.89.I01.1.454.CMB.1.raw
  modified_base (165)..(165): a, c, t, g, unknown or other
  misc_feature (165)..(165): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttccaccctcctctactgctagtctgagcggctggcaaggcgcatagn

SEQ ID NO: 86349 - DNA, 167 bp, Homo sapiens; identical to SEQ ID NO: 86274
  misc_feature: GYAE6OF01A1D3J.1.89.I01.1.454.CMB.1.raw
  modified_base (167)..(167): a, c, t, g, unknown or other
  misc_feature (167)..(167): n is a, c, g, or t

SEQ ID NO: 86350 - DNA, 217 bp, Homo sapiens
  misc_feature: GYAE6OF01CFINH.1.89.I01.1.454.CMB.1.raw
  modified_base (162)..(217): a, c, t, g, unknown or other
  misc_feature (162)..(217): n is a, c, g, or t
tcagacgagtgcgtcacgaccggtgctcgatttagtatgctagtatcgcggggtgttcggcgagggaccaactgaccgtcctaggtcagcccaaggctgcccctcggtcactctgttccgcctcctctactgctagtctgagcggctggcaaggcgcatagnnnnnnnnnnnnnnnnnnnnnnnnnnnnnnnnnnnnnnnnnnnnnnnnnnnnnnnn

SEQ ID NO: 86351 - DNA, 168 bp, Homo sapiens
  misc_feature: GYAE6OF01ESSX8.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcatagcgtactctgagcgggctggcaaggcgcatagn

SEQ ID NO: 86352 - DNA, 169 bp, Homo sapiens
  misc_feature: GYAE6OF01D9WIU.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggttgcccctcggtcactctgttcccaccctcctcatagcgtactctgagcgggctggcaaggcgcatagnn

SEQ ID NO: 86353 - DNA, 218 bp, Homo sapiens
  misc_feature: GYAE6OF01A7MKW.1.89.I01.1.454.CMB.1.raw
  modified_base (56)..(56): a, c, t, g, unknown or other
  misc_feature (56)..(56): n is a, c, g, or t
  modified_base (160)..(160): a, c, t, g, unknown or other
  misc_feature (160)..(160): n is a, c, g, or t
  modified_base (166)..(218): a, c, t, g, unknown or other
  misc_feature (166)..(218): n is a, c, g, or t
tcagacgagtgcgtcacgaccggtgctcgatttagtatgctagtatcgcgggggtnttcggcggagggaccaaactgaccgtcctaggtcagcccaaggctgcccctggtcactctgttcccacctcctctactgctagtctgagcgggctggcaaggcncatagnnnnnnnnnnnnnnnnnnnnnnnnnnnnnnnnnnnnnnnnnnnnnnnnnnnnn

SEQ ID NO: 86354 - DNA, 180 bp, Homo sapiens
  misc_feature: GYAE6OF01C60M2.1.89.I01.1.454.CMB.1.raw
  modified_base (170)..(180): a, c, t, g, unknown or other
  misc_feature (170)..(180): n is a, c, g, or t
tcagacgagtgcgtcacgaccggtgctcgatttagtatgctagtatcggcgggggtgttcggcggagggaccaaactgaccgtcctaggtcagcccaaggctgccccctcggtcactctgttcccaccctcctctactgctagtctgagcgggctggcaaggcgcatagnnnnnnnnnnn

SEQ ID NO: 86355 - DNA, 213 bp, Homo sapiens
  misc_feature: GYAE6OF01DFV2I.1.89.I01.1.454.CMB.1.raw
  modified_base (170)..(213): a, c, t, g, unknown or other
  misc_feature (170)..(213): n is a, c, g, or t
tcagacgagtgcgtcacgaccggtgctcgatttagtatgctagtatcggtcgggggtcttcggagctgggaccaaggtcaccgtcctaggtcagcccaaggccaacccactgtcactctgttcccacctcctcacgtctactggctgagcgggctggcaaggcgcatagnnnnnnnnnnnnnnnnnnnnnnnnnnnnnnnnnnnnnnnnnnnn

SEQ ID NO: 86356 - DNA, 168 bp, Homo sapiens
  misc_feature: GYAE6OF01A0RM1.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcggggtcttcggagctgggaccaaggtcaccgtcctaggtcagcccaaggccaaccccactgtcactctgttcccaccctcctcacgtctactgctgagcgggctggcaaggcgcatagn

SEQ ID NO: 86357 - DNA, 170 bp, Homo sapiens
  misc_feature: GYAE6OF01ELTPH.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcgagtgcgtctctgagcgggctggcaaggcgcatagnn

SEQ ID NO: 86358 - DNA, 169 bp, Homo sapiens; identical to SEQ ID NO: 86322
  misc_feature: GYAE6OF01C6GGF.1.89.I01.1.454.CMB.1.raw
  modified_base (169)..(169): a, c, t, g, unknown or other
  misc_feature (169)..(169): n is a, c, g, or t

SEQ ID NO: 86359 - DNA, 168 bp, Homo sapiens; identical to SEQ ID NO: 86342
  misc_feature: GYAE6OF01C8M90.1.89.I01.1.454.CMB.1.raw
  modified_base (168)..(168): a, c, t, g, unknown or other
  misc_feature (168)..(168): n is a, c, g, or t

SEQ ID NO: 86360 - DNA, 169 bp, Homo sapiens
  misc_feature: GYAE6OF01CIO1R.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcacgtctactgctgagcgggctggcaaggcgcatagn

SEQ ID NO: 86361 - DNA, 170 bp, Homo sapiens
  misc_feature: GYAE6OF01B8UT0.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctcgtactgcgctgagcgggctggcaaggcgcatagn

SEQ ID NO: 86362 - DNA, 170 bp, Homo sapiens
  misc_feature: GYAE6OF01EPDE7.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcatagcgtactctgagcgggctggcaaggcgcatagnn

SEQ ID NO: 86363 - DNA, 170 bp, Homo sapiens
  misc_feature: GYAE6OF01DWA2Y.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccatctgaatagcgtactctgagcgggctggcaaggcgcatagnn

SEQ ID NO: 86364 - DNA, 170 bp, Homo sapiens
  misc_feature: GYAE6OF01DXO4P.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactttgttcccaccctcctctgtcgagcgtctgagcgggctggcaaggcgcatagn

SEQ ID NO: 86365 - DNA, 168 bp, Homo sapiens
  misc_feature: GYAE6OF01EFUNE.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcggggtcttcggagctgggaccaaggtcaccgtcctaggtcagcccaaggccaaccccactgtcactctgttcccgccctcctcacgtctactgctgagcgggctggcaaggcgcatagn

SEQ ID NO: 86366 - DNA, 169 bp, Homo sapiens
  misc_feature: GYAE6OF01ASFTR.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcctgccctcctcatagcgtactctgagcgggctggcaaggcgcatagn

SEQ ID NO: 86367 - DNA, 188 bp, Homo sapiens
  misc_feature: GYAE6OF01AMTYS.1.89.I01.1.454.CMB.1.raw
  modified_base (187)..(188): a, c, t, g, unknown or other
  misc_feature (187)..(188): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagcgggctggcaaggcgcatagnn

SEQ ID NO: 86368 - DNA, 168 bp, Homo sapiens
  misc_feature: GYAE6OF01CLL7F.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcccacctcctcacgtagcgtgctgagcgggctggcaaggcgcatagnn

SEQ ID NO: 86369 - DNA, 168 bp, Homo sapiens
  misc_feature: GYAE6OF01B544F.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctactgctagtctgagcgggctggcaaggcgcatagnn

SEQ ID NO: 86370 - DNA, 174 bp, Homo sapiens
  misc_feature: GYAE6OF01BZWH3.1.89.I01.1.454.CMB.1.raw
  modified_base (167)..(174): a, c, t, g, unknown or other
  misc_feature (167)..(174): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcacgtctactgctgagcggctggcaaggcgcatagnnnnnnnn

SEQ ID NO: 86371 - DNA, 167 bp, Homo sapiens; identical to SEQ ID NO: 86341
  misc_feature: GYAE6OF01DOLR9.1.89.I01.1.454.CMB.1.raw
  modified_base (167)..(167): a, c, t, g, unknown or other
  misc_feature (167)..(167): n is a, c, g, or t

SEQ ID NO: 86372 - DNA, 190 bp, Homo sapiens
  misc_feature: GYAE6OF01CYTD6.1.89.I01.1.454.CMB.1.raw
  modified_base (187)..(190): a, c, t, g, unknown or other
  misc_feature (187)..(190): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctatgtatactctgagcgggctggcaaggcgcatagnnnn

SEQ ID NO: 86373 - DNA, 220 bp, Homo sapiens
  misc_feature: GYAE6OF01BNJLD.1.89.I01.1.454.CMB.1.raw
  modified_base (216)..(220): a, c, t, g, unknown or other
  misc_feature (216)..(220): n is a, c, g, or t
tcagacgagtgcgtcacgaccggtgctcgatttagtatgctagtatcgcgggacgaggccgattaatactgcgggacctgggataccagtctgagttctgtggtgttcggcggagggaccaagctgaccgtcgcaggtcagcccaagtctgcccctcggtcactctgttcccgcctcctctagagacacgctgagcgggctggcaaggcgcatagnnnnn

SEQ ID NO: 86374 - DNA, 170 bp, Homo sapiens
  misc_feature: GYAE6OF01BAW58.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcatagcgtactctgagcgggctggcaaggcgcatagnn

SEQ ID NO: 86375 - DNA, 178 bp, Homo sapiens
  misc_feature: GYAE6OF01DXNGZ.1.89.I01.1.454.CMB.1.raw
  modified_base (171)..(178): a, c, t, g, unknown or other
  misc_feature (171)..(178): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccgccctcctccgtgtctgatctgagcgggctggcaaggcgcatagnnnnnnnn

SEQ ID NO: 86376 - DNA, 230 bp, Homo sapiens
  misc_feature: GYAE6OF01BT6SF.1.89.I01.1.454.CMB.1.raw
  modified_base (230)..(230): a, c, t, g, unknown or other
  misc_feature (230)..(230): n is a, c, g, or t
tcagacgagtgcgtcacgaccggtgctcgatttagtatgctagtatggggcccacatgtaccgcgccaaaacaggaagggatgagaccccacctcgcctccaccaagggcccatcggtcttcccctggcgccctgctccaggagcacctccgagagcacagcggccctgggctgcctggtcaaggactacttccacgcactcgtctgagcgggctggcaaggcgcatagn

SEQ ID NO: 86377 - DNA, 177 bp, Homo sapiens
  misc_feature: GYAE6OF01D4XIC.1.89.I01.1.454.CMB.1.raw
  modified_base (168)..(177): a, c, t, g, unknown or other
  misc_feature (168)..(177): n is a, c, g, or t
tcagacgagtgcgtcacgaccggtgctcgatttagtatgctagtatcgcgggggtcttcggagctgggaccaaggtcaccgtcctaggtcagcccaaggccaacccactgtcactctgttcccaccctcctcacgtctactgctgagcgggctggcaaggcgcatagnnnnnnnnnn

SEQ ID NO: 86378 - DNA, 168 bp, Homo sapiens; identical to SEQ ID NO: 86342
  misc_feature: GYAE6OF01C7P2U.1.89.I01.1.454.CMB.1.raw
  modified_base (168)..(168): a, c, t, g, unknown or other
  misc_feature (168)..(168): n is a, c, g, or t

SEQ ID NO: 86379 - DNA, 169 bp, Homo sapiens; identical to SEQ ID NO: 86285
  misc_feature: GYAE6OF01ET86W.1.89.I01.1.454.CMB.1.raw
  modified_base (169)..(169): a, c, t, g, unknown or other
  misc_feature (169)..(169): n is a, c, g, or t

SEQ ID NO: 86380 - DNA, 551 bp, Homo sapiens
  misc_feature: GYAE6OF01ET4OR.1.89.I01.1.454.CMB.1.raw
  modified_base (159)..(159): a, c, t, g, unknown or other
  misc_feature (159)..(159): n is a, c, g, or t
  modified_base (165)..(170): a, c, t, g, unknown or other
  misc_feature (165)..(170): n is a, c, g, or t
  modified_base (174)..(174): a, c, t, g, unknown or other
  misc_feature (174)..(174): n is a, c, g, or t
  modified_base (179)..(180): a, c, t, g, unknown or other
  misc_feature (179)..(180): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
tcagacgagtgcgtcacgaccggtgctcgatttagtatgctagtatcgcgggggtgttcggcggaggaccaaactgaccgtcctaggtcagcccaaggctgccccctggtcactctttcccacctcctcatagcgtactctgagcgggctggcaaggcncatagnnnnnncatncatgnnancgnagctnacngcnctgctnanctgnagcagcngntcatgnctgcngnctgnctgnctgcatcgctgcngctgncgntncgtnagtcagcgtntacgntcgtcgtcggtcncgttacgacgttacgcgtcgtacggtaaccagggttcctacgtcggtaacttaccgtacgtacggtttcacgtttaacgacgtcgtaacgggttacccagttacccgtgtacgtttaacgacgttccgggaacttccgggacttaaaccggtctccgggttaacctgttaaccccggtgttaacccgtcggtaacgttaccgcgttacgtaacgtcgtaccgtaagtcccaaggttccaaggtctaacggcccgttag

SEQ ID NO: 86381 - DNA, 170 bp, Homo sapiens
  misc_feature: GYAE6OF01DN099.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagn

SEQ ID NO: 86382 - DNA, 275 bp, Homo sapiens
  misc_feature: GYAE6OF01CPD4N.1.89.I01.1.454.CMB.1.raw
  modified_base (179)..(179): a, c, t, g, unknown or other
  misc_feature (179)..(179): n is a, c, g, or t
  modified_base (236)..(236): a, c, t, g, unknown or other
  misc_feature (236)..(236): n is a, c, g, or t
  modified_base (242)..(275): a, c, t, g, unknown or other
  misc_feature (242)..(275): n is a, c, g, or t
tcagacgagtgcgtcacgaccggtgctcgatttagtatgctagtatcggcgggaccatctctgggctccaggctgaggacgaggctgattatttctgcagctcatatacaaccagcagcaccaagtcttcggaactgggaccaggtcaccgtcctaggtcagcccaaggcccaaccccntggtcactcctgttcccaccctcctcacgcactcgtctgagcgggctggcaagggcncatagnnnnnnnnnnnnnnnnnnnnnnnnnnnnnnnnnn

SEQ ID NO: 86383 - DNA, 169 bp, Homo sapiens
  misc_feature: GYAE6OF01A34R0.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctctactgctagtctgagcgggctggcaaggcgcatagn

SEQ ID NO: 86384 - DNA, 187 bp, Homo sapiens
  misc_feature: GYAE6OF01A8KYQ.1.89.I01.1.454.CMB.1.raw
  modified_base (187)..(187): a, c, t, g, unknown or other
  misc_feature (187)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagcgggctggcaaggcgcatagn

SEQ ID NO: 86385 - DNA, 170 bp, Homo sapiens; identical to SEQ ID NO: 86344
  misc_feature: GYAE6OF01A1J3D.1.89.I01.1.454.CMB.1.raw
  modified_base (170)..(170): a, c, t, g, unknown or other
  misc_feature (170)..(170): n is a, c, g, or t

SEQ ID NO: 86386 - DNA, 257 bp, Homo sapiens
  misc_feature: GYAE6OF01A42Q3.1.89.I01.1.454.CMB.1.raw
  modified_base (255)..(257): a, c, t, g, unknown or other
  misc_feature (255)..(257): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgccccctcggtcactctgttcccgccatctgaatagcgtactctgagcgggctggcaaggcgcatagnnn

SEQ ID NO: 86387 - DNA, 168 bp, Homo sapiens; identical to SEQ ID NO: 86287
  misc_feature: GYAE6OF01B8EX0.1.89.I01.1.454.CMB.1.raw
  modified_base (168)..(168): a, c, t, g, unknown or other
  misc_feature (168)..(168): n is a, c, g, or t

SEQ ID NO: 86388 - DNA, 170 bp, Homo sapiens
  misc_feature: GYAE6OF01BSJPO.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctcgtactgcgctgagcgggctggcaaggcgcatagnnn

SEQ ID NO: 86389 - DNA, 170 bp, Homo sapiens
  misc_feature: GYAE6OF01A8UCV.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctcgtactgcgctgagcgggctggcaaggcgcatagnn

SEQ ID NO: 86390 - DNA, 168 bp, Homo sapiens; identical to SEQ ID NO: 86282
  misc_feature: GYAE6OF01BLBJ2.1.89.I01.1.454.CMB.1.raw
  modified_base (168)..(168): a, c, t, g, unknown or other
  misc_feature (168)..(168): n is a, c, g, or t

SEQ ID NO: 86391 - DNA, 171 bp, Homo sapiens
  misc_feature: GYAE6OF01DWFO2.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnn

SEQ ID NO: 86392 - DNA, 171 bp, Homo sapiens
  misc_feature: GYAE6OF01DESLR.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcacgtagcgtgctgagcgggctggcaaggcgcatagnn

SEQ ID NO: 86393 - DNA, 169 bp, Homo sapiens; identical to SEQ ID NO: 86383
  misc_feature: GYAE6OF01BA12V.1.89.I01.1.454.CMB.1.raw
  modified_base (169)..(169): a, c, t, g, unknown or other
  misc_feature (169)..(169): n is a, c, g, or t

SEQ ID NO: 86394 - DNA, 211 bp, Homo sapiens
  misc_feature: GYAE6OF01B268Y.1.89.I01.1.454.CMB.1.raw
  modified_base (178)..(211): a, c, t, g, unknown or other
  misc_feature (178)..(211): n is a, c, g, or t
tcagacgagtgcgtcacgaccggtgctcgatttagtatgctagtatcggacggggggtgttcggcggagggaccaaactgtaccgtcctaggtcagcccaaggacgtgccccctcggtcactctgttcccgccctccgtccatagcgtacctctgagcgggctggcaaggcgcatagnnnnnnnnnnnnnnnnnnnnnnnnnnnnnnnnnn

SEQ ID NO: 86395 - DNA, 181 bp, Homo sapiens
  misc_feature: GYAE6OF01BHZYS.1.89.I01.1.454.CMB.1.raw
  modified_base (169)..(181): a, c, t, g, unknown or other
  misc_feature (169)..(181): n is a, c, g, or t
tcagacgagtgcgtcacgaccggtgctcgatttagtatgctagtatcggcgggggtgttcggcggagggaccaaactgaccgtcctaggtcagcccaaggctgcccctcggtcactctgttcccaccctcctcatagcgtactctgagcgggctggcaaggcgcatagnnnnnnnnnnnnn

SEQ ID NO: 86396 - DNA, 168 bp, Homo sapiens
  misc_feature: GYAE6OF01B3KD0.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctgtcgagcgtctgagcgggctggcaaggcgcatagnn

SEQ ID NO: 86397 - DNA, 172 bp, Homo sapiens
  misc_feature: GYAE6OF01AISCE.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcatagcgtactctgagcgggctggcaaggcgcatagnnnn

SEQ ID NO: 86398 - DNA, 181 bp, Homo sapiens
  misc_feature: GYAE6OF01E326B.1.89.I01.1.454.CMB.1.raw
  modified_base (171)..(181): a, c, t, g, unknown or other
  misc_feature (171)..(181): n is a, c, g, or t
tcagacgagtgcgtcacgaccggtgctcgatttagtatgctagtatcgcgggggggtgttcggtggagggaccaaactgaccgtcctaggtcagcccaaggctgccccctcggtcactctgttcccgccatctgaatagcgtactctgagcgggctggcaaggcgcatagnnnnnnnnnnn

SEQ ID NO: 86399 - DNA, 169 bp, Homo sapiens; identical to SEQ ID NO: 86346
  misc_feature: GYAE6OF01BLRNX.1.89.I01.1.454.CMB.1.raw
  modified_base (169)..(169): a, c, t, g, unknown or other
  misc_feature (169)..(169): n is a, c, g, or t

SEQ ID NO: 86400 - DNA, 169 bp, Homo sapiens
  misc_feature: GYAE6OF01DQQNM.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctcgtagcactctgagcgggctggcaaggcgcatagn

SEQ ID NO: 86401 - DNA, 189 bp, Homo sapiens
  misc_feature: GYAE6OF01D7FAL.1.89.I01.1.454.CMB.1.raw
  modified_base (168)..(189): a, c, t, g, unknown or other
  misc_feature (168)..(189): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcatagcgtactctgagcgggctggcaaggcgcatagnnnnnnnnnnnnnnnnnnnnnn

SEQ ID NO: 86402 - DNA, 192 bp, Homo sapiens
  misc_feature: GYAE6OF01D2671.1.89.I01.1.454.CMB.1.raw
  modified_base (171)..(192): a, c, t, g, unknown or other
  misc_feature (171)..(192): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctcatagcgtactctgagcgggctggcaaggcgcatagnnnnnnnnnnnnnnnnnnnnnn

SEQ ID NO: 86403 - DNA, 168 bp, Homo sapiens
  misc_feature: GYAE6OF01APL4Y.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctcgtactgcgctgagcgggctggcaaggcgcatagn

SEQ ID NO: 86404 - DNA, 170 bp, Homo sapiens
  misc_feature: GYAE6OF01CXE50.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagn

SEQ ID NO: 86405 - DNA, 183 bp, Homo sapiens
  misc_feature: GYAE6OF01DO2HE.1.89.I01.1.454.CMB.1.raw
  modified_base (171)..(183): a, c, t, g, unknown or other
  misc_feature (171)..(183): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctctactgctagtctgagcgggctggcaaggcgcatagnnnnnnnnnnnnn

SEQ ID NO: 86406 - DNA, 169 bp, Homo sapiens; identical to SEQ ID NO: 86285
  misc_feature: GYAE6OF01DMP8Z.1.89.I01.1.454.CMB.1.raw
  modified_base (169)..(169): a, c, t, g, unknown or other
  misc_feature (169)..(169): n is a, c, g, or t

SEQ ID NO: 86407 - DNA, 187 bp, Homo sapiens; identical to SEQ ID NO: 86384
  misc_feature: GYAE6OF01D1DX1.1.89.I01.1.454.CMB.1.raw
  modified_base (187)..(187): a, c, t, g, unknown or other
  misc_feature (187)..(187): n is a, c, g, or t

SEQ ID NO: 86408 - DNA, 170 bp, Homo sapiens
  misc_feature: GYAE6OF01BJWYB.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccacccctcctctactgctagtctgagcgggctggcaaggcgcatagn

SEQ ID NO: 86409 - DNA, 169 bp, Homo sapiens
  misc_feature: GYAE6OF01D0AEW.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcatagcgtactctgagcgggctggcaaggcgcatagn

SEQ ID NO: 86410 - DNA, 190 bp, Homo sapiens
  misc_feature: GYAE6OF01DMC3G.1.89.I01.1.454.CMB.1.raw
  modified_base (171)..(190): a, c, t, g, unknown or other
  misc_feature (171)..(190): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctggttcccaccctcctctactgctagtctgagcgggctggcaaggcgcatagnnnnnnnnnnnnnnnnnnnn

SEQ ID NO: 86411 - DNA, 165 bp, Homo sapiens
  misc_feature: GYAE6OF01DI6W6.1.89.I01.1.454.CMB.1.raw
tcagacgagtgcgtcacgaccggtgctcgatttagtatgctagtatcgcggggtgttcggcggagggaccaactgaccgtcctaggtcagcccaaggctgcccctcggtcactctgttcccaccctcctcacgtctactgctgagcgggctggcaaggcgcatag

SEQ ID NO: 86412 - DNA, 216 bp, Homo sapiens
  misc_feature: GYAE6OF01AOF6T.1.89.I01.1.454.CMB.1.raw
  modified_base (179)..(216): a, c, t, g, unknown or other
  misc_feature (179)..(216): n is a, c, g, or t
tcagacgagtgcgtcacgaccggtgctcgatttagtatgctagtatcggtcggggggtgttcggcggagggaccaaacctgaccgtccgtaggtaagcccaaggctggccccctcggtcacgtcctgttcccgcctcctcacggtagcgtgctgagcgggctggccaaggcgcaatagnnnnnnnnnnnnnnnnnnnnnnnnnnnnnnnnnnnnnn

SEQ ID NO: 86413 - DNA, 167 bp, Homo sapiens
  misc_feature: GYAE6OF01B8487.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctcgtactgcctgagcgggctggcaaggcgcatagn

SEQ ID NO: 86414 - DNA, 224 bp, Homo sapiens
  misc_feature: GYAE6OF01A46HG.1.89.I01.1.454.CMB.1.raw
  modified_base (224)..(224): a, c, t, g, unknown or other
  misc_feature (224)..(224): n is a, c, g, or t
tcagacgagtgcgtcacgaccggtgctcgatttagtatgctagtatcgcggggcccaggcagatgatgaatctaattattactgtttgctttatttgatagtggctgggtgttcggcggcgggaccaagctgaccgtcctaggtcagcccaaggctgtcccctcggtcactctgttcccaccctcctctatacgatcgctgagcgggctggcaaggcgcatagn

SEQ ID NO: 86415 - DNA, 187 bp, Homo sapiens
  misc_feature: GYAE6OF01DMMID.1.89.I01.1.454.CMB.1.raw
  modified_base (172)..(187): a, c, t, g, unknown or other
  misc_feature (172)..(187): n is a, c, g, or t
tcagacgagtgcgtcacgaccggtgctcgatttagtatgctagtatcgcgggggggtgttcggcggagggaccaaactgaccgtcctaggtcagcccaaggcctgccccctcggtcactctgttcccaccctcctcatagcgtactctgagcgggctggcaaggcgcatagnnnnnnnnnnnnnnnn

SEQ ID NO: 86416 - DNA, 178 bp, Homo sapiens
  misc_feature: GYAE6OF01BEM30.1.89.I01.1.454.CMB.1.raw
  modified_base (167)..(178): a, c, t, g, unknown or other
  misc_feature (167)..(178): n is a, c, g, or t
tcagacgagtgcgtcacgaccggtgctcgatttagtatgctagtatcggcgggggtgttcggcggaggaccaaactgaccgtcctaggtcagcccaaggctgcccctcggtcactctgttcccaccctcctccgtgtctgatctgagcggctggcaaggcgcatagnnnnnnnnnnnn

SEQ ID NO: 86417 - DNA, 170 bp, Homo sapiens
  misc_feature: GYAE6OF01BJJ4P.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagn

SEQ ID NO: 86418 - DNA, 171 bp, Homo sapiens
  misc_feature: GYAE6OF01A3E79.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagnn

SEQ ID NO: 86419 - DNA, 170 bp, Homo sapiens; identical to SEQ ID NO: 86344
  misc_feature: GYAE6OF01EELKR.1.89.I01.1.454.CMB.1.raw
  modified_base (170)..(170): a, c, t, g, unknown or other
  misc_feature (170)..(170): n is a, c, g, or t

SEQ ID NO: 86420 - DNA, 169 bp, Homo sapiens
  misc_feature: GYAE6OF01DABW0.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtaagcccaaggctgcccctcggtcactctgttcccaccctcctcacgtagcgtgctgagcgggctggcaaggcgcatagn

SEQ ID NO: 86421 - DNA, 181 bp, Homo sapiens
  misc_feature: GYAE6OF01CYGKG.1.89.I01.1.454.CMB.1.raw
  modified_base (171)..(181): a, c, t, g, unknown or other
  misc_feature (171)..(181): n is a, c, g, or t
tcagacgagtgcgtcacgaccggtgctcgatttagtatgctagtatcggcgggggtgttcggcggagggaccaaactgaccgtcctaggtcagcccaaggcctgccccctcggtcactctgttcccgccctcctcacgtctactgctgagcgggctggcaaggcgcatagnnnnnnnnnnn

SEQ ID NO: 86422 - DNA, 170 bp, Homo sapiens; identical to SEQ ID NO: 86404
  misc_feature: GYAE6OF01B4FXW.1.89.I01.1.454.CMB.1.raw
  modified_base (170)..(170): a, c, t, g, unknown or other
  misc_feature (170)..(170): n is a, c, g, or t

SEQ ID NO: 86423 - DNA, 236 bp, Homo sapiens
  misc_feature: GYAE6OF01CK47K.1.89.I01.1.454.CMB.1.raw
  modified_base (192)..(236): a, c, t, g, unknown or other
  misc_feature (192)..(236): n is a, c, g, or t
tcagacgagtgcgtcacgaccggtgctcgatttagtatgctagtatggggatgacagcctgaggtcgcccttatgtcttcggaactgggaccaaggtcaccgtcctaggtcagcccaaggccaaccccactgtcactctgttcccaccctcctcttctctcgactctgagcgggctggcaaggcgcataggnnnnnnnnnnnnnnnnnnnnnnnnnnnnnnnnnnnnnnnnnnnnn

SEQ ID NO: 86424 - DNA, 168 bp, Homo sapiens
  misc_feature: GYAE6OF01BOL8K.1.89.I01.1.454.CMB.1.raw
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctctactgctagtctgagcgggctggcaaggcgcatag

SEQ ID NO: 86425 - DNA, 170 bp, Homo sapiens
  misc_feature: GYAE6OF01AN30C.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcctacagtgctctgagcgggctggcaaggcgcatagn

SEQ ID NO: 86426 - DNA, 171 bp, Homo sapiens
  misc_feature: GYAE6OF01CDUBV.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctcgtagcactctgagcgggctggcaaggcgcatagnn

SEQ ID NO: 86427 - DNA, 168 bp, Homo sapiens
  misc_feature: GYAE6OF01CO5YQ.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctcgtactgcgctgagcgggctggcaaggcgcatagn

SEQ ID NO: 86428 - DNA, 169 bp, Homo sapiens; identical to SEQ ID NO: 86337
  misc_feature: GYAE6OF01C5F4Q.1.89.I01.1.454.CMB.1.raw
  modified_base (168)..(169): a, c, t, g, unknown or other
  misc_feature (168)..(169): n is a, c, g, or t

SEQ ID NO: 86429 - DNA, 170 bp, Homo sapiens
  misc_feature: GYAE6OF01A1V5J.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcgagtgcgtctctgagcgggctggcaaggcgcatagn

SEQ ID NO: 86430 - DNA, 169 bp, Homo sapiens
  misc_feature: GYAE6OF01D208W.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcgggctggcaaggcgcatagn

SEQ ID NO: 86431 - DNA, 218 bp, Homo sapiens
  misc_feature: GYAE6OF01E0TQJ.1.89.I01.1.454.CMB.1.raw
  modified_base (217)..(218): a, c, t, g, unknown or other
  misc_feature (217)..(218): n is a, c, g, or t
tcagacgagtgcgtcacgaccggtgctcgatttagtatgctagtatcgcgggacgaggccgattattactgcgggacctgggataccagtctgagttctgtggtgttcggcggagggaccaagctgaccgtcgcaggtcagcccaagtctgcccctcggtcactctgttcccgccctcctctagagacacgctgagcgggctggcaaggcgcatagnn

SEQ ID NO: 86432 - DNA, 169 bp, Homo sapiens; identical to SEQ ID NO: 86285
  misc_feature: GYAE6OF01EYL0P.1.89.I01.1.454.CMB.1.raw
  modified_base (169)..(169): a, c, t, g, unknown or other
  misc_feature (169)..(169): n is a, c, g, or t

SEQ ID NO: 86433 - DNA, 170 bp, Homo sapiens
  misc_feature: GYAE6OF01DMUZY.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagn

SEQ ID NO: 86434 - DNA, 270 bp, Homo sapiens
  misc_feature: GYAE6OF01D9FO1.1.89.I01.1.454.CMB.1.raw
  modified_base (232)..(270): a, c, t, g, unknown or other
  misc_feature (232)..(270): n is a, c, g, or t
tcagacgagtgcgtcacgaccggtgctcgatttagtatgctagtatcggcggggcccaggcagatgatgagtctacttactattgtgtcctttacttgcgtgatggcattttggctgttcggcggagggaccaaagtgaccgtcctgggtcaggcccaaggctggccccctcggtcactctgttcccaccctcctctgtcgagcgtctgagcgggctggcaaggcgcatagnnnnnnnnnnnnnnnnnnnnnnnnnnnnnnnnnnnnnnn

SEQ ID NO: 86435 - DNA, 220 bp, Homo sapiens
  misc_feature: GYAE6OF01A90GC.1.89.I01.1.454.CMB.1.raw
  modified_base (219)..(220): a, c, t, g, unknown or other
  misc_feature (219)..(220): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccaccctcctctagagacacgctgagcgggctggcaaggcgcatagnn

SEQ ID NO: 86436 - DNA, 168 bp, Homo sapiens; identical to SEQ ID NO: 86396
  misc_feature: GYAE6OF01CAM8E.1.89.I01.1.454.CMB.1.raw
  modified_base (167)..(168): a, c, t, g, unknown or other
  misc_feature (167)..(168): n is a, c, g, or t

SEQ ID NO: 86437 - DNA, 168 bp, Homo sapiens
  misc_feature: GYAE6OF01AI7YS.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgcctcctctactgctagtctgagcgggctggcaaggcgcatagn

SEQ ID NO: 86438 - DNA, 170 bp, Homo sapiens; identical to SEQ ID NO: 86316
  misc_feature: GYAE6OF01CHSTM.1.89.I01.1.454.CMB.1.raw
  modified_base (170)..(170): a, c, t, g, unknown or other
  misc_feature (170)..(170): n is a, c, g, or t

SEQ ID NO: 86439 - DNA, 169 bp, Homo sapiens
  misc_feature: GYAE6OF01CA9Q2.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctagagacacgctgagcgggctggcaaggcgcatagn

SEQ ID NO: 86440 - DNA, 170 bp, Homo sapiens
  misc_feature: GYAE6OF01B2ZTK.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcgggatgggttttggcggagggaccaagctgaccgtcctaggtcagcccaaggctgcccctcggtcactctgttcccaccctcctcctacagtgctctgagcgggctggcaaggcgcatagn

SEQ ID NO: 86441 - DNA, 171 bp, Homo sapiens
  misc_feature: GYAE6OF01A9CWX.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctgtcgagcgtctgagcgggctggcaaggcgcatagnn

SEQ ID NO: 86442 - DNA, 195 bp, Homo sapiens
  misc_feature: GYAE6OF01DK2OM.1.89.I01.1.454.CMB.1.raw
  modified_base (172)..(195): a, c, t, g, unknown or other
  misc_feature (172)..(195): n is a, c, g, or t
tcagacgagtgcgtcacgaccggtgctcgatttagtatgctagtatcggcggggggtgttcggcggagggaccaaactgaccgtcctaggtcagcccaaggcctgccccctcggtcactctgttcccaccctcctctacctgctagtctgagcggctggcaaggcgcatagnnnnnnnnnnnnnnnnnnnnnnnn

SEQ ID NO: 86443 - DNA, 170 bp, Homo sapiens; identical to SEQ ID NO: 86374
  misc_feature: GYAE6OF01D5QZ4.1.89.I01.1.454.CMB.1.raw
  modified_base (169)..(170): a, c, t, g, unknown or other
  misc_feature (169)..(170): n is a, c, g, or t

SEQ ID NO: 86444 - DNA, 167 bp, Homo sapiens
  misc_feature: GYAE6OF01BBN5S.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtcttcggagctgggaccaaggtcaccgtcctaggtcagcccaaggccaacccactgtcactctgttcccaccctcctcacgtctactgctgagcgggctggcaaggcgcatagn

SEQ ID NO: 86445 - DNA, 169 bp, Homo sapiens
  misc_feature: GYAE6OF01CWVTK.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcatagcgtactctgagcgggctggcaaggcgcatagn

SEQ ID NO: 86446 - DNA, 169 bp, Homo sapiens
  misc_feature: GYAE6OF01DURJ7.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagagaccaaactgaccgtcctaggtcagcccaaggctgccccctcggtcactctgttcccaccctcctctactgctagtctgagcgggctggcaaggcgcatagn

SEQ ID NO: 86447 - DNA, 170 bp, Homo sapiens; identical to SEQ ID NO: 86404
  misc_feature: GYAE6OF01EMR10.1.89.I01.1.454.CMB.1.raw
  modified_base (170)..(170): a, c, t, g, unknown or other
  misc_feature (170)..(170): n is a, c, g, or t

SEQ ID NO: 86448 - DNA, 187 bp, Homo sapiens
  misc_feature: GYAE6OF01A6YXR.1.89.I01.1.454.CMB.1.raw
  modified_base (170)..(187): a, c, t, g, unknown or other
  misc_feature (170)..(187): n is a, c, g, or t
tcagacgagtgcgtcacgaccggtgctcgatttagtatgctagtagtcgcgggggttgttcggcggagggaccaaactgacccgtcctaggtcagcccaaggctgccccctcggtcactctgttcccgcccctcatagcgtactctgagcgggctggcaaggcgcatagnnnnnnnnnnnnnnnnnn

SEQ ID NO: 86449 - DNA, 169 bp, Homo sapiens
  misc_feature: GYAE6OF01C13TO.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcctacagtgctctgagcgggctggcaaggcgcatagn

SEQ ID NO: 86450 - DNA, 170 bp, Homo sapiens; identical to SEQ ID NO: 86404
  misc_feature: GYAE6OF01CX4JS.1.89.I01.1.454.CMB.1.raw
  modified_base (170)..(170): a, c, t, g, unknown or other
  misc_feature (170)..(170): n is a, c, g, or t

SEQ ID NO: 86451 - DNA, 169 bp, Homo sapiens
  misc_feature: GYAE6OF01BCDVI.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcacgtctactgctgagcgggctggcaaggcgcatagnn

SEQ ID NO: 86452 - DNA, 170 bp, Homo sapiens
  misc_feature: GYAE6OF01EIMLR.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctgtcgagcgtctgagcgggctggcaaggcgcatagn

SEQ ID NO: 86453 - DNA, 188 bp, Homo sapiens; identical to SEQ ID NO: 86367
  misc_feature: GYAE6OF01CNI6X.1.89.I01.1.454.CMB.1.raw
  modified_base (187)..(188): a, c, t, g, unknown or other
  misc_feature (187)..(188): n is a, c, g, or t

SEQ ID NO: 86454 - DNA, 213 bp, Homo sapiens
  misc_feature: GYAE6OF01A9KAN.1.89.I01.1.454.CMB.1.raw
  modified_base (191)..(213): a, c, t, g, unknown or other
  misc_feature (191)..(213): n is a, c, g, or t
tcagacgagtgcgtcacgaccggtgctcgatttagtatgctagtatgggagtgacagccctgagtgcccttatgtcttcggaactgggaccaaggtcacccgtcctaggtcagcccaagggccaaccccactgtcactctgttcccaccctcctctctctcgactctgagcgggctggcaaggcgcatagnnnnnnnnnnnnnnnnnnnnnnn

SEQ ID NO: 86455 - DNA, 169 bp, Homo sapiens; identical to SEQ ID NO: 86383
  misc_feature: GYAE6OF01AV6ER.1.89.I01.1.454.CMB.1.raw
  modified_base (169)..(169): a, c, t, g, unknown or other
  misc_feature (169)..(169): n is a, c, g, or t

SEQ ID NO: 86456 - DNA, 168 bp, Homo sapiens; identical to SEQ ID NO: 86287
  misc_feature: GYAE6OF01B2BZD.1.89.I01.1.454.CMB.1.raw
  modified_base (168)..(168): a, c, t, g, unknown or other
  misc_feature (168)..(168): n is a, c, g, or t

SEQ ID NO: 86457 - DNA, 189 bp, Homo sapiens
  misc_feature: GYAE6OF01EI57X.1.89.I01.1.454.CMB.1.raw
  modified_base (187)..(189): a, c, t, g, unknown or other
  misc_feature (187)..(189): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctctctctcgactctgagcgggctggcaaggcgcatagnnn

SEQ ID NO: 86458 - DNA, 171 bp, Homo sapiens
  misc_feature: GYAE6OF01BI3MR.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcgggctggcaaggcgcatagnnn

SEQ ID NO: 86459 - DNA, 171 bp, Homo sapiens; identical to SEQ ID NO: 86441
  misc_feature: GYAE6OF01CWLCV.1.89.I01.1.454.CMB.1.raw
  modified_base (170)..(171): a, c, t, g, unknown or other
  misc_feature (170)..(171): n is a, c, g, or t

SEQ ID NO: 86460 - DNA, 217 bp, Homo sapiens
  misc_feature: GYAE6OF01D36CG.1.89.I01.1.454.CMB.1.raw
  modified_base (167)..(217): a, c, t, g, unknown or other
  misc_feature (167)..(217): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctagtctgagcggctggcaaggcgcatagnnnnnnnnnnnnnnnnnnnnnnnnnnnnnnnnnnnnnnnnnnnnnnnnnnn

SEQ ID NO: 86461 - DNA, 170 bp, Homo sapiens
  misc_feature: GYAE6OF01DHF4A.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctccgtgtctgatctgagcgggctggcaaggcgcatagn

SEQ ID NO: 86462 - DNA, 170 bp, Homo sapiens; identical to SEQ ID NO: 86361
  misc_feature: GYAE6OF01C4TOJ.1.89.I01.1.454.CMB.1.raw
  modified_base (170)..(170): a, c, t, g, unknown or other
  misc_feature (170)..(170): n is a, c, g, or t

SEQ ID NO: 86463 - DNA, 167 bp, Homo sapiens
  misc_feature: GYAE6OF01BOAJL.1.89.I01.1.454.CMB.1.raw
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcatagcgtactctgagcgggctggcaaggcgcatag

SEQ ID NO: 86464 - DNA, 170 bp, Homo sapiens; identical to SEQ ID NO: 86452
  misc_feature: GYAE6OF01AYTY1.1.89.I01.1.454.CMB.1.raw
  modified_base (170)..(170): a, c, t, g, unknown or other
  misc_feature (170)..(170): n is a, c, g, or t

SEQ ID NO: 86465 - DNA, 170 bp, Homo sapiens
  misc_feature: GYAE6OF01BZD73.1.89.I01.1.454.CMB.1.raw
  modified_base (167)..(170): a, c, t, g, unknown or other
  misc_feature (167)..(170): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctactgctagtctgagcgggctggcaaggcgcatagnnnn

SEQ ID NO: 86466 - DNA, 170 bp, Homo sapiens
  misc_feature: GYAE6OF01EAMLJ.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcgggggaatgttcggcgggggaccaagctgaccgtcttaggtcagcccaaggctgccccctcggtcactctgttcccaccctcctctgtcgagcgtctgagcgggctggcaaggcgcatagn

SEQ ID NO: 86467 - DNA, 170 bp, Homo sapiens; identical to SEQ ID NO: 86404
  misc_feature: GYAE6OF01EFOK5.1.89.I01.1.454.CMB.1.raw
  modified_base (170)..(170): a, c, t, g, unknown or other
  misc_feature (170)..(170): n is a, c, g, or t

SEQ ID NO: 86468 - DNA, 168 bp, Homo sapiens; identical to SEQ ID NO: 86282
  misc_feature: GYAE6OF01EDV42.1.89.I01.1.454.CMB.1.raw
  modified_base (168)..(168): a, c, t, g, unknown or other
  misc_feature (168)..(168): n is a, c, g, or t

SEQ ID NO: 86469 - DNA, 172 bp, Homo sapiens
  misc_feature: GYAE6OF01BUI80.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtaagcccaaggctgccccctcggtcactctgttcccaccctcctcacgtagcgtgctgagcgggctggcaaggcgcatagnnn

SEQ ID NO: 86470 - DNA, 169 bp, Homo sapiens
  misc_feature: GYAE6OF01CFCEJ.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctatgctgagcgggctggcaaggcgcatagnn

SEQ ID NO: 86471 - DNA, 168 bp, Homo sapiens
  misc_feature: GYAE6OF01BBU62.1.89.I01.1.454.CMB.1.raw
  modified_base (166)..(168): a, c, t, g, unknown or other
  misc_feature (166)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctactgctagtctgagcggctggcaaggcgcatagnnn

SEQ ID NO: 86472 - DNA, 208 bp, Homo sapiens
  misc_feature: GYAE6OF01B825G.1.89.I01.1.454.CMB.1.raw
  modified_base (169)..(208): a, c, t, g, unknown or other
  misc_feature (169)..(208): n is a, c, g, or t
tcagacgagtgcgtcacgaccggtgctcgatttagtatgctagtatcgcgggggtgttacgggcggagggaccaaactgaccgtcctaggtcagcccaaggctgcccctggtcactctgttcccgcctcctcacgcgactcgtctgagcgggctggcaaggcgcatagnnnnnnnnnnnnnnnnnnnnnnnnnnnnnnnnnnnnnnnn

SEQ ID NO: 86473 - DNA, 256 bp, Homo sapiens
  misc_feature: GYAE6OF01ENQ1E.1.89.I01.1.454.CMB.1.raw
  modified_base (254)..(256): a, c, t, g, unknown or other
  misc_feature (254)..(256): n is a, c, g, or t
tcagacgagtgcgtcacgaccggtgctcgatttagtatgctagtatcgcgggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgccccctcggtcactctgttcccgccatctgaatagcgtactctgagcgggctggcaaggcgcatagnnn

SEQ ID NO: 86474 - DNA, 170 bp, Homo sapiens; identical to SEQ ID NO: 86466
  misc_feature: GYAE6OF01BJGDF.1.89.I01.1.454.CMB.1.raw
  modified_base (170)..(170): a, c, t, g, unknown or other
  misc_feature (170)..(170): n is a, c, g, or t

SEQ ID NO: 86475 - DNA, 169 bp, Homo sapiens
  misc_feature: GYAE6OF01BN7OQ.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcggcgggggtgttcggcggagggaccaaactgaccgtcctaggtcagcccaaggctgcccctcggtcactctgttcccaccctcctctgtcgagcgtctgagcgggctggcaaggcgcatagn

SEQ ID NO: 86476 - DNA, 192 bp, Homo sapiens
  misc_feature: GYAE6OF01BOW8X.1.89.I01.1.454.CMB.1.raw
  modified_base (172)..(192): a, c, t, g, unknown or other
  misc_feature (172)..(192): n is a, c, g, or t
tcagacgagtgcgtcacgaccggtgctcgatttagtatgctagtatcgcgggggtgttcggtcggagggaccaaactgtaccgtcctaggtcagcccaaggctgccccctcggtcactctgttcccgcccgtcctcacgtagcgtgctgagcgggctggcaaggcgcatagnnnnnnnnnnnnnnnnnnnnn

SEQ ID NO: 86477 - DNA, 170 bp, Homo sapiens; identical to SEQ ID NO: 86374
  misc_feature: GYAE6OF01EYG96.1.89.I01.1.454.CMB.1.raw
  modified_base (169)..(170): a, c, t, g, unknown or other
  misc_feature (169)..(170): n is a, c, g, or t

SEQ ID NO: 86478 - DNA, 167 bp, Homo sapiens; identical to SEQ ID NO: 86274
  misc_feature: GYAE6OF01BOHGZ.1.89.I01.1.454.CMB.1.raw
  modified_base (167)..(167): a, c, t, g, unknown or other
  misc_feature (167)..(167): n is a, c, g, or t

SEQ ID NO: 86479 - DNA, 170 bp, Homo sapiens
  misc_feature: GYAE6OF01E52WF.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctccgtgtctgatctgagcgggctggcaaggcgcatagnn

SEQ ID NO: 86480 - DNA, 168 bp, Homo sapiens
  misc_feature: GYAE6OF01AF1PU.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgtcctcctcatagcgtactctgagcgggctggcaaggcgcatagn

SEQ ID NO: 86481 - DNA, 187 bp, Homo sapiens
  misc_feature: GYAE6OF01DC4H2.1.89.I01.1.454.CMB.1.raw
  modified_base (186)..(187): a, c, t, g, unknown or other
  misc_feature (186)..(187): n is a, c, g, or t
tcagacgagtgcgtcacgaccggtgctcgatttagtatgctagtatgggatggccacctgagtggtctttgggtgttcggcgggggaccaagctgaccgtcctaggtcagcccaaggctgccccctcggtcactctgttccgccatctgatctctcgactctgagcgggctggcaaggcgcatagnn

SEQ ID NO: 86482 - DNA, 191 bp, Homo sapiens
  misc_feature: GYAE6OF01CU9NI.1.89.I01.1.454.CMB.1.raw
  modified_base (187)..(191): a, c, t, g, unknown or other
  misc_feature (187)..(191): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctctctctcgactctgagcgggctggcaaggcgcatagnnnnn

SEQ ID NO: 86483 - DNA, 171 bp, Homo sapiens; identical to SEQ ID NO: 86391
  misc_feature: GYAE6OF01C6669.1.89.I01.1.454.CMB.1.raw
  modified_base (170)..(171): a, c, t, g, unknown or other
  misc_feature (170)..(171): n is a, c, g, or t

SEQ ID NO: 86484 - DNA, 170 bp, Homo sapiens; identical to SEQ ID NO: 86433
  misc_feature: GYAE6OF01AHZLW.1.89.I01.1.454.CMB.1.raw
  modified_base (170)..(170): a, c, t, g, unknown or other
  misc_feature (170)..(170): n is a, c, g, or t

SEQ ID NO: 86485 - DNA, 170 bp, Homo sapiens
  misc_feature: GYAE6OF01BWJO2.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcatagcgtactctgagcgggctggcaaggcgcatagnnn

SEQ ID NO: 86486 - DNA, 167 bp, Homo sapiens
  misc_feature: GYAE6OF01DKVUY.1.89.I01.1.454.CMB.1.raw
  modified_base (166)..(167): a, c, t, g, unknown or other
  misc_feature (166)..(167): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcgccctcctcacgtagcgtgctgagcgggctggcaaggcgcatagnn

SEQ ID NO: 86487 - DNA, 170 bp, Homo sapiens; identical to SEQ ID NO: 86404
  misc_feature: GYAE6OF01D95ES.1.89.I01.1.454.CMB.1.raw
  modified_base (170)..(170): a, c, t, g, unknown or other
  misc_feature (170)..(170): n is a, c, g, or t

SEQ ID NO: 86488 - DNA, 178 bp, Homo sapiens
  misc_feature: GYAE6OF01BW2VQ.1.89.I01.1.454.CMB.1.raw
  modified_base (170)..(178): a, c, t, g, unknown or other
  misc_feature (170)..(178): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagnnnnnnnnn

SEQ ID NO: 86489 - DNA, 170 bp, Homo sapiens; identical to SEQ ID NO: 86404
  misc_feature: GYAE6OF01D65B1.1.89.I01.1.454.CMB.1.raw
  modified_base (170)..(170): a, c, t, g, unknown or other
  misc_feature (170)..(170): n is a, c, g, or t

SEQ ID NO: 86490 - DNA, 170 bp, Homo sapiens; identical to SEQ ID NO: 86461
  misc_feature: GYAE6OF01CFXZ4.1.89.I01.1.454.CMB.1.raw
  modified_base (170)..(170): a, c, t, g, unknown or other
  misc_feature (170)..(170): n is a, c, g, or t

SEQ ID NO: 86491 - DNA, 187 bp, Homo sapiens
  misc_feature: GYAE6OF01B8U1J.1.89.I01.1.454.CMB.1.raw
  modified_base (171)..(187): a, c, t, g, unknown or other
  misc_feature (171)..(187): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccgccctcctctcgtactgcgctgagcgggctggcaaggcgcatagnnnnnnnnnnnnnnnnn

SEQ ID NO: 86492 - DNA, 176 bp, Homo sapiens
  misc_feature: GYAE6OF01AVZ9E.1.89.I01.1.454.CMB.1.raw
  modified_base (169)..(176): a, c, t, g, unknown or other
  misc_feature (169)..(176): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagnnnnnnnn

SEQ ID NO: 86493 - DNA, 171 bp, Homo sapiens
  misc_feature: GYAE6OF01BLF2U.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnn

SEQ ID NO: 86494 - DNA, 187 bp, Homo sapiens
  misc_feature: GYAE6OF01EMFXZ.1.89.I01.1.454.CMB.1.raw
  modified_base (186)..(187): a, c, t, g, unknown or other
  misc_feature (186)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaacccactgtcactctgttcccgccctcctctctctcgactctgagcgggctggcaaggcgcatagnn

SEQ ID NO: 86495 - DNA, 188 bp, Homo sapiens
  misc_feature: GYAE6OF01A8ZNU.1.89.I01.1.454.CMB.1.raw
  modified_base (168)..(188): a, c, t, g, unknown or other
  misc_feature (168)..(188): n is a, c, g, or t
tcagacgagtgcgtcacgaccggtgctcgatttagtatgctagtatcgcgggtgttcggcggagggaccaagctgaccgtcctaggtcagcccaaggcttgccccctcggtcactctgttcccgccatctgactcgtctctactgagcgggctggcaaggcgcatagnnnnnnnnnnnnnnnnnnnnn

SEQ ID NO: 86496 - DNA, 170 bp, Homo sapiens; identical to SEQ ID NO: 86404
  misc_feature: GYAE6OF01ES92C.1.89.I01.1.454.CMB.1.raw
  modified_base (170)..(170): a, c, t, g, unknown or other
  misc_feature (170)..(170): n is a, c, g, or t

SEQ ID NO: 86497 - DNA, 170 bp, Homo sapiens
  misc_feature: GYAE6OF01AJW87.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctcgtactgcgctgagcgggctggcaaggcgcatagn

SEQ ID NO: 86498 - DNA, 169 bp, Homo sapiens; identical to SEQ ID NO: 86383
  misc_feature: GYAE6OF01C3AJI.1.89.I01.1.454.CMB.1.raw
  modified_base (169)..(169): a, c, t, g, unknown or other
  misc_feature (169)..(169): n is a, c, g, or t

SEQ ID NO: 86499 - DNA, 169 bp, Homo sapiens; identical to SEQ ID NO: 86445
  misc_feature: GYAE6OF01BS55T.1.89.I01.1.454.CMB.1.raw
  modified_base (169)..(169): a, c, t, g, unknown or other
  misc_feature (169)..(169): n is a, c, g, or t

SEQ ID NO: 86500 - DNA, 169 bp, Homo sapiens
  misc_feature: GYAE6OF01B4O65.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgccccacggtcactctgttcccgccctcctcacgcactcgtctgagcgggctggcaaggcgcatagnn

SEQ ID NO: 86501 - DNA, 169 bp, Homo sapiens; identical to SEQ ID NO: 86303
  misc_feature: GYAE6OF01CCUKT.1.89.I01.1.454.CMB.1.raw
  modified_base (169)..(169): a, c, t, g, unknown or other
  misc_feature (169)..(169): n is a, c, g, or t

SEQ ID NO: 86502 - DNA, 169 bp, Homo sapiens; identical to SEQ ID NO: 86409
  misc_feature: GYAE6OF01AICE1.1.89.I01.1.454.CMB.1.raw
  modified_base (169)..(169): a, c, t, g, unknown or other
  misc_feature (169)..(169): n is a, c, g, or t

SEQ ID NO: 86503 - DNA, 176 bp, Homo sapiens
  misc_feature: GYAE6OF01BF8Y2.1.89.I01.1.454.CMB.1.raw
  modified_base (170)..(176): a, c, t, g, unknown or other
  misc_feature (170)..(176): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnnnnnnn

SEQ ID NO: 86504 - DNA, 169 bp, Homo sapiens
  misc_feature: GYAE6OF01BQDP3.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttccgccctcctcacgtagcgtgctgagcgggctggcaaggcgcatagn

SEQ ID NO: 86505 - DNA, 179 bp, Homo sapiens
  misc_feature: GYAE6OF01BMNBD.1.89.I01.1.454.CMB.1.raw
  modified_base (168)..(179): a, c, t, g, unknown or other
  misc_feature (168)..(179): n is a, c, g, or t
tcagacgagtgcgtcacgaccggtgctcgatttagtatgctagtatcgcggggtcttcggagctgggaccaaggtcaccgtcctaggtccagcccaaggccaaccccactgtcactctgttcccaccctctcacgtctactgctgagcgggctggcaaggcgcatagnnnnnnnnnnnn

SEQ ID NO: 86506 - DNA, 169 bp, Homo sapiens; identical to SEQ ID NO: 86383
  misc_feature: GYAE6OF01B96RF.1.89.I01.1.454.CMB.1.raw
  modified_base (169)..(169): a, c, t, g, unknown or other
  misc_feature (169)..(169): n is a, c, g, or t

SEQ ID NO: 86507 - DNA, 245 bp, Homo sapiens
  misc_feature: GYAE6OF01BWTEB.1.89.I01.1.454.CMB.1.raw
  modified_base (240)..(245): a, c, t, g, unknown or other
  misc_feature (240)..(245): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccactgtcactctgttcccaccctcctcactcactcgtctgagcgggctggcaaggcgcatagnnnnnn

SEQ ID NO: 86508 - DNA, 173 bp, Homo sapiens
  misc_feature: GYAE6OF01EC2BI.1.89.I01.1.454.CMB.1.raw
  modified_base (168)..(173): a, c, t, g, unknown or other
  misc_feature (168)..(173): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctagtctgagcgggctggcaaggcgcatagnnnnnn

SEQ ID NO: 86509 - DNA, 169 bp, Homo sapiens; identical to SEQ ID NO: 86445
  misc_feature: GYAE6OF01DROL7.1.89.I01.1.454.CMB.1.raw
  modified_base (169)..(169): a, c, t, g, unknown or other
  misc_feature (169)..(169): n is a, c, g, or t

SEQ ID NO: 86510 - DNA, 176 bp, Homo sapiens
  misc_feature: GYAE6OF01CZGKD.1.89.I01.1.454.CMB.1.raw
  modified_base (170)..(176): a, c, t, g, unknown or other
  misc_feature (170)..(176): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctccgtgtctgatctgagcgggctggcaaggcgcatagnnnnnnn

SEQ ID NO: 86511 - DNA, 171 bp, Homo sapiens
  misc_feature: GYAE6OF01EAVAG.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctcatagcgtactctgagcgggctggcaaggcgcatagn

SEQ ID NO: 86512 - DNA, 164 bp, Homo sapiens
  misc_feature: GYAE6OF01ES8IF.1.89.I01.1.454.CMB.1.raw
  modified_base (164)..(164): a, c, t, g, unknown or other
  misc_feature (164)..(164): n is a, c, g, or t
tcagacgagtgcgtcacgaccggtgctcgatttagtatgctagtatcgcgggtgttcggcggaggaccaactgaccgtcctaggtcagcccaaggctgcccctcggtcactctgttcccgccctcctctactgctagtctgagcgggctggcaaggcgcatagn

SEQ ID NO: 86513 - DNA, 170 bp, Homo sapiens; identical to SEQ ID NO: 86417
  misc_feature: GYAE6OF01DOC8S.1.89.I01.1.454.CMB.1.raw
  modified_base (170)..(170): a, c, t, g, unknown or other
  misc_feature (170)..(170): n is a, c, g, or t

SEQ ID NO: 86514 - DNA, 188 bp, Homo sapiens; identical to SEQ ID NO: 86367
  misc_feature: GYAE6OF01BFIB9.1.89.I01.1.454.CMB.1.raw
  modified_base (187)..(188): a, c, t, g, unknown or other
  misc_feature (187)..(188): n is a, c, g, or t

SEQ ID NO: 86515 - DNA, 171 bp, Homo sapiens
  misc_feature: GYAE6OF01CT1D4.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttctcgccctcctctactgctagtctgagcgggctggcaaggcgcatagnn

SEQ ID NO: 86516 - DNA, 219 bp, Homo sapiens
  misc_feature: GYAE6OF01CC3ET.1.89.I01.1.454.CMB.1.raw
  modified_base (218)..(219): a, c, t, g, unknown or other
  misc_feature (218)..(219): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccgcatctgaacgcactcgtctgagcgggctggcaaggcgcatagnn

SEQ ID NO: 86517 - DNA, 185 bp, Homo sapiens
  misc_feature: GYAE6OF01BEC0Y.1.89.I01.1.454.CMB.1.raw
  modified_base (171)..(185): a, c, t, g, unknown or other
  misc_feature (171)..(185): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctcgtactgcgctgagcgggctggcaaggcgcatagnnnnnnnnnnnnnnn

SEQ ID NO: 86518 - DNA, 349 bp, Homo sapiens
  misc_feature: GYAE6OF01A1KXX.1.89.I01.1.454.CMB.1.raw
  modified_base (342)..(349): a, c, t, g, unknown or other
  misc_feature (342)..(349): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctggggcacagcggccctgggctgcctggtcaaggactactcctcgtagcactctgagcgggctggcaaggcgcatagnnnnnnnn

SEQ ID NO: 86519 - DNA, 168 bp, Homo sapiens
  misc_feature: GYAE6OF01AQXOJ.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcggggtcttcggagctgggaccaaggtcaccgtcctaggtaagcccaaggccaaccccactgtcactctgttcccgccctcctcacgtctactgctgagcgggctggcaaggcgcatagn

SEQ ID NO: 86520 - DNA, 218 bp, Homo sapiens
  misc_feature: GYAE6OF01AW6YB.1.89.I01.1.454.CMB.1.raw
  modified_base (56)..(56): a, c, t, g, unknown or other
  misc_feature (56)..(56): n is a, c, g, or t
  modified_base (161)..(161): a, c, t, g, unknown or other
  misc_feature (161)..(161): n is a, c, g, or t
  modified_base (167)..(218): a, c, t, g, unknown or other
  misc_feature (167)..(218): n is a, c, g, or t
tcagacgagtgcgtcacgaccggtgctcgatttagtatgctagtatcgcgggggtnttcggcggagggaccaaactgaccgtcctaggtcagcccaaggctgccccctggtcactctgttcccaccctctctactgctagtctgagcgggctggcaaggcncatagnnnnnnnnnnnnnnnnnnnnnnnnnnnnnnnnnnnnnnnnnnnnnnnnnnnn

SEQ ID NO: 86521 - DNA, 221 bp, Homo sapiens
  misc_feature: GYAE6OF01DS4HY.1.89.I01.1.454.CMB.1.raw
  modified_base (57)..(57): a, c, t, g, unknown or other
  misc_feature (57)..(57): n is a, c, g, or t
  modified_base (162)..(162): a, c, t, g, unknown or other
  misc_feature (162)..(162): n is a, c, g, or t
  modified_base (168)..(221): a, c, t, g, unknown or other
  misc_feature (168)..(221): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttcccaccctcctctactgctagtctgagcggctggcaaggcncatagnnnnnnnnnnnnnnnnnnnnnnnnnnnnnnnnnnnnnnnnnnnnnnnnnnnnnn

SEQ ID NO: 86522 - DNA, 169 bp, Homo sapiens; identical to SEQ ID NO: 86430
  misc_feature: GYAE6OF01A4E1V.1.89.I01.1.454.CMB.1.raw
  modified_base (169)..(169): a, c, t, g, unknown or other
  misc_feature (169)..(169): n is a, c, g, or t

SEQ ID NO: 86523 - DNA, 257 bp, Homo sapiens
  misc_feature: GYAE6OF01AN7JV.1.89.I01.1.454.CMB.1.raw
  modified_base (254)..(257): a, c, t, g, unknown or other
  misc_feature (254)..(257): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgccccctggtcactctgttcccgccatctgaatagcgtactctgagcgggctggcaaggcgcatagnnnn

SEQ ID NO: 86524 - DNA, 174 bp, Homo sapiens
  misc_feature: GYAE6OF01EF72G.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnnn

SEQ ID NO: 86525 - DNA, 171 bp, Homo sapiens
  misc_feature: GYAE6OF01A4SO7.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcacgtagcgtgctgagcgggctggcaaggcgcatagnn

SEQ ID NO: 86526 - DNA, 170 bp, Homo sapiens
  misc_feature: GYAE6OF01BLNO6.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcacgtagcgtgctgagcgggctggcaaggcgcatagnn

SEQ ID NO: 86527 - DNA, 168 bp, Homo sapiens
  misc_feature: GYAE6OF01B190J.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcacgtagcgtgctgagcgggctggcaaggcgcatagn

SEQ ID NO: 86528 - DNA, 171 bp, Homo sapiens; identical to SEQ ID NO: 86391
  misc_feature: GYAE6OF01DMJ99.1.89.I01.1.454.CMB.1.raw
  modified_base (170)..(171): a, c, t, g, unknown or other
  misc_feature (170)..(171): n is a, c, g, or t

SEQ ID NO: 86529 - DNA, 348 bp, Homo sapiens
  misc_feature: GYAE6OF01B4Z6C.1.89.I01.1.454.CMB.1.raw
  modified_base (341)..(348): a, c, t, g, unknown or other
  misc_feature (341)..(348): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcacctcctccaagagcacctctggggcacagcggcctgggctgcctggtcaaggactacttcctctctcgactctgagcgggctggcaaggcgcatagnnnnnnnn

SEQ ID NO: 86530 - DNA, 188 bp, Homo sapiens
  misc_feature: GYAE6OF01CDZZ9.1.89.I01.1.454.CMB.1.raw
  modified_base (170)..(188): a, c, t, g, unknown or other
  misc_feature (170)..(188): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnnnnnnnnnnnnnnnnn

SEQ ID NO: 86531 - DNA, 170 bp, Homo sapiens
  misc_feature: GYAE6OF01D0Q40.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctgtcgagcgtctgagcgggctggcaaggcgcatagn

SEQ ID NO: 86532 - DNA, 342 bp, Homo sapiens
  misc_feature: GYAE6OF01CPJ5N.1.89.I01.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (333)..(342): a, c, t, g, unknown or other
  misc_feature (333)..(342): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctcaccaaggcccatcgtctccccngcaccctctcaagngcacctctggggcacagcggcctgggctgcctggtcaaggactacttccgagtgcgtctctgagcgggctggcaaggcgcatagnnnnnnnnnn

SEQ ID NO: 86533 - DNA, 171 bp, Homo sapiens
  misc_feature: GYAE6OF01BVSUB.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcgggggtgttcggcggagggaccaaactgaccgtcctaggtaagcccaaggctgccccctcggtcactctgttcccgccctcctcacatagcgtgctgagcgggctggcaaggcgcatagnnn

SEQ ID NO: 86534 - DNA, 181 bp, Homo sapiens
  misc_feature: GYAE6OF01BRJ5Q.1.89.I01.1.454.CMB.1.raw
  modified_base (170)..(181): a, c, t, g, unknown or other
  misc_feature (170)..(181): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctccgtgtctgatctgagcgggctggcaaggcgcatagnnnnnnnnnnnn

SEQ ID NO: 86535 - DNA, 175 bp, Homo sapiens
  misc_feature: GYAE6OF01COMZG.1.89.I01.1.454.CMB.1.raw
  modified_base (171)..(175): a, c, t, g, unknown or other
  misc_feature (171)..(175): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctcgtagcactctgagcgggctggcaaggcgcatagnnnnn

SEQ ID NO: 86536 - DNA, 170 bp, Homo sapiens; identical to SEQ ID NO: 86452
  misc_feature: GYAE6OF01BOST8.1.89.I01.1.454.CMB.1.raw
  modified_base (170)..(170): a, c, t, g, unknown or other
  misc_feature (170)..(170): n is a, c, g, or t

SEQ ID NO: 86537 - DNA, 169 bp, Homo sapiens
  misc_feature: GYAE6OF01DSAY1.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtaagcccaaggctgcccctcggtcactctgttcccgccctcctcacgtagcgtgctgagcgggctggcaaggcgcatagn

SEQ ID NO: 86538 - DNA, 192 bp, Homo sapiens
  misc_feature: GYAE6OF01DPO3F.1.89.I01.1.454.CMB.1.raw
  modified_base (191)..(192): a, c, t, g, unknown or other
  misc_feature (191)..(192): n is a, c, g, or t
tcagacgagtgcgtcacgaccggtgctcgatttagtatgctagtaagggaagacaatggagagctctcactgtggtggacgttcggccaagggaccaaggtggaaatcaaacgaactgtggctgcaccatctgtcttcatcttcccaccctcctcacgcactcgtctgagcgggctggcaaggcgcatagnn

SEQ ID NO: 86539 - DNA, 198 bp, Homo sapiens
  misc_feature: GYAE6OF01BB51E.1.89.I01.1.454.CMB.1.raw
  modified_base (174)..(198): a, c, t, g, unknown or other
  misc_feature (174)..(198): n is a, c, g, or t
tcagacgagtgcgtcacgaccggtgctcgatttagtatgctagtatcgcggggggtgttcggcggagggaccaaactgacccgtcctaggtcagcccaaggctgccccctcggtcactctgttcccaccctcctcataggcgtactctgagcgggcctgggcaaggcgcatagnnnnnnnnnnnnnnnnnnnnnnnnn

SEQ ID NO: 86540 - DNA, 170 bp, Homo sapiens; identical to SEQ ID NO: 86433
  misc_feature: GYAE6OF01BV65W.1.89.I01.1.454.CMB.1.raw
  modified_base (170)..(170): a, c, t, g, unknown or other
  misc_feature (170)..(170): n is a, c, g, or t

SEQ ID NO: 86541 - DNA, 170 bp, Homo sapiens; identical to SEQ ID NO: 86374
  misc_feature: GYAE6OF01DJFHS.1.89.I01.1.454.CMB.1.raw
  modified_base (169)..(170): a, c, t, g, unknown or other
  misc_feature (169)..(170): n is a, c, g, or t

SEQ ID NO: 86542 - DNA, 187 bp, Homo sapiens; identical to SEQ ID NO: 86314
  misc_feature: GYAE6OF01EXHWJ.1.89.I01.1.454.CMB.1.raw
  modified_base (187)..(187): a, c, t, g, unknown or other
  misc_feature (187)..(187): n is a, c, g, or t

SEQ ID NO: 86543 - DNA, 168 bp, Homo sapiens
  misc_feature: GYAE6OF01EM8PZ.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctgtcgagcgtctgagcgggctggcaaggcgcatagn

SEQ ID NO: 86544 - DNA, 170 bp, Homo sapiens; identical to SEQ ID NO: 86433
  misc_feature: GYAE6OF01DZR5F.1.89.I01.1.454.CMB.1.raw
  modified_base (170)..(170): a, c, t, g, unknown or other
  misc_feature (170)..(170): n is a, c, g, or t

SEQ ID NO: 86545 - DNA, 168 bp, Homo sapiens; identical to SEQ ID NO: 86351
  misc_feature: GYAE6OF01BPBG4.1.89.I01.1.454.CMB.1.raw
  modified_base (168)..(168): a, c, t, g, unknown or other
  misc_feature (168)..(168): n is a, c, g, or t

SEQ ID NO: 86546 - DNA, 187 bp, Homo sapiens
  misc_feature: GYAE6OF01B7CLR.1.89.I01.1.454.CMB.1.raw
  modified_base (187)..(187): a, c, t, g, unknown or other
  misc_feature (187)..(187): n is a, c, g, or t
tcagacgagtgcgtcacgaccggtgctcgatttagtatgctagtatgggatggccacctgagtggtctttgggtgttcggcgggggaccaagctgaccgtcctaggtcagcccaaggctgccccctcggtcactctgttcccgccatctgatctctcgactctgagcgggctggcaaggcgcatagn

SEQ ID NO: 86547 - DNA, 171 bp, Homo sapiens
  misc_feature: GYAE6OF01D8MET.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcctacagtgctctgagcgggctggcaaggcgcatagnn

SEQ ID NO: 86548 - DNA, 170 bp, Homo sapiens
  misc_feature: GYAE6OF01EQF4P.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtcttcggagctgggaccaaggtcaccgtcctaggtaagcccaaggccaaccccactgtcactctgttcccaccctcctcacgtctactgctgagcgggctggcaaggcgcatagnn

SEQ ID NO: 86549 - DNA, 168 bp, Homo sapiens; identical to SEQ ID NO: 86287
  misc_feature: GYAE6OF01AFJLH.1.89.I01.1.454.CMB.1.raw
  modified_base (168)..(168): a, c, t, g, unknown or other
  misc_feature (168)..(168): n is a, c, g, or t

SEQ ID NO: 86550 - DNA, 170 bp, Homo sapiens; identical to SEQ ID NO: 86433
  misc_feature: GYAE6OF01C8NRC.1.89.I01.1.454.CMB.1.raw
  modified_base (170)..(170): a, c, t, g, unknown or other
  misc_feature (170)..(170): n is a, c, g, or t

SEQ ID NO: 86551 - DNA, 170 bp, Homo sapiens; identical to SEQ ID NO: 86531
  misc_feature: GYAE6OF01D3KKG.1.89.I01.1.454.CMB.1.raw
  modified_base (170)..(170): a, c, t, g, unknown or other
  misc_feature (170)..(170): n is a, c, g, or t

SEQ ID NO: 86552 - DNA, 208 bp, Homo sapiens
  misc_feature: GYAE6OF01E1ZE9.1.89.I01.1.454.CMB.1.raw
  modified_base (169)..(208): a, c, t, g, unknown or other
  misc_feature (169)..(208): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnnnnnnnnnnnnnnnnnnnn

SEQ ID NO: 86553 - DNA, 170 bp, Homo sapiens; identical to SEQ ID NO: 86316
  misc_feature: GYAE6OF01EEI3P.1.89.I01.1.454.CMB.1.raw
  modified_base (170)..(170): a, c, t, g, unknown or other
  misc_feature (170)..(170): n is a, c, g, or t

SEQ ID NO: 86554 - DNA, 173 bp, Homo sapiens
  misc_feature: GYAE6OF01EU0O6.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatagnnn

SEQ ID NO: 86555 - DNA, 169 bp, Homo sapiens
  misc_feature: GYAE6OF01BO2WX.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctactgctagtctgagcgggctggcaaggcgcatagn

SEQ ID NO: 86556 - DNA, 183 bp, Homo sapiens
  misc_feature: GYAE6OF01D2OJ7.1.89.I01.1.454.CMB.1.raw
  modified_base (171)..(183): a, c, t, g, unknown or other
  misc_feature (171)..(183): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctcatagcgtactctgagcgggctggcaaggcgcatagnnnnnnnnnnnnn

SEQ ID NO: 86557 - DNA, 170 bp, Homo sapiens
  misc_feature: GYAE6OF01A1K4U.1.89.I01.1.454.CMB.1.raw
tcagacgagtgcgtcacgaccggtgctcgatttagtatgctagtatcggcggggggtgttcggcggagggaccaaactgaccgtcctaggtcagcccaaggctgccccctcggtcactctgttcccgccctcctcatagcgtactctgagcgggctggcaaggcgcatag

SEQ ID NO: 86558 - DNA, 170 bp, Homo sapiens
  misc_feature: GYAE6OF01BI12X.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctagagacacgctgagcgggctggcaaggcgcatagn

SEQ ID NO: 86559 - DNA, 173 bp, Homo sapiens
  misc_feature: GYAE6OF01C0O9X.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagnnnn

SEQ ID NO: 86560 - DNA, 169 bp, Homo sapiens; identical to SEQ ID NO: 86555
  misc_feature: GYAE6OF01BBVGL.1.89.I01.1.454.CMB.1.raw
  modified_base (169)..(169): a, c, t, g, unknown or other
  misc_feature (169)..(169): n is a, c, g, or t

SEQ ID NO: 86561 - DNA, 344 bp, Homo sapiens
  misc_feature: GYAE6OF01EGL7S.1.89.I01.1.454.CMB.1.raw
  modified_base (337)..(344): a, c, t, g, unknown or other
  misc_feature (337)..(344): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtcttcccctggcaccctcctccaagagcacctctggggcacagcggcctggctgcctggtcaggctacttccgagtgcgtctctgagcgggctggcaaggcgcatagnnnnnnnn

SEQ ID NO: 86562 - DNA, 192 bp, Homo sapiens
  misc_feature: GYAE6OF01B7KRY.1.89.I01.1.454.CMB.1.raw
  modified_base (192)..(192): a, c, t, g, unknown or other
  misc_feature (192)..(192): n is a, c, g, or t
tcagacgagtgcgtcacgaccggtgctcgatttagtatgctagtaaggggaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagn

SEQ ID NO: 86563 - DNA, 220 bp, Homo sapiens
  misc_feature: GYAE6OF01B4CB7.1.89.I01.1.454.CMB.1.raw
  modified_base (178)..(220): a, c, t, g, unknown or other
  misc_feature (178)..(220): n is a, c, g, or t
tcagacgagtgcgtcacgaccggtgctcgatttagtatgctagtatcgcgggggtgttcgggcggagggaccaaactcgaccgtcctaggtcagcccaaggctgccccctggtcacgtcctgttcccgccctcctctacgtgcctagtctgagcgggcttcggcaaggccgcgatagnnnnnnnnnnnnnnnnnnnnnnnnnnnnnnnnnnnnnnnnnnn

SEQ ID NO: 86564 - DNA, 170 bp, Homo sapiens; identical to SEQ ID NO: 86531
  misc_feature: GYAE6OF01C52W1.1.89.I01.1.454.CMB.1.raw
  modified_base (170)..(170): a, c, t, g, unknown or other
  misc_feature (170)..(170): n is a, c, g, or t

SEQ ID NO: 86565 - DNA, 187 bp, Homo sapiens
  misc_feature: GYAE6OF01ESKDB.1.89.I01.1.454.CMB.1.raw
  modified_base (186)..(187): a, c, t, g, unknown or other
  misc_feature (186)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttccgccctcctctctctcgactctgagcgggctggcaaggcgcatagnn

SEQ ID NO: 86566 - DNA, 227 bp, Homo sapiens
  misc_feature: GYAE6OF01AHQNV.1.89.I01.1.454.CMB.1.raw
  modified_base (56)..(56): a, c, t, g, unknown or other
  misc_feature (56)..(56): n is a, c, g, or t
  modified_base (160)..(160): a, c, t, g, unknown or other
  misc_feature (160)..(160): n is a, c, g, or t
  modified_base (166)..(167): a, c, t, g, unknown or other
  misc_feature (166)..(167): n is a, c, g, or t
  modified_base (169)..(227): a, c, t, g, unknown or other
  misc_feature (169)..(227): n is a, c, g, or t
tcagacgagtgcgtcacgaccggtgctcgatttagtatgctagtatcgcgggggtnttcggcggagggaccaaactgaccgtcctaggtcagcccaaggctgccccctggtcactctgttcccaccctctctactgctagtctgagcggctggcaaggcncatagnncnnnnnnnnnnnnnnnnnnnnnnnnnnnnnnnnnnnnnnnnnnnnnnnnnnnnnnnnnnn

SEQ ID NO: 86567 - DNA, 169 bp, Homo sapiens
  misc_feature: GYAE6OF01CQK9Q.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctcatagcgtactctgagcgggctggcaaggcgcatagn

SEQ ID NO: 86568 - DNA, 324 bp, Homo sapiens
  misc_feature: GYAE6OF01DJAQX.1.89.I01.1.454.CMB.1.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (251)..(253): a, c, t, g, unknown or other
  misc_feature (251)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (265)..(266): a, c, t, g, unknown or other
  misc_feature (265)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (312)..(324): a, c, t, g, unknown or other
  misc_feature (312)..(324): n is a, c, g, or t
tcagacgagtgcgtcacgaccggtgctcgatttagtatgctagtaagtaggggatggacaggccgtcgaagtgaccccttaatgtcgttacggaactagggaccaaggtcaccgtccgtaggtcagcccaaagggcccaaacccctactcgtcacttcctgttcccaaccctcctcctactactcgacttctgacgcgggctcggccaaacggcggccaattacggntcccngcncctgntcagncncncnnncncngcgcgngnncngnagactactcncgngcgtgntgngcggcgngcgagcgcanagnnnnnnnnnnnnn

SEQ ID NO: 86569 - DNA, 170 bp, Homo sapiens
  misc_feature: GYAE6OF01CXYRD.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcctacagtgctctgagcgggctggcaaggcgcatagn

SEQ ID NO: 86570 - DNA, 169 bp, Homo sapiens; identical to SEQ ID NO: 86285
  misc_feature: GYAE6OF01AQ0KH.1.89.I01.1.454.CMB.1.raw
  modified_base (169)..(169): a, c, t, g, unknown or other
  misc_feature (169)..(169): n is a, c, g, or t

SEQ ID NO: 86571 - DNA, 220 bp, Homo sapiens; identical to SEQ ID NO: 86435
  misc_feature: GYAE6OF01B7FQW.1.89.I01.1.454.CMB.1.raw
  modified_base (219)..(220): a, c, t, g, unknown or other
  misc_feature (219)..(220): n is a, c, g, or t

SEQ ID NO: 86572 - DNA, 501 bp, Homo sapiens
  misc_feature: GYAE6OF01EAWWD.1.89.I01.1.454.CMB.1.raw
  modified_base (186)..(189): a, c, t, g, unknown or other
  misc_feature (186)..(189): n is a, c, g, or t
  modified_base (191)..(192): a, c, t, g, unknown or other
  misc_feature (191)..(192): n is a, c, g, or t
  modified_base (194)..(194): a, c, t, g, unknown or other
  misc_feature (194)..(194): n is a, c, g, or t
  modified_base (196)..(197): a, c, t, g, unknown or other
  misc_feature (196)..(197): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (265)..(266): a, c, t, g, unknown or other
  misc_feature (265)..(266): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (288)..(289): a, c, t, g, unknown or other
  misc_feature (288)..(289): n is a, c, g, or t
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (497)..(497): a, c, t, g, unknown or other
  misc_feature (497)..(497): n is a, c, g, or t
tcagacgagtgcgtcacgaccggtgctcgatttagtatgctagtatcgggcgggggggtgttcggccggagggaccaaacgtgaccgtcctaggtcaggcccaaggctggccccctcggtcactctcgttcccgaccctcctctactgctagtcgtgacgcggggctcggcaaggtcgcactagcnnnncnncncnncncntgctgcatctgaganactgntcncatcgctgccgatagcaggtcatgaatgacttgctggtacnnacacacacgacncncncncncnnctctactctcncactactactactagcgacacactacgtacgtcgcgcgcgtagtcgtcgtcgcgacactactctctactctcactcncncgcncgcgcgcgacgtcgtacgtactactactactactactacgtactactactactactactactacgtcgtacgtacgtacgtcgtgcgtcgacgacgacgtacgacgtagtctgngtcg

SEQ ID NO: 86573 - DNA, 189 bp, Homo sapiens
  misc_feature: GYAE6OF01D4LZU.1.89.I01.1.454.CMB.1.raw
  modified_base (187)..(189): a, c, t, g, unknown or other
  misc_feature (187)..(189): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctatgtatactctgagcgggctggcaaggcgcatagnnn

SEQ ID NO: 86574 - DNA, 171 bp, Homo sapiens
  misc_feature: GYAE6OF01CJF1V.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgtcccctcggtcactctgttcccgccctcctcatagcgtactctgagcgggctggcaaggcgcatagnn

SEQ ID NO: 86575 - DNA, 209 bp, Homo sapiens
  misc_feature: GYAE6OF01AYRFV.1.89.I01.1.454.CMB.1.raw
  modified_base (171)..(171): a, c, t, g, unknown or other
  misc_feature (171)..(171): n is a, c, g, or t
  modified_base (173)..(209): a, c, t, g, unknown or other
  misc_feature (173)..(209): n is a, c, g, or t
tcagacgagtgcgtcacgaccggtgctcgatttagtatgctagtatcgcggggtcttcggagctggaccaaggtcaccgtcctaggtcaggccccaaggccaaccccactgtccacgtctgttcccaccctcctcacgtctactgctgagcgggctggcaaggcgcatagncnnnnnnnnnnnnnnnnnnnnnnnnnnnnnnnnnnnnn

SEQ ID NO: 86576 - DNA, 170 bp, Homo sapiens
  misc_feature: GYAE6OF01BUT51.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctccgtgtctgatctgagcgggctggcaaggcgcatagnn

SEQ ID NO: 86577 - DNA, 169 bp, Homo sapiens; identical to SEQ ID NO: 86383
  misc_feature: GYAE6OF01BE6IZ.1.89.I01.1.454.CMB.1.raw
  modified_base (169)..(169): a, c, t, g, unknown or other
  misc_feature (169)..(169): n is a, c, g, or t

SEQ ID NO: 86578 - DNA, 221 bp, Homo sapiens
  misc_feature: GYAE6OF01EEOQO.1.89.I01.1.454.CMB.1.raw
  modified_base (219)..(221): a, c, t, g, unknown or other
  misc_feature (219)..(221): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccaccctcctctagagacacgctgagcgggctggcaaggcgcatagnnn

SEQ ID NO: 86579 - DNA, 212 bp, Homo sapiens
  misc_feature: GYAE6OF01C4FE7.1.89.I01.1.454.CMB.1.raw
  modified_base (178)..(212): a, c, t, g, unknown or other
  misc_feature (178)..(212): n is a, c, g, or t
tcagacgagtgcgtcacgaccggtgctcgatttagtatgctagtatcggcgggggggtgttccggcggagggaccaaactgaccgtcctaggtcagcccaaggcgtcgccccctcggtcactctggttcccaccctcctccgtgtctgatctcgaggcgggctggcaaggcgcatagnnnnnnnnnnnnnnnnnnnnnnnnnnnnnnnnnnn

SEQ ID NO: 86580 - DNA, 170 bp, Homo sapiens
  misc_feature: GYAE6OF01EFEK0.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcacgtagcgtgctgagcgggctggcaaggcgcatagn

SEQ ID NO: 86581 - DNA, 168 bp, Homo sapiens
  misc_feature: GYAE6OF01BXWFM.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcggggaatgttcggcgggggaccaagctgaccgtcttaggtcagcccaaggctgcccctcggtcactctgttcccgccctcctctgtcgagcgtctgagcgggctggcaaggcgcatagn

SEQ ID NO: 86582 - DNA, 228 bp, Homo sapiens
  misc_feature: GYAE6OF01COXCX.1.89.I01.1.454.CMB.1.raw
  modified_base (57)..(57): a, c, t, g, unknown or other
  misc_feature (57)..(57): n is a, c, g, or t
  modified_base (169)..(228): a, c, t, g, unknown or other
  misc_feature (169)..(228): n is a, c, g, or t
tcagacgagtgcgtcacgaccggtgctcgatttagtatgctagtatcgcggggggtnttcggcggagggaccaaactgaccgtcctaggtcagcccaaggctgccccctcggtcactctgttcccaccctcctctactgctagtctgagcggctggcaaggcgcatagnnnnnnnnnnnnnnnnnnnnnnnnnnnnnnnnnnnnnnnnnnnnnnnnnnnnnnnnnnnn

SEQ ID NO: 86583 - DNA, 171 bp, Homo sapiens
  misc_feature: GYAE6OF01CH9P6.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcggcgggggtgttcggcggagggaccaaactgaccgtcctaggtcagcccaaggctgccccctcggtcactctgttcccgccctcctctatacgatcgctgagcgggctggcaaggcgcatagnn

SEQ ID NO: 86584 - DNA, 187 bp, Homo sapiens; identical to SEQ ID NO: 86314
  misc_feature: GYAE6OF01B4WAC.1.89.I01.1.454.CMB.1.raw
  modified_base (187)..(187): a, c, t, g, unknown or other
  misc_feature (187)..(187): n is a, c, g, or t

SEQ ID NO: 86585 - DNA, 171 bp, Homo sapiens; identical to SEQ ID NO: 86391
  misc_feature: GYAE6OF01BJ18J.1.89.I01.1.454.CMB.1.raw
  modified_base (170)..(171): a, c, t, g, unknown or other
  misc_feature (170)..(171): n is a, c, g, or t

SEQ ID NO: 86586 - DNA, 170 bp, Homo sapiens; identical to SEQ ID NO: 86531
  misc_feature: GYAE6OF01C77JV.1.89.I01.1.454.CMB.1.raw
  modified_base (170)..(170): a, c, t, g, unknown or other
  misc_feature (170)..(170): n is a, c, g, or t

SEQ ID NO: 86587 - DNA, 170 bp, Homo sapiens; identical to SEQ ID NO: 86433
  misc_feature: GYAE6OF01DMNXQ.1.89.I01.1.454.CMB.1.raw
  modified_base (170)..(170): a, c, t, g, unknown or other
  misc_feature (170)..(170): n is a, c, g, or t

SEQ ID NO: 86588 - DNA, 200 bp, Homo sapiens
  misc_feature: GYAE6OF01DW0GJ.1.89.I01.1.454.CMB.1.raw
  modified_base (167)..(200): a, c, t, g, unknown or other
  misc_feature (167)..(200): n is a, c, g, or t
tcagacgagtgcgtcacgaccggtgctcgatttagtatgctagtagtcggcggggggtgttcggcggaggaccaactgaccgtcctaggtcagcccaaggctgccccctggtcactctgttcccaccctctcacgtctactgctgagcggctggcaaggcgcatagnnnnnnnnnnnnnnnnnnnnnnnnnnnnnnnnnn

SEQ ID NO: 86589 - DNA, 169 bp, Homo sapiens; identical to SEQ ID NO: 86298
  misc_feature: GYAE6OF01A5TQ7.1.89.I01.1.454.CMB.1.raw
  modified_base (169)..(169): a, c, t, g, unknown or other
  misc_feature (169)..(169): n is a, c, g, or t

SEQ ID NO: 86590 - DNA, 232 bp, Homo sapiens
  misc_feature: GYAE6OF01CBZAT.1.89.I01.1.454.CMB.1.raw
  modified_base (169)..(169): a, c, t, g, unknown or other
  misc_feature (169)..(169): n is a, c, g, or t
  modified_base (176)..(232): a, c, t, g, unknown or other
  misc_feature (176)..(232): n is a, c, g, or t
tcagacgagtgcgtcacgaccggtgctcgatttagtatgctagtatcgcgggggggtgttcggacggagggaccaaactgaccgtcctagggtcagcccaaggctgccccctcggtcactctgttcccgccctcctcatagcgtactctgagcgggctgggccaaggcncatagcnnnnnnnnnnnnnnnnnnnnnnnnnnnnnnnnnnnnnnnnnnnnnnnnnnnnnnnnn

SEQ ID NO: 86591 - DNA, 170 bp, Homo sapiens; identical to SEQ ID NO: 86327
  misc_feature: GYAE6OF01D3P62.1.89.I01.1.454.CMB.1.raw
  modified_base (169)..(170): a, c, t, g, unknown or other
  misc_feature (169)..(170): n is a, c, g, or t

SEQ ID NO: 86592 - DNA, 542 bp, Homo sapiens
  misc_feature: GYAE6OF01DEOIQ.1.89.I01.1.454.CMB.1.raw
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccgaggggaaggggcttcagggacctctgggctgatccttggtctcctgctcctcaggctcgaccggggccagcactgactcactggcatgtgtttcctccctctttccagacgtcctgggcccagtctcgccctgacctcacgcctcgccctccgtgtcgtgggtctccgtggacagtcgatcaccatctcctgcactggaaccngcagtgacgttggtgttangactntgtctctgtacacactcaccagacaacgcccagactctatgtatttagtgtacgtactagtcacgttccggcctcgtacgggtttactaacgttccgtccttcgtcgttcggcttacctacgttcgtcggacctaaccgacccggtccctcccgtcgtaccctacg

SEQ ID NO: 86593 - DNA, 172 bp, Homo sapiens
  misc_feature: GYAE6OF01ENQXU.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnn

SEQ ID NO: 86594 - DNA, 214 bp, Homo sapiens
  misc_feature: GYAE6OF01BF2QD.1.89.I01.1.454.CMB.1.raw
  modified_base (55)..(55): a, c, t, g, unknown or other
  misc_feature (55)..(55): n is a, c, g, or t
  modified_base (154)..(154): a, c, t, g, unknown or other
  misc_feature (154)..(154): n is a, c, g, or t
  modified_base (160)..(214): a, c, t, g, unknown or other
  misc_feature (160)..(214): n is a, c, g, or t
tcagacgagtgcgtcacgaccggtgctcgatttagtatgctagtatcgcggggtnttcggcgaggaccaactgaccgtcctaggtcagcccaaggctgcccctggtcactctgttcccacctctctactgctagtctgagcggctggcaaggcncatagnnnnnnnnnnnnnnnnnnnnnnnnnnnnnnnnnnnnnnnnnnnnnnnnnnnnnnn

SEQ ID NO: 86595 - DNA, 170 bp, Homo sapiens; identical to SEQ ID NO: 86548
  misc_feature: GYAE6OF01CU63P.1.89.I01.1.454.CMB.1.raw
  modified_base (169)..(170): a, c, t, g, unknown or other
  misc_feature (169)..(170): n is a, c, g, or t

SEQ ID NO: 86596 - DNA, 171 bp, Homo sapiens
  misc_feature: GYAE6OF01BUU0X.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcggggtcttcggagctgggaccaaggtcaccgtcctaggtcagcccaaggccaaccccactgtcactctgttcccaccctcctcacgtctactgctgagcgggctggcaaggcgcatagnnnn

SEQ ID NO: 86597 - DNA, 171 bp, Homo sapiens
  misc_feature: GYAE6OF01DDEOK.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtaactctgttcccgcctcctctactgctagtctgagcgggctggcaaggcgcatagnnn

SEQ ID NO: 86598 - DNA, 182 bp, Homo sapiens
  misc_feature: GYAE6OF01AKJOK.1.89.I01.1.454.CMB.1.raw
  modified_base (169)..(182): a, c, t, g, unknown or other
  misc_feature (169)..(182): n is a, c, g, or t
tcagacgagtgcgtcacgaccggtgctcgatttagtatgctagtatcggcggggggtgttcggcggagggaccaaactgaccgtcctaggtcagcccaaggctgcccctggtcactctgttcccaccctcctctactgctagtctgagcgggctggcaaggcgcatagnnnnnnnnnnnnnn

SEQ ID NO: 86599 - DNA, 175 bp, Homo sapiens
  misc_feature: GYAE6OF01CFQNT.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnnnnnn

SEQ ID NO: 86600 - DNA, 169 bp, Homo sapiens; identical to SEQ ID NO: 86400
  misc_feature: GYAE6OF01CN4BV.1.89.I01.1.454.CMB.1.raw
  modified_base (169)..(169): a, c, t, g, unknown or other
  misc_feature (169)..(169): n is a, c, g, or t

SEQ ID NO: 86601 - DNA, 228 bp, Homo sapiens
  misc_feature: GYAE6OF01E1YC3.1.89.I01.1.454.CMB.1.raw
  modified_base (56)..(56): a, c, t, g, unknown or other
  misc_feature (56)..(56): n is a, c, g, or t
  modified_base (161)..(161): a, c, t, g, unknown or other
  misc_feature (161)..(161): n is a, c, g, or t
  modified_base (167)..(228): a, c, t, g, unknown or other
  misc_feature (167)..(228): n is a, c, g, or t
tcagacgagtgcgtcacgaccggtgctcgatttagtatgctagtatcgcgggggtnttcggcggagggaccaaactgaccgtcctaggtcagcccaaggctgccccctggtcactctgttcccaccctcctctactgctagtctgagcggctggcaaggcncatagnnnnnnnnnnnnnnnnnnnnnnnnnnnnnnnnnnnnnnnnnnnnnnnnnnnnnnnnnnnnnn

SEQ ID NO: 86602 - DNA, 170 bp, Homo sapiens; identical to SEQ ID NO: 86417
  misc_feature: GYAE6OF01CZ2HU.1.89.I01.1.454.CMB.1.raw
  modified_base (170)..(170): a, c, t, g, unknown or other
  misc_feature (170)..(170): n is a, c, g, or t

SEQ ID NO: 86603 - DNA, 558 bp, Homo sapiens
  misc_feature: GYAE6OF01AF9HG.1.89.I01.1.454.CMB.1.raw
  modified_base (56)..(56): a, c, t, g, unknown or other
  misc_feature (56)..(56): n is a, c, g, or t
  modified_base (167)..(167): a, c, t, g, unknown or other
  misc_feature (167)..(167): n is a, c, g, or t
  modified_base (488)..(488): a, c, t, g, unknown or other
  misc_feature (488)..(488): n is a, c, g, or t
  modified_base (510)..(510): a, c, t, g, unknown or other
  misc_feature (510)..(510): n is a, c, g, or t
  modified_base (552)..(552): a, c, t, g, unknown or other
  misc_feature (552)..(552): n is a, c, g, or t
tcagacgagtgcgtcacgaccggtgctcgatttagtatgctagtatcgcgggggtnttcggcggagggaccaactgaccgtcctaggtcagcccaaggctgcccctcggtcactctgttcccacctctctactgctagtctgacgcggctggcaaggcgcatacgcncgcgcgtcgcgcgcgcgtcgcgcgcgacgtcgtacgcgtcgcgcgtcgcgtcgacgtcgcgtcgacgtcgacgtcgtacgtcgacgtacgacgcgtcgcgcgtacgtacgcgtcgcgtacgtcgcgtcgtcgtcgtcgcgcgtcgcgtacgtcgcgtcgcgtcgtacgcgtcgtcgtacgcgcgtacgacgtcgacgtcgtccgcgtacgtcgtcgtcgacgtcgtcgtacgcgtcgaccgtcgacgtacgtcgtcgtcgtacgtacgcgtcgacgcgtcgacgtcgctcggacgtcgtacgcggtctacgtcgtcggtcncgtcgtcgcgcgtcgcgtacgngtacgtcgacggcgcgtacggcgtcggtcgacgacgtgccgnggtacg

SEQ ID NO: 86604 - DNA, 170 bp, Homo sapiens
  misc_feature: GYAE6OF01B3WWW.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctactgctgagcgggctggcaaggcgcatagnn

SEQ ID NO: 86605 - DNA, 166 bp, Homo sapiens
  misc_feature: GYAE6OF01B8RT9.1.89.I01.1.454.CMB.1.raw
tcagacgagtgcgtcacgaccggtgctcgatttagtatgctagtatcgcgggggtgttcggcggaggaccaaactgaccgtcctaggtcagcccaaggctgcccctcggtcactctgttcccgccctcctcatagcgtactctgagcgggctggcaaggcgcatag

SEQ ID NO: 86606 - DNA, 171 bp, Homo sapiens
  misc_feature: GYAE6OF01BSZT2.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagnn

SEQ ID NO: 86607 - DNA, 171 bp, Homo sapiens
  misc_feature: GYAE6OF01DXXRT.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcgggggaatgttcggcgggggaccaagctgaccgtcttaggtcagcccaaggctgccccctcggtcactctgttcccaccctcctctgtcgagcgtctgagcgggctggcaaggcgcatagnn

SEQ ID NO: 86608 - DNA, 168 bp, Homo sapiens
  misc_feature: GYAE6OF01C6WQU.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcatgcgtactctgagcgggctggcaaggcgcatagn

SEQ ID NO: 86609 - DNA, 188 bp, Homo sapiens; identical to SEQ ID NO: 86367
  misc_feature: GYAE6OF01CXOO9.1.89.I01.1.454.CMB.1.raw
  modified_base (187)..(188): a, c, t, g, unknown or other
  misc_feature (187)..(188): n is a, c, g, or t

SEQ ID NO: 86610 - DNA, 248 bp, Homo sapiens
  misc_feature: GYAE6OF01EQ2BE.1.89.I01.1.454.CMB.1.raw
  modified_base (178)..(248): a, c, t, g, unknown or other
  misc_feature (178)..(248): n is a, c, g, or t
tcagacgagtgcgtcacgaccggtgctcgatttagtatgctagtatcgggcggggggggtgttccggcggagggaccaaactgaccgtcctaggtcagcccaaggctcgccccctcggtcactctggttcccaccctcctctactgctagtctgaggcgggctggcaaggcgcatagnnnnnnnnnnnnnnnnnnnnnnnnnnnnnnnnnnnnnnnnnnnnnnnnnnnnnnnnnnnnnnnnnnnnnnn

SEQ ID NO: 86611 - DNA, 170 bp, Homo sapiens; identical to SEQ ID NO: 86404
  misc_feature: GYAE6OF01D7FP4.1.89.I01.1.454.CMB.1.raw
  modified_base (170)..(170): a, c, t, g, unknown or other
  misc_feature (170)..(170): n is a, c, g, or t

SEQ ID NO: 86612 - DNA, 340 bp, Homo sapiens
  misc_feature: GYAE6OF01CVGM3.1.89.I01.1.454.CMB.1.raw
  modified_base (331)..(340): a, c, t, g, unknown or other
  misc_feature (331)..(340): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggcagcagcctcaccaaggcccatcggtctcccctgcaccctcctcaagagcacctctggggcacagcgccctggctgctggtcaaggctactccgagtgcgtctctgagcggctggcaaggcgcagtagnnnnnnnnnn

SEQ ID NO: 86613 - DNA, 189 bp, Homo sapiens; identical to SEQ ID NO: 86573
  misc_feature: GYAE6OF01AOJBT.1.89.I01.1.454.CMB.1.raw
  modified_base (187)..(189): a, c, t, g, unknown or other
  misc_feature (187)..(189): n is a, c, g, or t

SEQ ID NO: 86614 - DNA, 173 bp, Homo sapiens
  misc_feature: GYAE6OF01CU4TG.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctgtcgagcgtctgagcgggctggcaaggcgcatagnnnn

SEQ ID NO: 86615 - DNA, 172 bp, Homo sapiens
  misc_feature: GYAE6OF01CRODO.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctccgtgtctgatctgagcgggctggcaaggcgcatagnn

SEQ ID NO: 86616 - DNA, 222 bp, Homo sapiens
  misc_feature: GYAE6OF01B5L71.1.89.I01.1.454.CMB.1.raw
  modified_base (57)..(57): a, c, t, g, unknown or other
  misc_feature (57)..(57): n is a, c, g, or t
  modified_base (162)..(162): a, c, t, g, unknown or other
  misc_feature (162)..(162): n is a, c, g, or t
  modified_base (168)..(222): a, c, t, g, unknown or other
  misc_feature (168)..(222): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttcccaccctcctctactgctagtctgagcggctggcaaggcncatagnnnnnnnnnnnnnnnnnnnnnnnnnnnnnnnnnnnnnnnnnnnnnnnnnnnnnnn

SEQ ID NO: 86617 - DNA, 171 bp, Homo sapiens
  misc_feature: GYAE6OF01CE809.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccacccctcctcatagcgtactctgagcgggctggcaaggcgcatagn

SEQ ID NO: 86618 - DNA, 257 bp, Homo sapiens; identical to SEQ ID NO: 86386
  misc_feature: GYAE6OF01BC98N.1.89.I01.1.454.CMB.1.raw
  modified_base (255)..(257): a, c, t, g, unknown or other
  misc_feature (255)..(257): n is a, c, g, or t

SEQ ID NO: 86619 - DNA, 223 bp, Homo sapiens
  misc_feature: GYAE6OF01B95WT.1.89.I01.1.454.CMB.1.raw
  modified_base (56)..(56): a, c, t, g, unknown or other
  misc_feature (56)..(56): n is a, c, g, or t
  modified_base (159)..(159): a, c, t, g, unknown or other
  misc_feature (159)..(159): n is a, c, g, or t
  modified_base (165)..(223): a, c, t, g, unknown or other
  misc_feature (165)..(223): n is a, c, g, or t
tcagacgagtgcgtcacgaccggtgctcgatttagtatgctagtatcgcgggggtnttcggcggagggaccaaactgaccgtcctaggtcagcccaaggctgcccctcggtcactctgttcccgcctctctactgctagtctgagcggctggcaaggcncatagnnnnnnnnnnnnnnnnnnnnnnnnnnnnnnnnnnnnnnnnnnnnnnnnnnnnnnnnnnn

SEQ ID NO: 86620 - DNA, 171 bp, Homo sapiens
  misc_feature: GYAE6OF01ADWM4.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcacgtctactgctgagcgggctggcaaggcgcatagnn

SEQ ID NO: 86621 - DNA, 164 bp, Homo sapiens
  misc_feature: GYAE6OF01CF85O.1.89.I01.1.454.CMB.1.raw
  modified_base (164)..(164): a, c, t, g, unknown or other
  misc_feature (164)..(164): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttccacctcctagagacacgctgagcgggctggcaaggcgcatagn

SEQ ID NO: 86622 - DNA, 276 bp, Homo sapiens
  misc_feature: GYAE6OF01CQKQ4.1.89.I01.1.454.CMB.1.raw
  modified_base (258)..(276): a, c, t, g, unknown or other
  misc_feature (258)..(276): n is a, c, g, or t
tcagacgagtgcgtcacgaccggtgctcgatttagtatgctagtatcgcgggggacaaagctgccctgaccctctcgggtgcgcagcctgacgatgaggctgactattactgcttcctctcctggcacggtgctctgccggcgttcggcggagggaccaaggtgatcggtcctaagtcagcccaaggcgtcgccccctggtcactctgttcccgccatctgaatagcgtactctgagcgggctggcaggcgcagtagnnnnnnnnnnnnnnnnnnn

SEQ ID NO: 86623 - DNA, 196 bp, Homo sapiens
  misc_feature: GYAE6OF01BF92A.1.89.I01.1.454.CMB.1.raw
  modified_base (170)..(196): a, c, t, g, unknown or other
  misc_feature (170)..(196): n is a, c, g, or t
tcagacgagtgcgtcacgaccggtgctcgatttagtatgctagtatcggcggggggtgttcggcggagggaccaaactgaccgtcctaggtcagcccaaggctgcccctcggtcactctgttcccgccctcctcatagcgtactctgagcgggctggcaaggcgcatagnnnnnnnnnnnnnnnnnnnnnnnnnnn

SEQ ID NO: 86624 - DNA, 183 bp, Homo sapiens
  misc_feature: GYAE6OF01BDOPO.1.89.I01.1.454.CMB.1.raw
  modified_base (172)..(183): a, c, t, g, unknown or other
  misc_feature (172)..(183): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccatctgaatagcgtactctgagcgggcttggcaaggcgcaatagnnnnnnnnnnnn

SEQ ID NO: 86625 - DNA, 170 bp, Homo sapiens; identical to SEQ ID NO: 86433
  misc_feature: GYAE6OF01D8TEG.1.89.I01.1.454.CMB.1.raw
  modified_base (170)..(170): a, c, t, g, unknown or other
  misc_feature (170)..(170): n is a, c, g, or t

SEQ ID NO: 86626 - DNA, 169 bp, Homo sapiens; identical to SEQ ID NO: 86445
  misc_feature: GYAE6OF01D6C2O.1.89.I01.1.454.CMB.1.raw
  modified_base (169)..(169): a, c, t, g, unknown or other
  misc_feature (169)..(169): n is a, c, g, or t

SEQ ID NO: 86627 - DNA, 170 bp, Homo sapiens; identical to SEQ ID NO: 86381
  misc_feature: GYAE6OF01CI4SG.1.89.I01.1.454.CMB.1.raw
  modified_base (170)..(170): a, c, t, g, unknown or other
  misc_feature (170)..(170): n is a, c, g, or t

SEQ ID NO: 86628 - DNA, 347 bp, Homo sapiens
  misc_feature: GYAE6OF01B3B0A.1.89.I01.1.454.CMB.1.raw
  modified_base (344)..(347): a, c, t, g, unknown or other
  misc_feature (344)..(347): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttcccctggccaccctcctccaagagcacctctgggggcacagcggccctgggctgcctggtcaaggactacttcctcgtagcactctgagcgggctggcaaggcgcatagnnnn

SEQ ID NO: 86629 - DNA, 169 bp, Homo sapiens
  misc_feature: GYAE6OF01DJP3Q.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctactgctgagcggctggcaaggcgcatagnn

SEQ ID NO: 86630 - DNA, 236 bp, Homo sapiens
  misc_feature: GYAE6OF01D355E.1.89.I01.1.454.CMB.1.raw
  modified_base (182)..(236): a, c, t, g, unknown or other
  misc_feature (182)..(236): n is a, c, g, or t
tcagacgagtgcgtcacgaccggtgctcgattttagtatgctagtatcgcgggggggtgttacgggccggaagggaccaaacctgaccggtcctaggtccagcccaaggctgccccctcgtcactctgttcccgccctcctctatacgattcgctggagcgggctggcaaaggcgcatagcnnnnnnnnnnnnnnnnnnnnnnnnnnnnnnnnnnnnnnnnnnnnnnnnnnnnnnn

SEQ ID NO: 86631 - DNA, 170 bp, Homo sapiens
  misc_feature: GYAE6OF01EV96U.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcacgtagcgtgctgagcgggctggcaaggcgcatagn

SEQ ID NO: 86632 - DNA, 171 bp, Homo sapiens
  misc_feature: GYAE6OF01DDDX6.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctcacgtagcgtgctgagcgggctggcaaggcgcatagnnn

SEQ ID NO: 86633 - DNA, 170 bp, Homo sapiens; identical to SEQ ID NO: 86433
  misc_feature: GYAE6OF01CZSXH.1.89.I01.1.454.CMB.1.raw
  modified_base (170)..(170): a, c, t, g, unknown or other
  misc_feature (170)..(170): n is a, c, g, or t

SEQ ID NO: 86634 - DNA, 220 bp, Homo sapiens
  misc_feature: GYAE6OF01AUFUJ.1.89.I01.1.454.CMB.1.raw
  modified_base (56)..(56): a, c, t, g, unknown or other
  misc_feature (56)..(56): n is a, c, g, or t
  modified_base (162)..(165): a, c, t, g, unknown or other
  misc_feature (162)..(165): n is a, c, g, or t
  modified_base (167)..(220): a, c, t, g, unknown or other
  misc_feature (167)..(220): n is a, c, g, or t
tcagacgagtgcgtcacgaccggtgctcgatttagtatgctagtatcgcgggggtnttcggcgaggaccaactgaccgtcctaggtcagcccaaggctgcccctggtcactctgttcccgccctctctactgctagtctgagcggctggcaaggcgcatagnnnncnnnnnnnnnnnnnnnnnnnnnnnnnnnnnnnnnnnnnnnnnnnnnnnnnnnnnn

SEQ ID NO: 86635 - DNA, 172 bp, Homo sapiens
  misc_feature: GYAE6OF01BXRIE.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccatctgaatagcgtactctgagcgggctggcaaggcgcatagnnn

SEQ ID NO: 86636 - DNA, 249 bp, Homo sapiens
  misc_feature: GYAE6OF01EABVY.1.89.I01.1.454.CMB.1.raw
  modified_base (240)..(249): a, c, t, g, unknown or other
  misc_feature (240)..(249): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccactgtcactctgttcccaccctcctctcgtagcactctgagcgggctggcaaggcgcatagnnnnnnnnnn

SEQ ID NO: 86637 - DNA, 203 bp, Homo sapiens
  misc_feature: GYAE6OF01BJDQ8.1.89.I01.1.454.CMB.1.raw
  modified_base (170)..(203): a, c, t, g, unknown or other
  misc_feature (170)..(203): n is a, c, g, or t
tcagacgagtgcgtcacgaccggtgctcgatttagtatgctagtagtcgcggggtcttcggagctgggaccaaggtcaccgtcctaggtaagccccaaggccaaccccactgtcactctgttcccgccctcctcacgtctactgctgagcgggctggcaaggcgcatagnnnnnnnnnnnnnnnnnnnnnnnnnnnnnnnnnn

SEQ ID NO: 86638 - DNA, 171 bp, Homo sapiens; identical to SEQ ID NO: 86458
  misc_feature: GYAE6OF01APPO1.1.89.I01.1.454.CMB.1.raw
  modified_base (169)..(171): a, c, t, g, unknown or other
  misc_feature (169)..(171): n is a, c, g, or t

SEQ ID NO: 86639 - DNA, 227 bp, Homo sapiens
  misc_feature: GYAE6OF01DN6C1.1.89.I01.1.454.CMB.1.raw
  modified_base (225)..(227): a, c, t, g, unknown or other
  misc_feature (225)..(227): n is a, c, g, or t
tcagacgagtgcgtcacgaccggtgctcgatttagtatgctagtatcgcggggcccaggcagatgatgaatctaattattactgtttgctttattttgatagtggctgggtgttcggcggcgggaccaagctgaccgtcctaggtcagcccaaggctgtcccctcggtcactctgttcccaccctcctctatacgatcgctgagcgggctggcaaggcgcatagnnn

SEQ ID NO: 86640 - DNA, 193 bp, Homo sapiens
  misc_feature: GYAE6OF01AG64X.1.89.I01.1.454.CMB.1.raw
  modified_base (187)..(193): a, c, t, g, unknown or other
  misc_feature (187)..(193): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctcacgtagcgtgctgagcgggctggcaaggcgcatagnnnnnnn

SEQ ID NO: 86641 - DNA, 170 bp, Homo sapiens; identical to SEQ ID NO: 86580
  misc_feature: GYAE6OF01CW1UU.1.89.I01.1.454.CMB.1.raw
  modified_base (170)..(170): a, c, t, g, unknown or other
  misc_feature (170)..(170): n is a, c, g, or t

SEQ ID NO: 86642 - DNA, 170 bp, Homo sapiens; identical to SEQ ID NO: 86497
  misc_feature: GYAE6OF01DRK3M.1.89.I01.1.454.CMB.1.raw
  modified_base (170)..(170): a, c, t, g, unknown or other
  misc_feature (170)..(170): n is a, c, g, or t

SEQ ID NO: 86643 - DNA, 176 bp, Homo sapiens
  misc_feature: GYAE6OF01DKI5X.1.89.I01.1.454.CMB.1.raw
  modified_base (169)..(176): a, c, t, g, unknown or other
  misc_feature (169)..(176): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccgccctcctctgtcgagcgtctgagcgggctggcaaggcgcatagnnnnnnnn

SEQ ID NO: 86644 - DNA, 170 bp, Homo sapiens; identical to SEQ ID NO: 86433
  misc_feature: GYAE6OF01DH3YJ.1.89.I01.1.454.CMB.1.raw
  modified_base (170)..(170): a, c, t, g, unknown or other
  misc_feature (170)..(170): n is a, c, g, or t

SEQ ID NO: 86645 - DNA, 170 bp, Homo sapiens; identical to SEQ ID NO: 86580
  misc_feature: GYAE6OF01BHFUV.1.89.I01.1.454.CMB.1.raw
  modified_base (170)..(170): a, c, t, g, unknown or other
  misc_feature (170)..(170): n is a, c, g, or t

SEQ ID NO: 86646 - DNA, 169 bp, Homo sapiens
  misc_feature: GYAE6OF01E35ME.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccatctgaacgcactcgtctgagcgggctggcaaggcgcatagn

SEQ ID NO: 86647 - DNA, 213 bp, Homo sapiens
  misc_feature: GYAE6OF01AOSV7.1.89.I01.1.454.CMB.1.raw
  modified_base (162)..(162): a, c, t, g, unknown or other
  misc_feature (162)..(162): n is a, c, g, or t
  modified_base (168)..(213): a, c, t, g, unknown or other
  misc_feature (168)..(213): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccgccctcctctactgctagtctgagcggctggcaaggcncatagnnnnnnnnnnnnnnnnnnnnnnnnnnnnnnnnnnnnnnnnnnnnnn

SEQ ID NO: 86648 - DNA, 169 bp, Homo sapiens
  misc_feature: GYAE6OF01DG822.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcacgtagcgtgctgagcgggctggcaaggcgcatagn

SEQ ID NO: 86649 - DNA, 256 bp, Homo sapiens; identical to SEQ ID NO: 86473
  misc_feature: GYAE6OF01EP4RZ.1.89.I01.1.454.CMB.1.raw
  modified_base (254)..(256): a, c, t, g, unknown or other
  misc_feature (254)..(256): n is a, c, g, or t

SEQ ID NO: 86650 - DNA, 175 bp, Homo sapiens
  misc_feature: GYAE6OF01B384L.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctgtcgagcgtctgagcgggctggcaaggcgcatagnnnnnn

SEQ ID NO: 86651 - DNA, 170 bp, Homo sapiens
  misc_feature: GYAE6OF01BFPZU.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctcgtagcactctgagcgggctggcaaggcgcatagn

SEQ ID NO: 86652 - DNA, 183 bp, Homo sapiens
  misc_feature: GYAE6OF01DTRHO.1.89.I01.1.454.CMB.1.raw
  modified_base (170)..(183): a, c, t, g, unknown or other
  misc_feature (170)..(183): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctcatagcgtactctgagcggctggcaaggcgcatagnnnnnnnnnnnnnn

SEQ ID NO: 86653 - DNA, 171 bp, Homo sapiens; identical to SEQ ID NO: 86606
  misc_feature: GYAE6OF01DWULM.1.89.I01.1.454.CMB.1.raw
  modified_base (170)..(171): a, c, t, g, unknown or other
  misc_feature (170)..(171): n is a, c, g, or t

SEQ ID NO: 86654 - DNA, 188 bp, Homo sapiens
  misc_feature: GYAE6OF01EE47D.1.89.I01.1.454.CMB.1.raw
  modified_base (187)..(188): a, c, t, g, unknown or other
  misc_feature (187)..(188): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggctgccccctcggtcactctgttcccaccctcctctctctcgactctgagcgggctggcaaggcgcatagnn

SEQ ID NO: 86655 - DNA, 168 bp, Homo sapiens
  misc_feature: GYAE6OF01E3GI1.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctccgtgtctgatctgagcgggctggcaaggcgcatagn

SEQ ID NO: 86656 - DNA, 196 bp, Homo sapiens
  misc_feature: GYAE6OF01DYW15.1.89.I01.1.454.CMB.1.raw
  modified_base (172)..(196): a, c, t, g, unknown or other
  misc_feature (172)..(196): n is a, c, g, or t
tcagacgagtgcgtcacgaccggtgctcgatttagtatgctagtatcgcgggggggtgttcggcggagggaccaaactgaccgtcctaggtcagcccaaggcctgccccctcggtcactctgttcccaccctcctctactgctagtctgagcgggctggcaaggcgcatagnnnnnnnnnnnnnnnnnnnnnnnnn

SEQ ID NO: 86657 - DNA, 170 bp, Homo sapiens; identical to SEQ ID NO: 86417
  misc_feature: GYAE6OF01AMDL7.1.89.I01.1.454.CMB.1.raw
  modified_base (170)..(170): a, c, t, g, unknown or other
  misc_feature (170)..(170): n is a, c, g, or t

SEQ ID NO: 86658 - DNA, 188 bp, Homo sapiens; identical to SEQ ID NO: 86367
  misc_feature: GYAE6OF01DN973.1.89.I01.1.454.CMB.1.raw
  modified_base (187)..(188): a, c, t, g, unknown or other
  misc_feature (187)..(188): n is a, c, g, or t

SEQ ID NO: 86659 - DNA, 172 bp, Homo sapiens
  misc_feature: GYAE6OF01CW7H0.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagnnn

SEQ ID NO: 86660 - DNA, 169 bp, Homo sapiens
  misc_feature: GYAE6OF01BDRSD.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatag

SEQ ID NO: 86661 - DNA, 188 bp, Homo sapiens; identical to SEQ ID NO: 86367
  misc_feature: GYAE6OF01CAJI7.1.89.I01.1.454.CMB.1.raw
  modified_base (187)..(188): a, c, t, g, unknown or other
  misc_feature (187)..(188): n is a, c, g, or t

SEQ ID NO: 86662 - DNA, 170 bp, Homo sapiens; identical to SEQ ID NO: 86433
  misc_feature: GYAE6OF01D6W03.1.89.I01.1.454.CMB.1.raw
  modified_base (170)..(170): a, c, t, g, unknown or other
  misc_feature (170)..(170): n is a, c, g, or t

SEQ ID NO: 86663 - DNA, 170 bp, Homo sapiens; identical to SEQ ID NO: 86631
  misc_feature: GYAE6OF01BNUNX.1.89.I01.1.454.CMB.1.raw
  modified_base (170)..(170): a, c, t, g, unknown or other
  misc_feature (170)..(170): n is a, c, g, or t

SEQ ID NO: 86664 - DNA, 187 bp, Homo sapiens
  misc_feature: GYAE6OF01BVDWZ.1.89.I01.1.454.CMB.1.raw
  modified_base (172)..(187): a, c, t, g, unknown or other
  misc_feature (172)..(187): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccaccctcctcatagcgtactctgagcgggctggcaaggcgcatagnnnnnnnnnnnnnnnn

SEQ ID NO: 86665 - DNA, 172 bp, Homo sapiens
  misc_feature: GYAE6OF01AJI6J.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcgggggtggttcggcggagggaccgaaactgaccgtcctaggtcagcccaaggctgcccctcggtcactctgttccgacctcctctagagacacgctgagcgggctggcaaggcgcatagnnnn

SEQ ID NO: 86666 - DNA, 346 bp, Homo sapiens
  misc_feature: GYAE6OF01B91KC.1.89.I01.1.454.CMB.1.raw
  modified_base (342)..(346): a, c, t, g, unknown or other
  misc_feature (342)..(346): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtctcccctggccaccctcctccaagagcacctctgggggcacagcggccctgggctgcctggtcaaggactacttcctcgtagcactctgagcgggctggcaaggcgcatagnnnnn

SEQ ID NO: 86667 - DNA, 169 bp, Homo sapiens
  misc_feature: GYAE6OF01A4H13.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcccaccctcctcacgtagcgtgctgagcgggctggcaaggcgcatagnn

SEQ ID NO: 86668 - DNA, 170 bp, Homo sapiens; identical to SEQ ID NO: 86531
  misc_feature: GYAE6OF01BT6AE.1.89.I01.1.454.CMB.1.raw
  modified_base (170)..(170): a, c, t, g, unknown or other
  misc_feature (170)..(170): n is a, c, g, or t

SEQ ID NO: 86669 - DNA, 228 bp, Homo sapiens
  misc_feature: GYAE6OF01EGTJY.1.89.I01.1.454.CMB.1.raw
  modified_base (227)..(228): a, c, t, g, unknown or other
  misc_feature (227)..(228): n is a, c, g, or t
tcagacgagtgcgtcacgaccggtgctcgatttagtatgctagtatcgcggggcccaggcagatgatgagtctacttactattgtgtcctttacttgcgtgatggcatttggctgttcggcggagggaccaaagtgaccgtcctgggtcagcccaaggctgccccctcggtcactctgttcccgcctcctctgtcgagcgtctgagcgggctggcaaggcgcatagnn

SEQ ID NO: 86670 - DNA, 216 bp, Homo sapiens
  misc_feature: GYAE6OF01DG583.1.89.I01.1.454.CMB.1.raw
  modified_base (173)..(216): a, c, t, g, unknown or other
  misc_feature (173)..(216): n is a, c, g, or t
tcagacgagtgcgtcacgaccggtgctcgatttagtatgctagtatcggtcgggggtcttcggagctgggaccaaggtcaccgtcctaggtcagcccaaggcccaaccccactgtcactcgtgttcccaccctcctcacgtctactgctgagcgggctggcaaggcgcatagnnnnnnnnnnnnnnnnnnnnnnnnnnnnnnnnnnnnnnnnnnnn

SEQ ID NO: 86671 - DNA, 171 bp, Homo sapiens
  misc_feature: GYAE6OF01AYQ6Z.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctgtcgagcgtctgagcgggctggcaaggcgcatagnn

SEQ ID NO: 86672 - DNA, 187 bp, Homo sapiens; identical to SEQ ID NO: 86314
  misc_feature: GYAE6OF01EGBYN.1.89.I01.1.454.CMB.1.raw
  modified_base (187)..(187): a, c, t, g, unknown or other
  misc_feature (187)..(187): n is a, c, g, or t

SEQ ID NO: 86673 - DNA, 233 bp, Homo sapiens
  misc_feature: GYAE6OF01EI3UV.1.89.I01.1.454.CMB.1.raw
  modified_base (178)..(233): a, c, t, g, unknown or other
  misc_feature (178)..(233): n is a, c, g, or t
tcagacgagtgcgtcacgaccggtgctcgatttagtatgctagtatcgcggggggggtgttacggcggagggaccaaactggacccgtcctagggtccagcccaaggcctgccccctggtcactctgttcccgccctctctgtcgagcgtctggagcgggctggcaaggcgcagtagnnnnnnnnnnnnnnnnnnnnnnnnnnnnnnnnnnnnnnnnnnnnnnnnnnnnnnnn

SEQ ID NO: 86674 - DNA, 183 bp, Homo sapiens
  misc_feature: GYAE6OF01B861R.1.89.I01.1.454.CMB.1.raw
  modified_base (172)..(183): a, c, t, g, unknown or other
  misc_feature (172)..(183): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccgccctcctctactgctagtctgagcgggctggcaaggcgcatagnnnnnnnnnnnn

SEQ ID NO: 86675 - DNA, 238 bp, Homo sapiens
  misc_feature: GYAE6OF01A7HZ6.1.89.I01.1.454.CMB.1.raw
  modified_base (177)..(177): a, c, t, g, unknown or other
  misc_feature (177)..(177): n is a, c, g, or t
  modified_base (184)..(238): a, c, t, g, unknown or other
  misc_feature (184)..(238): n is a, c, g, or t
tcagacgagtgcgtcacgaccggtgctcgatttagtatgctagtattcggtcggggggggtgttcggggcggagggaccaaacgtgaccgtcctaggtcaggcccaaggcctgccccctggtcacgtctgttcccaccctcctctactcgctagtctgaggcgggctgggcaaggcncatagcnnnnnnnnnnnnnnnnnnnnnnnnnnnnnnnnnnnnnnnnnnnnnnnnnnnnnnn

SEQ ID NO: 86676 - DNA, 170 bp, Homo sapiens; identical to SEQ ID NO: 86452
  misc_feature: GYAE6OF01AD0BD.1.89.I01.1.454.CMB.1.raw
  modified_base (170)..(170): a, c, t, g, unknown or other
  misc_feature (170)..(170): n is a, c, g, or t

SEQ ID NO: 86677 - DNA, 219 bp, Homo sapiens
  misc_feature: GYAE6OF01CMWFE.1.89.I01.1.454.CMB.1.raw
  modified_base (217)..(219): a, c, t, g, unknown or other
  misc_feature (217)..(219): n is a, c, g, or t
tcagacgagtgcgtcacgaccggtgctcgatttagtatgctagtatcgcgggacgaggccgattattactgcgggacctgggataccagtctgagttctgtggtgttcggcggagggaccaagctgaccgtcgcaggtcagcccaagtctgccccctcggtcactctgttcccaccctcctctaagacacgctgagcgggctggcaaggcgcatagnnn

SEQ ID NO: 86678 - DNA, 171 bp, Homo sapiens
  misc_feature: GYAE6OF01BU5J6.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctatacgatcgctgagcgggctggcaaggcgcatagnn

SEQ ID NO: 86679 - DNA, 221 bp, Homo sapiens
  misc_feature: GYAE6OF01DZ120.1.89.I01.1.454.CMB.1.raw
  modified_base (219)..(221): a, c, t, g, unknown or other
  misc_feature (219)..(221): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccgccctcctctatgtatactctgagcgggctggcaaggcgcatagnnn

SEQ ID NO: 86680 - DNA, 170 bp, Homo sapiens; identical to SEQ ID NO: 86404
  misc_feature: GYAE6OF01EBEA1.1.89.I01.1.454.CMB.1.raw
  modified_base (170)..(170): a, c, t, g, unknown or other
  misc_feature (170)..(170): n is a, c, g, or t

SEQ ID NO: 86681 - DNA, 171 bp, Homo sapiens; identical to SEQ ID NO: 86493
  misc_feature: GYAE6OF01CWAL1.1.89.I01.1.454.CMB.1.raw
  modified_base (170)..(171): a, c, t, g, unknown or other
  misc_feature (170)..(171): n is a, c, g, or t

SEQ ID NO: 86682 - DNA, 169 bp, Homo sapiens
  misc_feature: GYAE6OF01BZACO.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcgagtgcgtctctgagcgggctggcaaggcgcatag

SEQ ID NO: 86683 - DNA, 191 bp, Homo sapiens
  misc_feature: GYAE6OF01BL069.1.89.I01.1.454.CMB.1.raw
  modified_base (166)..(166): a, c, t, g, unknown or other
  misc_feature (166)..(166): n is a, c, g, or t
  modified_base (172)..(191): a, c, t, g, unknown or other
  misc_feature (172)..(191): n is a, c, g, or t
tcagacgagtgcgtcacgaccggtgctcgatttagtatgctagtatcggcgggggtggttcggcggagggaccaaactgaccgtcctaggtcagcccaaggctgccccctcggtcactctgttcccaccctcctcatagcgtactctgagcgggctggcaagggcncatagnnnnnnnnnnnnnnnnnnnn

SEQ ID NO: 86684 - DNA, 174 bp, Homo sapiens; identical to SEQ ID NO: 86524
  misc_feature: GYAE6OF01EVW47.1.89.I01.1.454.CMB.1.raw
  modified_base (170)..(174): a, c, t, g, unknown or other
  misc_feature (170)..(174): n is a, c, g, or t

SEQ ID NO: 86685 - DNA, 209 bp, Homo sapiens
  misc_feature: GYAE6OF01CPPYV.1.89.I01.1.454.CMB.1.raw
  modified_base (172)..(209): a, c, t, g, unknown or other
  misc_feature (172)..(209): n is a, c, g, or t
tcagacgagtgcgtcacgaccggtgctcgatttagtatgctagtatcgcgggggtcgttcggagctgggaccaaggtcaccgtcctaggtccagcccaaggcctaaccccactgtcactctgttcccaccctcctcacgtctactgctgagcggctggcaaggcgcatacgnnnnnnnnnnnnnnnnnnnnnnnnnnnnnnnnnnnnnn

SEQ ID NO: 86686 - DNA, 171 bp, Homo sapiens; identical to SEQ ID NO: 86493
  misc_feature: GYAE6OF01BHUZP.1.89.I01.1.454.CMB.1.raw
  modified_base (170)..(171): a, c, t, g, unknown or other
  misc_feature (170)..(171): n is a, c, g, or t

SEQ ID NO: 86687 - DNA, 171 bp, Homo sapiens; identical to SEQ ID NO: 86441
  misc_feature: GYAE6OF01EFD4J.1.89.I01.1.454.CMB.1.raw
  modified_base (170)..(171): a, c, t, g, unknown or other
  misc_feature (170)..(171): n is a, c, g, or t

SEQ ID NO: 86688 - DNA, 174 bp, Homo sapiens
  misc_feature: GYAE6OF01CY0WP.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnnnn

SEQ ID NO: 86689 - DNA, 170 bp, Homo sapiens; identical to SEQ ID NO: 86433
  misc_feature: GYAE6OF01APR99.1.89.I01.1.454.CMB.1.raw
  modified_base (170)..(170): a, c, t, g, unknown or other
  misc_feature (170)..(170): n is a, c, g, or t

SEQ ID NO: 86690 - DNA, 170 bp, Homo sapiens; identical to SEQ ID NO: 86404
  misc_feature: GYAE6OF01DP0NW.1.89.I01.1.454.CMB.1.raw
  modified_base (170)..(170): a, c, t, g, unknown or other
  misc_feature (170)..(170): n is a, c, g, or t

SEQ ID NO: 86691 - DNA, 170 bp, Homo sapiens; identical to SEQ ID NO: 86433
  misc_feature: GYAE6OF01B505L.1.89.I01.1.454.CMB.1.raw
  modified_base (170)..(170): a, c, t, g, unknown or other
  misc_feature (170)..(170): n is a, c, g, or t

SEQ ID NO: 86692 - DNA, 171 bp, Homo sapiens
  misc_feature: GYAE6OF01DG7RN.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcggctggcaaggcgcatagnnn

SEQ ID NO: 86693 - DNA, 208 bp, Homo sapiens
  misc_feature: GYAE6OF01BXYBT.1.89.I01.1.454.CMB.1.raw
  modified_base (56)..(56): a, c, t, g, unknown or other
  misc_feature (56)..(56): n is a, c, g, or t
  modified_base (157)..(157): a, c, t, g, unknown or other
  misc_feature (157)..(157): n is a, c, g, or t
  modified_base (163)..(208): a, c, t, g, unknown or other
  misc_feature (163)..(208): n is a, c, g, or t
tcagacgagtgcgtcacgaccggtgctcgatttagtatgctagtatcgcgggggtnttcggcggaggaccaaactgaccgtcctaggtcagcccaaggctgcccctggtcactctgttcccgcctctctactgctagtctgagcggctggcaaggcncatagnnnnnnnnnnnnnnnnnnnnnnnnnnnnnnnnnnnnnnnnnnnnnn

SEQ ID NO: 86694 - DNA, 170 bp, Homo sapiens; identical to SEQ ID NO: 86433
  misc_feature: GYAE6OF01CKSWS.1.89.I01.1.454.CMB.1.raw
  modified_base (170)..(170): a, c, t, g, unknown or other
  misc_feature (170)..(170): n is a, c, g, or t

SEQ ID NO: 86695 - DNA, 171 bp, Homo sapiens
  misc_feature: GYAE6OF01DLHU7.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctactgctagtctgagcgggctggcaaggcgcatagn

SEQ ID NO: 86696 - DNA, 168 bp, Homo sapiens; identical to SEQ ID NO: 86287
  misc_feature: GYAE6OF01A1P3M.1.89.I01.1.454.CMB.1.raw
  modified_base (168)..(168): a, c, t, g, unknown or other
  misc_feature (168)..(168): n is a, c, g, or t

SEQ ID NO: 86697 - DNA, 171 bp, Homo sapiens; identical to SEQ ID NO: 86391
  misc_feature: GYAE6OF01DVK5P.1.89.I01.1.454.CMB.1.raw
  modified_base (170)..(171): a, c, t, g, unknown or other
  misc_feature (170)..(171): n is a, c, g, or t

SEQ ID NO: 86698 - DNA, 169 bp, Homo sapiens; identical to SEQ ID NO: 86430
  misc_feature: GYAE6OF01D753E.1.89.I01.1.454.CMB.1.raw
  modified_base (169)..(169): a, c, t, g, unknown or other
  misc_feature (169)..(169): n is a, c, g, or t

SEQ ID NO: 86699 - DNA, 232 bp, Homo sapiens
  misc_feature: GYAE6OF01EA1LK.1.89.I01.1.454.CMB.1.raw
  modified_base (231)..(232): a, c, t, g, unknown or other
  misc_feature (231)..(232): n is a, c, g, or t
tcagacgagtgcgtcacgaccggtgctcgatttagtatgctagtatcgcgggggcccaggcagatgatgaatctgattattactgtgtgctgtatatgggtagtgactcagattgggtgttcggcggagggaccaagctgaccgtcctacgtcagcccaaggctgcccctcggtcactctgttcccgccctcctcacgcactcgtctgagcgggctggcaaggcgcatagnn

SEQ ID NO: 86700 - DNA, 172 bp, Homo sapiens
  misc_feature: GYAE6OF01DMWLL.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcacgtagcgtgctgagcgggctggcaaggcgcatagnn

SEQ ID NO: 86701 - DNA, 168 bp, Homo sapiens; identical to SEQ ID NO: 86287
  misc_feature: GYAE6OF01BO20K.1.89.I01.1.454.CMB.1.raw
  modified_base (168)..(168): a, c, t, g, unknown or other
  misc_feature (168)..(168): n is a, c, g, or t

SEQ ID NO: 86702 - DNA, 170 bp, Homo sapiens; identical to SEQ ID NO: 86404
  misc_feature: GYAE6OF01A9QKW.1.89.I01.1.454.CMB.1.raw
  modified_base (170)..(170): a, c, t, g, unknown or other
  misc_feature (170)..(170): n is a, c, g, or t

SEQ ID NO: 86703 - DNA, 170 bp, Homo sapiens; identical to SEQ ID NO: 86404
  misc_feature: GYAE6OF01ETD6T.1.89.I01.1.454.CMB.1.raw
  modified_base (170)..(170): a, c, t, g, unknown or other
  misc_feature (170)..(170): n is a, c, g, or t

SEQ ID NO: 86704 - DNA, 181 bp, Homo sapiens
  misc_feature: GYAE6OF01BHA2R.1.89.I01.1.454.CMB.1.raw
  modified_base (170)..(181): a, c, t, g, unknown or other
  misc_feature (170)..(181): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccgccctcctccgtgtctgatctgagcggctggcaaggcgcatagnnnnnnnnnnnn

SEQ ID NO: 86705 - DNA, 172 bp, Homo sapiens
  misc_feature: GYAE6OF01D3A1O.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcacgtagcgtgctgagcgggctggcaaggcgcatagnnn

SEQ ID NO: 86706 - DNA, 171 bp, Homo sapiens
  misc_feature: GYAE6OF01DIAXM.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagn

SEQ ID NO: 86707 - DNA, 170 bp, Homo sapiens; identical to SEQ ID NO: 86381
  misc_feature: GYAE6OF01APIMH.1.89.I01.1.454.CMB.1.raw
  modified_base (170)..(170): a, c, t, g, unknown or other
  misc_feature (170)..(170): n is a, c, g, or t

SEQ ID NO: 86708 - DNA, 522 bp, Homo sapiens
  misc_feature: GYAE6OF01DNNY9.1.89.I01.1.454.CMB.1.raw
  modified_base (58)..(58): a, c, t, g, unknown or other
  misc_feature (58)..(58): n is a, c, g, or t
  modified_base (164)..(165): a, c, t, g, unknown or other
  misc_feature (164)..(165): n is a, c, g, or t
  modified_base (168)..(168): a, c, t, g, unknown or other
  misc_feature (168)..(168): n is a, c, g, or t
  modified_base (170)..(170): a, c, t, g, unknown or other
  misc_feature (170)..(170): n is a, c, g, or t
  modified_base (172)..(175): a, c, t, g, unknown or other
  misc_feature (172)..(175): n is a, c, g, or t
  modified_base (178)..(179): a, c, t, g, unknown or other
  misc_feature (178)..(179): n is a, c, g, or t
  modified_base (182)..(183): a, c, t, g, unknown or other
  misc_feature (182)..(183): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
tcagacgagtgcgtcacgaccggtgctcgatttagtatgctagtatcggcggggggtnttcggcggaggaccaaactgaccgtctaggtcagccaaggctgcccctggtcactctgttcccgcctctctactgctagtctgagcgggctggcaaggcgcatagnncgncngnnnnagnngcnncgncgngcgcgcgcgngcncgtngcncgtcngtncgcncagtcgcgagtcacgtcgcgcgctacnccgtanccgancgacgcnggtccatcggntccgagccagtcncgcngtgngcgcgtaacgcgtaagcgcgtacgtcgcgtcgngtcacgtgtctacgngtacgacgacgagtacgacgtgtacgacgtcgtacgtacgtacgtactacgtcgtacgtcgtcgtgtaacgtcgcgacgtgtacgtcgtcgtaagcgtaacgtcgtacggaccggtacgtacgttcggacgtacgtacgtacgtcgacgttacggaaacgtcgtcgtaagtcgtcg

SEQ ID NO: 86709 - DNA, 514 bp, Homo sapiens
  misc_feature: GYAE6OF01AE5P5.1.89.I01.1.454.CMB.1.raw
  modified_base (224)..(224): a, c, t, g, unknown or other
  misc_feature (224)..(224): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacagagtcctgggcccagtctgccctgactcagcctgcctccgtgtctgggtctcctggacagtcgatcaccatctcctgcactggaaccngcagtgacgttggtggttatgactatgtctcctggtaccaacatcacccaggcaaaggccccagactcatgattttatgaggtcagtcatcggccctcgaggggtttctaatcgctttctctggctccaagtctggcacacggcctccctgaccatctctcgcctccaggctgaggacgaggctgattacttactgcagctacatatacaagacagtagaactacgtagggttttcggacggaagggaccaacgcgtacgaccgtcgtaaggtccacggcccgtaaccgg

SEQ ID NO: 86710 - DNA, 171 bp, Homo sapiens
  misc_feature: GYAE6OF01EFVI3.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctgtcgagcgtctgagcgggctggcaaggcgcatagn

SEQ ID NO: 86711 - DNA, 170 bp, Homo sapiens
  misc_feature: GYAE6OF01BGZJA.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccatctgaacgcactcgtctgagcgggctggcaaggcgcatagn

SEQ ID NO: 86712 - DNA, 170 bp, Homo sapiens; identical to SEQ ID NO: 86404
  misc_feature: GYAE6OF01BAZBO.1.89.I01.1.454.CMB.1.raw
  modified_base (170)..(170): a, c, t, g, unknown or other
  misc_feature (170)..(170): n is a, c, g, or t

SEQ ID NO: 86713 - DNA, 171 bp, Homo sapiens; identical to SEQ ID NO: 86391
  misc_feature: GYAE6OF01CPLKU.1.89.I01.1.454.CMB.1.raw
  modified_base (170)..(171): a, c, t, g, unknown or other
  misc_feature (170)..(171): n is a, c, g, or t

SEQ ID NO: 86714 - DNA, 171 bp, Homo sapiens; identical to SEQ ID NO: 86441
  misc_feature: GYAE6OF01DS84H.1.89.I01.1.454.CMB.1.raw
  modified_base (170)..(171): a, c, t, g, unknown or other
  misc_feature (170)..(171): n is a, c, g, or t

SEQ ID NO: 86715 - DNA, 211 bp, Homo sapiens
  misc_feature: GYAE6OF01B0OYD.1.89.I01.1.454.CMB.1.raw
  modified_base (186)..(211): a, c, t, g, unknown or other
  misc_feature (186)..(211): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctcctcgactctgagcgggctggcaaggcgcatagnnnnnnnnnnnnnnnnnnnnnnnnnn

SEQ ID NO: 86716 - DNA, 169 bp, Homo sapiens
  misc_feature: GYAE6OF01ACVU4.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtcttcggagctgggaccaaggtcaccgtcctaggtaagcccaaggccaaccccactgtcactctgttcccaccctcctcacgtctactgctgagcgggctggcaaggcgcatagn

SEQ ID NO: 86717 - DNA, 170 bp, Homo sapiens; identical to SEQ ID NO: 86417
  misc_feature: GYAE6OF01DZF70.1.89.I01.1.454.CMB.1.raw
  modified_base (170)..(170): a, c, t, g, unknown or other
  misc_feature (170)..(170): n is a, c, g, or t

SEQ ID NO: 86718 - DNA, 171 bp, Homo sapiens; identical to SEQ ID NO: 86493
  misc_feature: GYAE6OF01BX7EW.1.89.I01.1.454.CMB.1.raw
  modified_base (170)..(171): a, c, t, g, unknown or other
  misc_feature (170)..(171): n is a, c, g, or t

SEQ ID NO: 86719 - DNA, 170 bp, Homo sapiens; identical to SEQ ID NO: 86381
  misc_feature: GYAE6OF01BIXB7.1.89.I01.1.454.CMB.1.raw
  modified_base (170)..(170): a, c, t, g, unknown or other
  misc_feature (170)..(170): n is a, c, g, or t

SEQ ID NO: 86720 - DNA, 169 bp, Homo sapiens
  misc_feature: GYAE6OF01CCCLA.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctcatagcgtactctgagcgggctggcaaggcgcatagn

SEQ ID NO: 86721 - DNA, 170 bp, Homo sapiens; identical to SEQ ID NO: 86433
  misc_feature: GYAE6OF01C80BL.1.89.I01.1.454.CMB.1.raw
  modified_base (170)..(170): a, c, t, g, unknown or other
  misc_feature (170)..(170): n is a, c, g, or t

SEQ ID NO: 86722 - DNA, 168 bp, Homo sapiens; identical to SEQ ID NO: 86317
  misc_feature: GYAE6OF01AZZGJ.1.89.I01.1.454.CMB.1.raw
  modified_base (168)..(168): a, c, t, g, unknown or other
  misc_feature (168)..(168): n is a, c, g, or t

SEQ ID NO: 86723 - DNA, 172 bp, Homo sapiens
  misc_feature: GYAE6OF01ESUUP.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnn

SEQ ID NO: 86724 - DNA, 188 bp, Homo sapiens
  misc_feature: GYAE6OF01B7Q04.1.89.I01.1.454.CMB.1.raw
  modified_base (187)..(188): a, c, t, g, unknown or other
  misc_feature (187)..(188): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctctctctcgactctgagcgggctggcaaggcgcatagnn

SEQ ID NO: 86725 - DNA, 257 bp, Homo sapiens
  misc_feature: GYAE6OF01CN2J3.1.89.I01.1.454.CMB.1.raw
  modified_base (253)..(257): a, c, t, g, unknown or other
  misc_feature (253)..(257): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgcccctggtcactctgttcccgccatctgaatagcgtactctgagcgggctggcaaggcgcatagnnnnn

SEQ ID NO: 86726 - DNA, 170 bp, Homo sapiens; identical to SEQ ID NO: 86417
  misc_feature: GYAE6OF01CL86C.1.89.I01.1.454.CMB.1.raw
  modified_base (170)..(170): a, c, t, g, unknown or other
  misc_feature (170)..(170): n is a, c, g, or t

SEQ ID NO: 86727 - DNA, 216 bp, Homo sapiens
  misc_feature: GYAE6OF01A9JRA.1.89.I01.1.454.CMB.1.raw
  modified_base (57)..(57): a, c, t, g, unknown or other
  misc_feature (57)..(57): n is a, c, g, or t
  modified_base (169)..(216): a, c, t, g, unknown or other
  misc_feature (169)..(216): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttcccgccctcctctactgctagtctgagcgggctggcaaggcgcatagnnnnnnnnnnnnnnnnnnnnnnnnnnnnnnnnnnnnnnnnnnnnnnnn

SEQ ID NO: 86728 - DNA, 186 bp, Homo sapiens
  misc_feature: GYAE6OF01DHFM1.1.89.I01.1.454.CMB.1.raw
  modified_base (164)..(164): a, c, t, g, unknown or other
  misc_feature (164)..(164): n is a, c, g, or t
  modified_base (170)..(186): a, c, t, g, unknown or other
  misc_feature (170)..(186): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcctgccctcctctactgctagtctgagcggctggcaaggcncatagnnnnnnnnnnnnnnnnn

SEQ ID NO: 86729 - DNA, 199 bp, Homo sapiens
  misc_feature: GYAE6OF01EPLB6.1.89.I01.1.454.CMB.1.raw
  modified_base (172)..(199): a, c, t, g, unknown or other
  misc_feature (172)..(199): n is a, c, g, or t
tcagacgagtgcgtcacgaccggtgctcgatttagtatgctagtatcggcggggggtgttcggcggagggaccaaactgaccggtcctaggtcagcccaaggctgccccctcggtcactctgttcccgccctcctctactgctagtctgagcgggctggcaaggcgcatagnnnnnnnnnnnnnnnnnnnnnnnnnnnn

SEQ ID NO: 86730 - DNA, 170 bp, Homo sapiens
  misc_feature: GYAE6OF01CKFNV.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcgggctggcaaggcgcatagnn

SEQ ID NO: 86731 - DNA, 171 bp, Homo sapiens; identical to SEQ ID NO: 86695
  misc_feature: GYAE6OF01CPBN0.1.89.I01.1.454.CMB.1.raw
  modified_base (171)..(171): a, c, t, g, unknown or other
  misc_feature (171)..(171): n is a, c, g, or t

SEQ ID NO: 86732 - DNA, 170 bp, Homo sapiens; identical to SEQ ID NO: 86417
  misc_feature: GYAE6OF01DIU3O.1.89.I01.1.454.CMB.1.raw
  modified_base (170)..(170): a, c, t, g, unknown or other
  misc_feature (170)..(170): n is a, c, g, or t

SEQ ID NO: 86733 - DNA, 173 bp, Homo sapiens
  misc_feature: GYAE6OF01AVKPK.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnnn

SEQ ID NO: 86734 - DNA, 171 bp, Homo sapiens; identical to SEQ ID NO: 86493
  misc_feature: GYAE6OF01ER1FG.1.89.I01.1.454.CMB.1.raw
  modified_base (170)..(171): a, c, t, g, unknown or other
  misc_feature (170)..(171): n is a, c, g, or t

SEQ ID NO: 86735 - DNA, 350 bp, Homo sapiens
  misc_feature: GYAE6OF01DMYFP.1.89.I01.1.454.CMB.1.raw
  modified_base (343)..(350): a, c, t, g, unknown or other
  misc_feature (343)..(350): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggccaccctcctccaagagcacctctggggcacagcggcctgggctgcctggtcaaggactacttccgagtgcgtctctgagcgggctggcaaggcgcatagnnnnnnnn

SEQ ID NO: 86736 - DNA, 184 bp, Homo sapiens
  misc_feature: GYAE6OF01DLA06.1.89.I01.1.454.CMB.1.raw
  modified_base (170)..(184): a, c, t, g, unknown or other
  misc_feature (170)..(184): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctcgagtgcgtctctgagcgggctggcaaggcgcatagnnnnnnnnnnnnnnn

SEQ ID NO: 86737 - DNA, 169 bp, Homo sapiens; identical to SEQ ID NO: 86285
  misc_feature: GYAE6OF01CVO40.1.89.I01.1.454.CMB.1.raw
  modified_base (169)..(169): a, c, t, g, unknown or other
  misc_feature (169)..(169): n is a, c, g, or t

SEQ ID NO: 86738 - DNA, 198 bp, Homo sapiens
  misc_feature: GYAE6OF01DMPL3.1.89.I01.1.454.CMB.1.raw
  modified_base (170)..(198): a, c, t, g, unknown or other
  misc_feature (170)..(198): n is a, c, g, or t
tcagacgagtgcgtcacgaccggtgctcgatttagtatgctagtagtcgcggggggtgttcggcggagggaccaaactgaccgtcctaggtcagcccaaggctgccccctggtcactctgttcccgccctcctcatagcgtactctgagcgggctggcaaggcgcatagnnnnnnnnnnnnnnnnnnnnnnnnnnnnn

SEQ ID NO: 86739 - DNA, 171 bp, Homo sapiens; identical to SEQ ID NO: 86391
  misc_feature: GYAE6OF01EOOQQ.1.89.I01.1.454.CMB.1.raw
  modified_base (170)..(171): a, c, t, g, unknown or other
  misc_feature (170)..(171): n is a, c, g, or t

SEQ ID NO: 86740 - DNA, 173 bp, Homo sapiens
  misc_feature: GYAE6OF01DFJGG.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnnnn

SEQ ID NO: 86741 - DNA, 203 bp, Homo sapiens
  misc_feature: GYAE6OF01ESVXL.1.89.I01.1.454.CMB.1.raw
  modified_base (172)..(203): a, c, t, g, unknown or other
  misc_feature (172)..(203): n is a, c, g, or t
tcagacgagtgcgtcacgaccggtgctcgatttagtatgctagtatcggcggggggtgttcggcggagggaccaaactgaccgtcctaggtcagcccaaggctgccccctggtcactctgttcccgccctcctccgtgtctgatctgagcgggctgggcaaggcgcattagnnnnnnnnnnnnnnnnnnnnnnnnnnnnnnnn

SEQ ID NO: 86742 - DNA, 180 bp, Homo sapiens
  misc_feature: GYAE6OF01BV5FT.1.89.I01.1.454.CMB.1.raw
  modified_base (171)..(180): a, c, t, g, unknown or other
  misc_feature (171)..(180): n is a, c, g, or t
tcagacgagtgcgtcacgaccggtgctcgatttagtatgctagtagtcggcgggggggtgttcggcggagggaccaaactgaccgtcctaggtcagcccaaggctgcccctcggtcactctgttcccaccctctcacgtagcgtgctgagcgggctggcaaggcgcatagnnnnnnnnnn

SEQ ID NO: 86743 - DNA, 170 bp, Homo sapiens
  misc_feature: GYAE6OF01COOON.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcatagcgtactctgagcggctggcaaggcgcatagnnn

SEQ ID NO: 86744 - DNA, 187 bp, Homo sapiens
  misc_feature: GYAE6OF01BBTGX.1.89.I01.1.454.CMB.1.raw
  modified_base (186)..(187): a, c, t, g, unknown or other
  misc_feature (186)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctccctctctcgactctgagcgggctggcaaggcgcatagnn

SEQ ID NO: 86745 - DNA, 172 bp, Homo sapiens
  misc_feature: GYAE6OF01EB5CG.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccatctgaatagcgtactctgagcgggctggcaaggcgcatagnn

SEQ ID NO: 86746 - DNA, 244 bp, Homo sapiens
  misc_feature: GYAE6OF01DZAQW.1.89.I01.1.454.CMB.1.raw
  modified_base (240)..(244): a, c, t, g, unknown or other
  misc_feature (240)..(244): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccactgtcactctgttcccaccctcctcacgcactcgtctgagcgggctggcaaggcgcatagnnnnn

SEQ ID NO: 86747 - DNA, 188 bp, Homo sapiens
  misc_feature: GYAE6OF01A9DC9.1.89.I01.1.454.CMB.1.raw
  modified_base (169)..(188): a, c, t, g, unknown or other
  misc_feature (169)..(188): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctattgctgagcgggctggcaaggcgcatagnnnnnnnnnnnnnnnnnnnn

SEQ ID NO: 86748 - DNA, 186 bp, Homo sapiens
  misc_feature: GYAE6OF01AY2B0.1.89.I01.1.454.CMB.1.raw
  modified_base (172)..(186): a, c, t, g, unknown or other
  misc_feature (172)..(186): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccgccctcctctgtcgagcgtctgagcgggctggcaaggcgcatagnnnnnnnnnnnnnnn

SEQ ID NO: 86749 - DNA, 239 bp, Homo sapiens
  misc_feature: GYAE6OF01BQO69.1.89.I01.1.454.CMB.1.raw
  modified_base (188)..(239): a, c, t, g, unknown or other
  misc_feature (188)..(239): n is a, c, g, or t
tcagacgagtgcgtcacgaccggtgctcgatttagtatgctagtatacggacggggggggtcgttaaccggcggacgggaccaaacgtgaaccgtccctaggtcagcccaaggctgccccctcggtcactctgttcccaccctctcattagcggtactctgagcgggctggcaagggccgcactaggnnnnnnnnnnnnnnnnnnnnnnnnnnnnnnnnnnnnnnnnnnnnnnnnnnnn

SEQ ID NO: 86750 - DNA, 187 bp, Homo sapiens
  misc_feature: GYAE6OF01AL7VW.1.89.I01.1.454.CMB.1.raw
  modified_base (171)..(187): a, c, t, g, unknown or other
  misc_feature (171)..(187): n is a, c, g, or t
tcagacgagtgcgtcacgaccggtgctcgatttagtatgctagtagtcgcggggggtgttcggcggagggaccaaactgaccgtcctaggtcagcccaaggctgccccctcggtcactctgttcccgccctcctcacgtctactgctgagcgggctggcaaggcgcatagnnnnnnnnnnnnnnnnn

SEQ ID NO: 86751 - DNA, 263 bp, Homo sapiens
  misc_feature: GYAE6OF01A7UEY.1.89.I01.1.454.CMB.1.raw
  modified_base (254)..(263): a, c, t, g, unknown or other
  misc_feature (254)..(263): n is a, c, g, or t
tcagacgagtgcgtcacgaccggtgctcgatttagtatgctagtatcgcgggggcccaggcagatgatgagtctacttactattgtgtcctttacttgcgtgatggctagtttggctgttcggcgggaggaaccaaagtcgaccgtccgtgggtcacgcccaaggctccgcccccgtcggtcactctcgttccccaccctcctctgtcgagtcgtctgacggcgggtcgtcggacgaagggccgactaagtagnnnnnnnnnn

SEQ ID NO: 86752 - DNA, 177 bp, Homo sapiens
  misc_feature: GYAE6OF01EFLVU.1.89.I01.1.454.CMB.1.raw
  modified_base (169)..(177): a, c, t, g, unknown or other
  misc_feature (169)..(177): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctcacgtagcgtgctgagcgggctggcaaggcgcatagnnnnnnnnn

SEQ ID NO: 86753 - DNA, 226 bp, Homo sapiens
  misc_feature: GYAE6OF01DKQD5.1.89.I01.1.454.CMB.1.raw
  modified_base (57)..(57): a, c, t, g, unknown or other
  misc_feature (57)..(57): n is a, c, g, or t
  modified_base (166)..(168): a, c, t, g, unknown or other
  misc_feature (166)..(168): n is a, c, g, or t
  modified_base (170)..(226): a, c, t, g, unknown or other
  misc_feature (170)..(226): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttccacctctctactgctagtctgagcgggctggcaaggcgcatagnnngnnnnnnnnnnnnnnnnnnnnnnnnnnnnnnnnnnnnnnnnnnnnnnnnnnnnnnnnn

SEQ ID NO: 86754 - DNA, 221 bp, Homo sapiens; identical to SEQ ID NO: 86578
  misc_feature: GYAE6OF01EUBQC.1.89.I01.1.454.CMB.1.raw
  modified_base (219)..(221): a, c, t, g, unknown or other
  misc_feature (219)..(221): n is a, c, g, or t

SEQ ID NO: 86755 - DNA, 331 bp, Homo sapiens
  misc_feature: GYAE6OF01D8N17.1.89.I01.1.454.CMB.1.raw
  modified_base (327)..(331): a, c, t, g, unknown or other
  misc_feature (327)..(331): n is a, c, g, or t
tcagacgagtgcgtcacgaccggtgctcgatttagtatgctagtatcgcgggctcctcatttttgacaatgataaacgaccctcaggaatttctgaccgattctctggctccaagtctggcctgtcagcctccctgggcatcaccggactccaaactggggacgaggccgattattactgcgagacatgggatagtaacttgaatgttgggcgattcggcggagggaccaagttgaccgtcctaggtcagcccaaggccaaccccactgtcactctgttcccaccctcctcctcgtctctactgagcgggctggcaaggcgcatagnnnnn

SEQ ID NO: 86756 - DNA, 199 bp, Homo sapiens
  misc_feature: GYAE6OF01BS55M.1.89.I01.1.454.CMB.1.raw
  modified_base (172)..(199): a, c, t, g, unknown or other
  misc_feature (172)..(199): n is a, c, g, or t
tcagacgagtgcgtcacgaccggtgctcgatttagtatgctagtatcgcgggggggtgttcggcggagggaccaaactgaccgtcctaggtcagcccaaggcctgccccctcggtcactctgttcccgccctctctgtcgagcgtctgagcgggctggcaaggcgtcatagnnnnnnnnnnnnnnnnnnnnnnnnnnnn

SEQ ID NO: 86757 - DNA, 171 bp, Homo sapiens; identical to SEQ ID NO: 86706
  misc_feature: GYAE6OF01CQ6MF.1.89.I01.1.454.CMB.1.raw
  modified_base (171)..(171): a, c, t, g, unknown or other
  misc_feature (171)..(171): n is a, c, g, or t

SEQ ID NO: 86758 - DNA, 170 bp, Homo sapiens; identical to SEQ ID NO: 86404
  misc_feature: GYAE6OF01E3741.1.89.I01.1.454.CMB.1.raw
  modified_base (170)..(170): a, c, t, g, unknown or other
  misc_feature (170)..(170): n is a, c, g, or t

SEQ ID NO: 86759 - DNA, 221 bp, Homo sapiens
  misc_feature: GYAE6OF01CQHR0.1.89.I01.1.454.CMB.1.raw
  modified_base (56)..(56): a, c, t, g, unknown or other
  misc_feature (56)..(56): n is a, c, g, or t
  modified_base (162)..(162): a, c, t, g, unknown or other
  misc_feature (162)..(162): n is a, c, g, or t
  modified_base (168)..(221): a, c, t, g, unknown or other
  misc_feature (168)..(221): n is a, c, g, or t
tcagacgagtgcgtcacgaccggtgctcgatttagtatgctagtatcgcgggggtnttcggcggagggaccaaactgaccgtcctaggtcagcccaaggctgccccctggtcactctgttcccgccctcctctactgctagtctgagcgggctggcaaggcncatagnnnnnnnnnnnnnnnnnnnnnnnnnnnnnnnnnnnnnnnnnnnnnnnnnnnnnn

SEQ ID NO: 86760 - DNA, 170 bp, Homo sapiens; identical to SEQ ID NO: 86381
  misc_feature: GYAE6OF01BU8K1.1.89.I01.1.454.CMB.1.raw
  modified_base (170)..(170): a, c, t, g, unknown or other
  misc_feature (170)..(170): n is a, c, g, or t

SEQ ID NO: 86761 - DNA, 201 bp, Homo sapiens
  misc_feature: GYAE6OF01BNO04.1.89.I01.1.454.CMB.1.raw
  modified_base (171)..(201): a, c, t, g, unknown or other
  misc_feature (171)..(201): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctcgtactgcgctgagcgggctggcaaggcgctatagnnnnnnnnnnnnnnnnnnnnnnnnnnnnnnn

SEQ ID NO: 86762 - DNA, 170 bp, Homo sapiens; identical to SEQ ID NO: 86730
  misc_feature: GYAE6OF01B1SG7.1.89.I01.1.454.CMB.1.raw
  modified_base (169)..(170): a, c, t, g, unknown or other
  misc_feature (169)..(170): n is a, c, g, or t

SEQ ID NO: 86763 - DNA, 171 bp, Homo sapiens
  misc_feature: GYAE6OF01DZD2L.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagn

SEQ ID NO: 86764 - DNA, 170 bp, Homo sapiens; identical to SEQ ID NO: 86433
  misc_feature: GYAE6OF01DPJN9.1.89.I01.1.454.CMB.1.raw
  modified_base (170)..(170): a, c, t, g, unknown or other
  misc_feature (170)..(170): n is a, c, g, or t

SEQ ID NO: 86765 - DNA, 172 bp, Homo sapiens
  misc_feature: GYAE6OF01CVUPX.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctgtcgagcgtctgagcgggctggcaaggcgcatagnn

SEQ ID NO: 86766 - DNA, 206 bp, Homo sapiens
  misc_feature: GYAE6OF01DGDVH.1.89.I01.1.454.CMB.1.raw
  modified_base (126)..(126): a, c, t, g, unknown or other
  misc_feature (126)..(126): n is a, c, g, or t
  modified_base (181)..(181): a, c, t, g, unknown or other
  misc_feature (181)..(181): n is a, c, g, or t
  modified_base (186)..(206): a, c, t, g, unknown or other
  misc_feature (186)..(206): n is a, c, g, or t
tcagacgagtgcgtcacgaccggtgctcgatttagtatgctagtatgggagtgacagcctgagtgcccttatgtcttcggaactgggaccaaggtcaccgtctaggtcagcccaaggccaaccccnctgtcactctgttcccaccctcctctctctcgactctgagcgggctggcaaggcncatgnnnnnnnnnnnnnnnnnnnnn

SEQ ID NO: 86767 - DNA, 218 bp, Homo sapiens
  misc_feature: GYAE6OF01A19D9.1.89.I01.1.454.CMB.1.raw
  modified_base (56)..(56): a, c, t, g, unknown or other
  misc_feature (56)..(56): n is a, c, g, or t
  modified_base (131)..(131): a, c, t, g, unknown or other
  misc_feature (131)..(131): n is a, c, g, or t
  modified_base (160)..(160): a, c, t, g, unknown or other
  misc_feature (160)..(160): n is a, c, g, or t
  modified_base (165)..(218): a, c, t, g, unknown or other
  misc_feature (165)..(218): n is a, c, g, or t
tcagacgagtgcgtcacgaccggtgctcgatttagtatgctagtatcgcgggggtnttcggcggagggaccaaactgaccgtcctaggtcagcccaaggctgccccctggtcactctgttcccacctcctntactgctagtctgagcggctggcaaggcncatgnnnnnnnnnnnnnnnnnnnnnnnnnnnnnnnnnnnnnnnnnnnnnnnnnnnnnn

SEQ ID NO: 86768 - DNA, 177 bp, Homo sapiens
  misc_feature: GYAE6OF01ALH1Q.1.89.I01.1.454.CMB.1.raw
  modified_base (170)..(177): a, c, t, g, unknown or other
  misc_feature (170)..(177): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnnnnnnnn

SEQ ID NO: 86769 - DNA, 170 bp, Homo sapiens; identical to SEQ ID NO: 86433
  misc_feature: GYAE6OF01AZ6D8.1.89.I01.1.454.CMB.1.raw
  modified_base (170)..(170): a, c, t, g, unknown or other
  misc_feature (170)..(170): n is a, c, g, or t

SEQ ID NO: 86770 - DNA, 194 bp, Homo sapiens
  misc_feature: GYAE6OF01C4OTK.1.89.I01.1.454.CMB.1.raw
  modified_base (189)..(194): a, c, t, g, unknown or other
  misc_feature (189)..(194): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggcccaaccccactgtcactctcgttcccgccctcctctctctcgactctgagcgggctggcaaggcgcatagnnnnnn

SEQ ID NO: 86771 - DNA, 196 bp, Homo sapiens
  misc_feature: GYAE6OF01DB9I3.1.89.I01.1.454.CMB.1.raw
  modified_base (59)..(59): a, c, t, g, unknown or other
  misc_feature (59)..(59): n is a, c, g, or t
  modified_base (169)..(196): a, c, t, g, unknown or other
  misc_feature (169)..(196): n is a, c, g, or t
tcagacgagtgcgtcacgaccggtgctcgatttagtatgctagtagtcgcgggggggtnttcggcggagggaccaaactgaccgtctaggtcagcccaaggctgccccctgtcactctgttcccaccctcctctactgctagtctgagcggctggctaaggcgcatagnnnnnnnnnnnnnnnnnnnnnnnnnnnn

SEQ ID NO: 86772 - DNA, 194 bp, Homo sapiens
  misc_feature: GYAE6OF01ESAM6.1.89.I01.1.454.CMB.1.raw
  modified_base (174)..(194): a, c, t, g, unknown or other
  misc_feature (174)..(194): n is a, c, g, or t
tcagacgagtgcgtcacgaccggtgctcgatttagtatgctagtatcggcggggggggtgttcgggcggagggaccaaactgaccgtcctaggtcagcccaaggctgccccctggtcactctgttcccacccttcctctactgctagtctgagcgggctggcaaggcgcatagnnnnnnnnnnnnnnnnnnnnn

SEQ ID NO: 86773 - DNA, 208 bp, Homo sapiens
  misc_feature: GYAE6OF01D0C80.1.89.I01.1.454.CMB.1.raw
  modified_base (170)..(208): a, c, t, g, unknown or other
  misc_feature (170)..(208): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctactgctgacgcgggctggcaaggcgcatagnnnnnnnnnnnnnnnnnnnnnnnnnnnnnnnnnnnnnnn

SEQ ID NO: 86774 - DNA, 172 bp, Homo sapiens
  misc_feature: GYAE6OF01C45EJ.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcgagtgcgtctctgagcgggctggcaaggcgcatagnnn

SEQ ID NO: 86775 - DNA, 172 bp, Homo sapiens; identical to SEQ ID NO: 86765
  misc_feature: GYAE6OF01DC1NE.1.89.I01.1.454.CMB.1.raw
  modified_base (171)..(172): a, c, t, g, unknown or other
  misc_feature (171)..(172): n is a, c, g, or t

SEQ ID NO: 86776 - DNA, 183 bp, Homo sapiens
  misc_feature: GYAE6OF01CMRLG.1.89.I01.1.454.CMB.1.raw
  modified_base (146)..(146): a, c, t, g, unknown or other
  misc_feature (146)..(146): n is a, c, g, or t
  modified_base (173)..(183): a, c, t, g, unknown or other
  misc_feature (173)..(183): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctcgttcccacctcctcatagcgtactntgaggcgggctggacaaggcgcatagnnnnnnnnnnn

SEQ ID NO: 86777 - DNA, 170 bp, Homo sapiens
  misc_feature: GYAE6OF01C1UGL.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtaagcccaaggctgcccctcggtcactctgttcccaccctcctcacgtagcgtgctgagcgggctggcaaggcgcatagnn

SEQ ID NO: 86778 - DNA, 168 bp, Homo sapiens
  misc_feature: GYAE6OF01CVMXI.1.89.I01.1.454.CMB.1.raw
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctactgctgagcgggctggcaaggcgcatag

SEQ ID NO: 86779 - DNA, 174 bp, Homo sapiens
  misc_feature: GYAE6OF01BOM4R.1.89.I01.1.454.CMB.1.raw
  modified_base (167)..(174): a, c, t, g, unknown or other
  misc_feature (167)..(174): n is a, c, g, or t
tcagacgagtgcgtcacgaccggtgctcgatttagtatgctagtatcgcggggaatgttcggcggggaccaagctgaccgtcttaggtcagcccaaggctgccccctggtcactctgttcccaccctcctctgtcgagcgtctgagcgggctggcaaggcgcatagnnnnnnnn

SEQ ID NO: 86780 - DNA, 246 bp, Homo sapiens
  misc_feature: GYAE6OF01ALGWP.1.89.I01.1.454.CMB.1.raw
  modified_base (239)..(246): a, c, t, g, unknown or other
  misc_feature (239)..(246): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaacccactgtcactctgttcccgccctcctctcgtagcactctgagcgggctggcaaggcgcatagnnnnnnnn

SEQ ID NO: 86781 - DNA, 189 bp, Homo sapiens; identical to SEQ ID NO: 86457
  misc_feature: GYAE6OF01AZWEO.1.89.I01.1.454.CMB.1.raw
  modified_base (187)..(189): a, c, t, g, unknown or other
  misc_feature (187)..(189): n is a, c, g, or t

SEQ ID NO: 86782 - DNA, 170 bp, Homo sapiens
  misc_feature: GYAE6OF01B692R.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctactgctagtctgagcgggctggcaaggcgcatagnn

SEQ ID NO: 86783 - DNA, 171 bp, Homo sapiens
  misc_feature: GYAE6OF01CXE2G.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatagn

SEQ ID NO: 86784 - DNA, 191 bp, Homo sapiens
  misc_feature: GYAE6OF01EF3O5.1.89.I01.1.454.CMB.1.raw
  modified_base (173)..(191): a, c, t, g, unknown or other
  misc_feature (173)..(191): n is a, c, g, or t
tcagacgagtgcgtcacgaccggtgctcgatttagtatgctagtatcggcggggggggtgttcggcggagggaccaaactgaccgtcctaggtcagcccaaggctgccccctcggtcactctgttcccgccctcctcgagtgcgtctctgagcgggctggcaaggcgcatagnnnnnnnnnnnnnnnnnnn

SEQ ID NO: 86785 - DNA, 352 bp, Homo sapiens
  misc_feature: GYAE6OF01BFOZG.1.89.I01.1.454.CMB.1.raw
  modified_base (344)..(352): a, c, t, g, unknown or other
  misc_feature (344)..(352): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnnnn

SEQ ID NO: 86786 - DNA, 170 bp, Homo sapiens
  misc_feature: GYAE6OF01DHO1J.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtattgcggggggtgttcggcggagggaccaaactgaccgtcctaggtcagcccaaggctgccccctcggtcactctgttcccgccctcctcatagcgtactctgagcgggctggcaaggcgcatagn

SEQ ID NO: 86787 - DNA, 170 bp, Homo sapiens; identical to SEQ ID NO: 86433
  misc_feature: GYAE6OF01BR5CA.1.89.I01.1.454.CMB.1.raw
  modified_base (170)..(170): a, c, t, g, unknown or other
  misc_feature (170)..(170): n is a, c, g, or t

SEQ ID NO: 86788 - DNA, 356 bp, Homo sapiens
  misc_feature: GYAE6OF01EIQ3J.1.89.I01.1.454.CMB.1.raw
  modified_base (345)..(356): a, c, t, g, unknown or other
  misc_feature (345)..(356): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagacgcacctctgggggccacagcggcctgggctgcctggtcaaggactacttcctctctcgactctgagcgggctggcaaggcgcatagnnnnnnnnnnnn

SEQ ID NO: 86789 - DNA, 224 bp, Homo sapiens
  misc_feature: GYAE6OF01D0988.1.89.I01.1.454.CMB.1.raw
  modified_base (58)..(58): a, c, t, g, unknown or other
  misc_feature (58)..(58): n is a, c, g, or t
  modified_base (163)..(163): a, c, t, g, unknown or other
  misc_feature (163)..(163): n is a, c, g, or t
  modified_base (169)..(224): a, c, t, g, unknown or other
  misc_feature (169)..(224): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccaccctcctctactgctagtctgagcggctggcaaggcncatagnnnnnnnnnnnnnnnnnnnnnnnnnnnnnnnnnnnnnnnnnnnnnnnnnnnnnnnn

SEQ ID NO: 86790 - DNA, 172 bp, Homo sapiens
  misc_feature: GYAE6OF01APVS0.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcgggctggcaaggcgcatagnnnn

SEQ ID NO: 86791 - DNA, 215 bp, Homo sapiens
  misc_feature: GYAE6OF01AIX2R.1.89.I01.1.454.CMB.1.raw
  modified_base (174)..(215): a, c, t, g, unknown or other
  misc_feature (174)..(215): n is a, c, g, or t
tcagacgagtgcgtcacgaccggtgctcgatttagtatgctagtatcggcggggggtgttcggcggagggaccaaactgaccggtcctaggtcaagcccaaggctgccccctcggtcactctgttctcgccctcctcatagcgtactctgagcgggctgggcaaggcgcatagnnnnnnnnnnnnnnnnnnnnnnnnnnnnnnnnnnnnnnnnnn

SEQ ID NO: 86792 - DNA, 188 bp, Homo sapiens
  misc_feature: GYAE6OF01BAGX3.1.89.I01.1.454.CMB.1.raw
  modified_base (186)..(188): a, c, t, g, unknown or other
  misc_feature (186)..(188): n is a, c, g, or t
tcagacgagtgcgtcacgaccggtgctcgatttagtatgctagtatcgcggggacattctgcgtgcttgggtgttcggcggagggaccaagctgaccgtcctaggtcagcccaaggctgccccctcggtcactctgttcccaccctcctcacgcactcgtctgagcgggctggcaaggcgcatagnnn

SEQ ID NO: 86793 - DNA, 169 bp, Homo sapiens; identical to SEQ ID NO: 86285
  misc_feature: GYAE6OF01DY80H.1.89.I01.1.454.CMB.1.raw
  modified_base (169)..(169): a, c, t, g, unknown or other
  misc_feature (169)..(169): n is a, c, g, or t

SEQ ID NO: 86794 - DNA, 187 bp, Homo sapiens
  misc_feature: GYAE6OF01B7MR2.1.89.I01.1.454.CMB.1.raw
  modified_base (170)..(187): a, c, t, g, unknown or other
  misc_feature (170)..(187): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctctactgctagtctgagcgggctggcaaggcgcatagnnnnnnnnnnnnnnnnnn

SEQ ID NO: 86795 - DNA, 248 bp, Homo sapiens
  misc_feature: GYAE6OF01B1RZ7.1.89.I01.1.454.CMB.1.raw
  modified_base (60)..(60): a, c, t, g, unknown or other
  misc_feature (60)..(60): n is a, c, g, or t
  modified_base (141)..(141): a, c, t, g, unknown or other
  misc_feature (141)..(141): n is a, c, g, or t
  modified_base (180)..(182): a, c, t, g, unknown or other
  misc_feature (180)..(182): n is a, c, g, or t
  modified_base (184)..(184): a, c, t, g, unknown or other
  misc_feature (184)..(184): n is a, c, g, or t
  modified_base (186)..(187): a, c, t, g, unknown or other
  misc_feature (186)..(187): n is a, c, g, or t
  modified_base (190)..(191): a, c, t, g, unknown or other
  misc_feature (190)..(191): n is a, c, g, or t
  modified_base (193)..(194): a, c, t, g, unknown or other
  misc_feature (193)..(194): n is a, c, g, or t
  modified_base (196)..(248): a, c, t, g, unknown or other
  misc_feature (196)..(248): n is a, c, g, or t
tcagacgagtgcgtcacgaccggtgctcgatttagtatgctagtatcggcggggggggtnttcgggcggagggaccaaactgaccgtcctaggtcagcccaaggtctgcccccctggtcacctctgttcccacccttcctntactgctagtctgagcgggctgggcaagggcgtcatagnnnancnntgnntnngnnnnnnnnnnnnnnnnnnnnnnnnnnnnnnnnnnnnnnnnnnnnnnnnnnnnn

SEQ ID NO: 86796 - DNA, 170 bp, Homo sapiens; identical to SEQ ID NO: 86531
  misc_feature: GYAE6OF01E5ECL.1.89.I01.1.454.CMB.1.raw
  modified_base (170)..(170): a, c, t, g, unknown or other
  misc_feature (170)..(170): n is a, c, g, or t

SEQ ID NO: 86797 - DNA, 172 bp, Homo sapiens; identical to SEQ ID NO: 86765
  misc_feature: GYAE6OF01CD0VQ.1.89.I01.1.454.CMB.1.raw
  modified_base (171)..(172): a, c, t, g, unknown or other
  misc_feature (171)..(172): n is a, c, g, or t

SEQ ID NO: 86798 - DNA, 170 bp, Homo sapiens; identical to SEQ ID NO: 86604
  misc_feature: GYAE6OF01CZHH0.1.89.I01.1.454.CMB.1.raw
  modified_base (169)..(170): a, c, t, g, unknown or other
  misc_feature (169)..(170): n is a, c, g, or t

SEQ ID NO: 86799 - DNA, 171 bp, Homo sapiens; identical to SEQ ID NO: 86525
  misc_feature: GYAE6OF01EB7EI.1.89.I01.1.454.CMB.1.raw
  modified_base (170)..(171): a, c, t, g, unknown or other
  misc_feature (170)..(171): n is a, c, g, or t

SEQ ID NO: 86800 - DNA, 171 bp, Homo sapiens; identical to SEQ ID NO: 86606
  misc_feature: GYAE6OF01DVSWS.1.89.I01.1.454.CMB.1.raw
  modified_base (170)..(171): a, c, t, g, unknown or other
  misc_feature (170)..(171): n is a, c, g, or t

SEQ ID NO: 86801 - DNA, 194 bp, Homo sapiens
  misc_feature: GYAE6OF01EUI0F.1.89.I01.1.454.CMB.1.raw
  modified_base (175)..(194): a, c, t, g, unknown or other
  misc_feature (175)..(194): n is a, c, g, or t
tcagacgagtgcgtcacgaccggtgctcgattttagtatgctagtatcggcgggggggtgttccggcggagggaccaaactgaccgtcctaggtcagcccaaggctcgccccctggtcactctggttcccgccctcctctgtcgagcgtctgagcgggctggcaaggcgcatagnnnnnnnnnnnnnnnnnnnn

SEQ ID NO: 86802 - DNA, 182 bp, Homo sapiens
  misc_feature: GYAE6OF01ATTY4.1.89.I01.1.454.CMB.1.raw
  modified_base (170)..(182): a, c, t, g, unknown or other
  misc_feature (170)..(182): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcacgtctactgctgagcgggctggcaaggcgcatagnnnnnnnnnnnnn

SEQ ID NO: 86803 - DNA, 170 bp, Homo sapiens
  misc_feature: GYAE6OF01EZL8J.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatag

SEQ ID NO: 86804 - DNA, 172 bp, Homo sapiens
  misc_feature: GYAE6OF01AX3FE.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagnnn

SEQ ID NO: 86805 - DNA, 195 bp, Homo sapiens
  misc_feature: GYAE6OF01EQNO1.1.89.I01.1.454.CMB.1.raw
  modified_base (172)..(195): a, c, t, g, unknown or other
  misc_feature (172)..(195): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcctacagtgctctgagcgggctggcaaggcgcatagcnnnnnnnnnnnnnnnnnnnnnnnn

SEQ ID NO: 86806 - DNA, 171 bp, Homo sapiens
  misc_feature: GYAE6OF01CDKE9.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactttgttcccaccctcctctactgctagtctgagcgggctggcaaggcgcatagn

SEQ ID NO: 86807 - DNA, 187 bp, Homo sapiens; identical to SEQ ID NO: 86384
  misc_feature: GYAE6OF01D89LS.1.89.I01.1.454.CMB.1.raw
  modified_base (187)..(187): a, c, t, g, unknown or other
  misc_feature (187)..(187): n is a, c, g, or t

SEQ ID NO: 86808 - DNA, 393 bp, Homo sapiens
  misc_feature: GYAE6OF01AHF9B.1.89.I01.1.454.CMB.1.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (335)..(335): a, c, t, g, unknown or other
  misc_feature (335)..(335): n is a, c, g, or t
  modified_base (344)..(355): a, c, t, g, unknown or other
  misc_feature (344)..(355): n is a, c, g, or t
  modified_base (357)..(358): a, c, t, g, unknown or other
  misc_feature (357)..(358): n is a, c, g, or t
  modified_base (360)..(393): a, c, t, g, unknown or other
  misc_feature (360)..(393): n is a, c, g, or t
tcagacgagtgcgtcacgaccggtgctcgatttagtatgctagtatgggcacgaccgacctgagctcaggaggcagcagagcgagggaggaggagaggccccgaggtgaacggaggggcttgtccaggccggcagcatcaccggagcccagggcagggtcagcagtgctggccgtggggccctcctctcagccaggaccaaggacagcagcctccaccaagggcccatcggtctcccctggcaccctctcaagngcaccnctggggcacngcggcctggctgcctggcaggactacttccgagtcgcgtctctgagcggggctgggcaagggccncgagtaggnnnnnnnnnnnntnncnnnnnnnnnnnnnnnnnnnnnnnnnnnnnnnnnn

SEQ ID NO: 86809 - DNA, 174 bp, Homo sapiens
  misc_feature: GYAE6OF01CFAIZ.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctctactgctagtctgagcgggctggcaaggcgcatagnnnn

SEQ ID NO: 86810 - DNA, 169 bp, Homo sapiens; identical to SEQ ID NO: 86285
  misc_feature: GYAE6OF01CLBY6.1.89.I01.1.454.CMB.1.raw
  modified_base (169)..(169): a, c, t, g, unknown or other
  misc_feature (169)..(169): n is a, c, g, or t

SEQ ID NO: 86811 - DNA, 190 bp, Homo sapiens
  misc_feature: GYAE6OF01BCBL8.1.89.I01.1.454.CMB.1.raw
  modified_base (186)..(190): a, c, t, g, unknown or other
  misc_feature (186)..(190): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaacccactgtcactctgttcccaccctcctcacgtagcgtgctgagcgggctggcaaggcgcatagnnnnn

SEQ ID NO: 86812 - DNA, 208 bp, Homo sapiens
  misc_feature: GYAE6OF01D9P2J.1.89.I01.1.454.CMB.1.raw
  modified_base (128)..(128): a, c, t, g, unknown or other
  misc_feature (128)..(128): n is a, c, g, or t
  modified_base (188)..(208): a, c, t, g, unknown or other
  misc_feature (188)..(208): n is a, c, g, or t
tcagacgagtgcgtcacgaccggtgctcgatttagtatgctagtatgggatgacgagcctgagtgcccttatgtcttcggaactgggaccaaggtcaccgtcctaggtcagcccaaggccaaccccgntgtcactctgttcccaccctcctctctctcgactctgagcgggctggcaaggcgcatagnnnnnnnnnnnnnnnnnnnnn

SEQ ID NO: 86813 - DNA, 224 bp, Homo sapiens
  misc_feature: GYAE6OF01A3KJK.1.89.I01.1.454.CMB.1.raw
  modified_base (57)..(57): a, c, t, g, unknown or other
  misc_feature (57)..(57): n is a, c, g, or t
  modified_base (163)..(163): a, c, t, g, unknown or other
  misc_feature (163)..(163): n is a, c, g, or t
  modified_base (169)..(224): a, c, t, g, unknown or other
  misc_feature (169)..(224): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttcccaccctcctctactgctagtctgagcgggctggcaaggcncatagnnnnnnnnnnnnnnnnnnnnnnnnnnnnnnnnnnnnnnnnnnnnnnnnnnnnnnnn

SEQ ID NO: 86814 - DNA, 172 bp, Homo sapiens
  misc_feature: GYAE6OF01CUE0U.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctctcgtactgcgctgagcgggctggcaaggcgcatagnnn

SEQ ID NO: 86815 - DNA, 350 bp, Homo sapiens
  misc_feature: GYAE6OF01DUXXA.1.89.I01.1.454.CMB.1.raw
  modified_base (342)..(350): a, c, t, g, unknown or other
  misc_feature (342)..(350): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtcttccccctggccaccctcctccaagagcacctctgggggcacagcggcctggctgcctggtcaaggactacttccgagtgcgtctctgagcgggctggcaaggcgcatagnnnnnnnnn

SEQ ID NO: 86816 - DNA, 352 bp, Homo sapiens
  misc_feature: GYAE6OF01DBWKJ.1.89.I01.1.454.CMB.1.raw
  modified_base (346)..(352): a, c, t, g, unknown or other
  misc_feature (346)..(352): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtccttccccctggccaccctcctccaagagcacctctggggcacagcggccctgggctgcctggtcaaggactacttccgagtgcgtctctgagcgggctggacaaggcgcatagnnnnnnn

SEQ ID NO: 86817 - DNA, 210 bp, Homo sapiens
  misc_feature: GYAE6OF01D3GVV.1.89.I01.1.454.CMB.1.raw
  modified_base (57)..(57): a, c, t, g, unknown or other
  misc_feature (57)..(57): n is a, c, g, or t
  modified_base (167)..(210): a, c, t, g, unknown or other
  misc_feature (167)..(210): n is a, c, g, or t
tcagacgagtgcgtcacgaccggtgctcgatttagtatgctagtatcgcggggggtnttcggcggagggaccaaactgaccgtcctaggtcagcccaaggctgcccctggtcactctgttcccaccctctcatagcgtactctgagcgggctggcaaggcgcatagnnnnnnnnnnnnnnnnnnnnnnnnnnnnnnnnnnnnnnnnnnnn

SEQ ID NO: 86818 - DNA, 259 bp, Homo sapiens
  misc_feature: GYAE6OF01CEL7H.1.89.I01.1.454.CMB.1.raw
  modified_base (254)..(259): a, c, t, g, unknown or other
  misc_feature (254)..(259): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgccccctggtcactctgttcccgccatctgaatagcgtactctgagcgggctggcaaggcgcatagnnnnnn

SEQ ID NO: 86819 - DNA, 170 bp, Homo sapiens; identical to SEQ ID NO: 86417
  misc_feature: GYAE6OF01B60A4.1.89.I01.1.454.CMB.1.raw
  modified_base (170)..(170): a, c, t, g, unknown or other
  misc_feature (170)..(170): n is a, c, g, or t

SEQ ID NO: 86820 - DNA, 173 bp, Homo sapiens
  misc_feature: GYAE6OF01DA97G.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcacgtctactgctgagcgggctggcaaggcgcatagnnn

SEQ ID NO: 86821 - DNA, 174 bp, Homo sapiens
  misc_feature: GYAE6OF01A4G3K.1.89.I01.1.454.CMB.1.raw
  modified_base (169)..(174): a, c, t, g, unknown or other
  misc_feature (169)..(174): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctactgctgagcgggctggcaaggcgcatagnnnnnn

SEQ ID NO: 86822 - DNA, 171 bp, Homo sapiens; identical to SEQ ID NO: 86706
  misc_feature: GYAE6OF01C30TH.1.89.I01.1.454.CMB.1.raw
  modified_base (171)..(171): a, c, t, g, unknown or other
  misc_feature (171)..(171): n is a, c, g, or t

SEQ ID NO: 86823 - DNA, 171 bp, Homo sapiens
  misc_feature: GYAE6OF01BC8FU.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctactgctagtctgagcgggctggcaaggcgcatagngg

SEQ ID NO: 86824 - DNA, 171 bp, Homo sapiens; identical to SEQ ID NO: 86391
  misc_feature: GYAE6OF01C0UQB.1.89.I01.1.454.CMB.1.raw
  modified_base (170)..(171): a, c, t, g, unknown or other
  misc_feature (170)..(171): n is a, c, g, or t

SEQ ID NO: 86825 - DNA, 190 bp, Homo sapiens
  misc_feature: GYAE6OF01A999L.1.89.I01.1.454.CMB.1.raw
  modified_base (187)..(190): a, c, t, g, unknown or other
  misc_feature (187)..(190): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctcacgtagcgtgctgagcgggctggcaaggcgcatagnnnn

SEQ ID NO: 86826 - DNA, 197 bp, Homo sapiens
  misc_feature: GYAE6OF01CI8YM.1.89.I01.1.454.CMB.1.raw
  modified_base (172)..(197): a, c, t, g, unknown or other
  misc_feature (172)..(197): n is a, c, g, or t
tcagacgagtgcgtcacgaccggtgctcgatttagtatgctagtatcgcggggggtgttcggcggagggaccaaactgaccgtcctaggtctagcccaaggctgccccctcggtcactctgttccacctcctcacgtagcgtgctggagcgggctggctaaggcgcattagnnnnnnnnnnnnnnnnnnnnnnnnnn

SEQ ID NO: 86827 - DNA, 188 bp, Homo sapiens; identical to SEQ ID NO: 86724
  misc_feature: GYAE6OF01ECVI4.1.89.I01.1.454.CMB.1.raw
  modified_base (187)..(188): a, c, t, g, unknown or other
  misc_feature (187)..(188): n is a, c, g, or t

SEQ ID NO: 86828 - DNA, 171 bp, Homo sapiens; identical to SEQ ID NO: 86706
  misc_feature: GYAE6OF01ADBLL.1.89.I01.1.454.CMB.1.raw
  modified_base (171)..(171): a, c, t, g, unknown or other
  misc_feature (171)..(171): n is a, c, g, or t

SEQ ID NO: 86829 - DNA, 171 bp, Homo sapiens; identical to SEQ ID NO: 86763
  misc_feature: GYAE6OF01ETNDK.1.89.I01.1.454.CMB.1.raw
  modified_base (171)..(171): a, c, t, g, unknown or other
  misc_feature (171)..(171): n is a, c, g, or t

SEQ ID NO: 86830 - DNA, 352 bp, Homo sapiens
  misc_feature: GYAE6OF01BS451.1.89.I01.1.454.CMB.1.raw
  modified_base (339)..(339): a, c, t, g, unknown or other
  misc_feature (339)..(339): n is a, c, g, or t
  modified_base (344)..(352): a, c, t, g, unknown or other
  misc_feature (344)..(352): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctggggcacagccggccctgggctgcctggtcaaggactacttccgagtgcgtctctgagcgggctggcaaggcgnatagnnnnnnnnn

SEQ ID NO: 86831 - DNA, 171 bp, Homo sapiens
  misc_feature: GYAE6OF01BOA1I.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccgccctcctcatagcgtactctgagcgggctggcaaggcgcatagn

SEQ ID NO: 86832 - DNA, 171 bp, Homo sapiens
  misc_feature: GYAE6OF01BZ71E.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcgagtgcgtctctgagcgggctggcaaggcgcatagn

SEQ ID NO: 86833 - DNA, 179 bp, Homo sapiens
  misc_feature: GYAE6OF01DB8R7.1.89.I01.1.454.CMB.1.raw
  modified_base (172)..(179): a, c, t, g, unknown or other
  misc_feature (172)..(179): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccaccctcctcatagcgtactctgagcgggctggcaaggcgcatagnnnnnnnn

SEQ ID NO: 86834 - DNA, 172 bp, Homo sapiens; identical to SEQ ID NO: 86593
  misc_feature: GYAE6OF01DYPYK.1.89.I01.1.454.CMB.1.raw
  modified_base (171)..(172): a, c, t, g, unknown or other
  misc_feature (171)..(172): n is a, c, g, or t

SEQ ID NO: 86835 - DNA, 197 bp, Homo sapiens
  misc_feature: GYAE6OF01E1E0B.1.89.I01.1.454.CMB.1.raw
  modified_base (183)..(183): a, c, t, g, unknown or other
  misc_feature (183)..(183): n is a, c, g, or t
  modified_base (192)..(193): a, c, t, g, unknown or other
  misc_feature (192)..(193): n is a, c, g, or t
  modified_base (195)..(197): a, c, t, g, unknown or other
  misc_feature (195)..(197): n is a, c, g, or t
tcagacgagtgcgtcacgaccggtgctcgatttagtatgctagtattcggtcggggggggtagttcgggacggagggaccaaaccgtccgaccggtccttaggtaagcccaaggcgtgccccctggtcacctcgtgttcccaccctccgtcaacgtagcgtgctgagcgggctggcaagggcncgataaggnnannn

SEQ ID NO: 86836 - DNA, 170 bp, Homo sapiens; identical to SEQ ID NO: 86417
  misc_feature: GYAE6OF01BCVL8.1.89.I01.1.454.CMB.1.raw
  modified_base (170)..(170): a, c, t, g, unknown or other
  misc_feature (170)..(170): n is a, c, g, or t

SEQ ID NO: 86837 - DNA, 267 bp, Homo sapiens
  misc_feature: GYAE6OF01A8KWO.1.89.I01.1.454.CMB.1.raw
  modified_base (235)..(235): a, c, t, g, unknown or other
  misc_feature (235)..(235): n is a, c, g, or t
  modified_base (241)..(244): a, c, t, g, unknown or other
  misc_feature (241)..(244): n is a, c, g, or t
  modified_base (246)..(246): a, c, t, g, unknown or other
  misc_feature (246)..(246): n is a, c, g, or t
  modified_base (248)..(267): a, c, t, g, unknown or other
  misc_feature (248)..(267): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccgactgtcactctgttcccaccctcctctcgtagcactctgagcgggctggcaaggcncatagnnnnancnnnnnnnnnnnnnnnnnnnn

SEQ ID NO: 86838 - DNA, 188 bp, Homo sapiens; identical to SEQ ID NO: 86724
  misc_feature: GYAE6OF01EMO6O.1.89.I01.1.454.CMB.1.raw
  modified_base (187)..(188): a, c, t, g, unknown or other
  misc_feature (187)..(188): n is a, c, g, or t

SEQ ID NO: 86839 - DNA, 208 bp, Homo sapiens
  misc_feature: GYAE6OF01C85PP.1.89.I01.1.454.CMB.1.raw
  modified_base (59)..(59): a, c, t, g, unknown or other
  misc_feature (59)..(59): n is a, c, g, or t
  modified_base (170)..(208): a, c, t, g, unknown or other
  misc_feature (170)..(208): n is a, c, g, or t
tcagacgagtgcgtcacgaccggtgctcgatttagtatgctagtatcgcggggggggtnttcggcggagggaccaaactgaccgtcctaggtcagcccaaggctgccccctggtcactctgttcccaccctctctactgctagtctgagcgggctggcaaggcgcatagnnnnnnnnnnnnnnnnnnnnnnnnnnnnnnnnnnnnnnn

SEQ ID NO: 86840 - DNA, 174 bp, Homo sapiens
  misc_feature: GYAE6OF01ERKOU.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagnnnnn

SEQ ID NO: 86841 - DNA, 175 bp, Homo sapiens
  misc_feature: GYAE6OF01DXFXI.1.89.I01.1.454.CMB.1.raw
  modified_base (165)..(165): a, c, t, g, unknown or other
  misc_feature (165)..(165): n is a, c, g, or t
  modified_base (170)..(175): a, c, t, g, unknown or other
  misc_feature (170)..(175): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctcacgtagcgtgctgagcgggctggcaaggcncatgnnnnnn

SEQ ID NO: 86842 - DNA, 229 bp, Homo sapiens
  misc_feature: GYAE6OF01BMPZI.1.89.I01.1.454.CMB.1.raw
  modified_base (58)..(58): a, c, t, g, unknown or other
  misc_feature (58)..(58): n is a, c, g, or t
  modified_base (165)..(165): a, c, t, g, unknown or other
  misc_feature (165)..(165): n is a, c, g, or t
  modified_base (170)..(229): a, c, t, g, unknown or other
  misc_feature (170)..(229): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctcgttcccaccctcctctactgctagtctgagccggctggcaaggcncatgnnnnnnnnnnnnnnnnnnnnnnnnnnnnnnnnnnnnnnnnnnnnnnnnnnnnnnnnnnnn

SEQ ID NO: 86843 - DNA, 170 bp, Homo sapiens; identical to SEQ ID NO: 86452
  misc_feature: GYAE6OF01D8AIZ.1.89.I01.1.454.CMB.1.raw
  modified_base (170)..(170): a, c, t, g, unknown or other
  misc_feature (170)..(170): n is a, c, g, or t

SEQ ID NO: 86844 - DNA, 172 bp, Homo sapiens
  misc_feature: GYAE6OF01ELIBJ.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtaagcccaaggctgccccctcggtcactctgttcccaccctcctcacgtagcgtgctgagcgggctggcaaggcgcatagnn

SEQ ID NO: 86845 - DNA, 172 bp, Homo sapiens; identical to SEQ ID NO: 86593
  misc_feature: GYAE6OF01DSBI4.1.89.I01.1.454.CMB.1.raw
  modified_base (171)..(172): a, c, t, g, unknown or other
  misc_feature (171)..(172): n is a, c, g, or t

SEQ ID NO: 86846 - DNA, 189 bp, Homo sapiens
  misc_feature: GYAE6OF01DBWP0.1.89.I01.1.454.CMB.1.raw
  modified_base (171)..(189): a, c, t, g, unknown or other
  misc_feature (171)..(189): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcacgtagcgtgctgagcgggctggcaaggcgcatagnnnnnnnnnnnnnnnnnnn

SEQ ID NO: 86847 - DNA, 349 bp, Homo sapiens
  misc_feature: GYAE6OF01ANIKM.1.89.I01.1.454.CMB.1.raw
  modified_base (343)..(349): a, c, t, g, unknown or other
  misc_feature (343)..(349): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtcttccccctggccaccctcctccaagagcacctctgggggcacagcggccctgggctgcctggtcaaggctacttccgagtgcgtctctgagcgggctggcaaggcgcatagnnnnnnn

SEQ ID NO: 86848 - DNA, 188 bp, Homo sapiens
  misc_feature: GYAE6OF01CSHJJ.1.89.I01.1.454.CMB.1.raw
  modified_base (186)..(188): a, c, t, g, unknown or other
  misc_feature (186)..(188): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccatgtcactctgttcccgccctcctctatgtatactctgagcgggctggcaaggcgcatagnnn

SEQ ID NO: 86849 - DNA, 170 bp, Homo sapiens
  misc_feature: GYAE6OF01C3X7K.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctcatagcgtactctgagcgggctggcaaggcgcatagnn

SEQ ID NO: 86850 - DNA, 170 bp, Homo sapiens; identical to SEQ ID NO: 86404
  misc_feature: GYAE6OF01B7MB7.1.89.I01.1.454.CMB.1.raw
  modified_base (170)..(170): a, c, t, g, unknown or other
  misc_feature (170)..(170): n is a, c, g, or t

SEQ ID NO: 86851 - DNA, 172 bp, Homo sapiens; identical to SEQ ID NO: 86723
  misc_feature: GYAE6OF01BEF9S.1.89.I01.1.454.CMB.1.raw
  modified_base (171)..(172): a, c, t, g, unknown or other
  misc_feature (171)..(172): n is a, c, g, or t

SEQ ID NO: 86852 - DNA, 171 bp, Homo sapiens; identical to SEQ ID NO: 86391
  misc_feature: GYAE6OF01EUU4N.1.89.I01.1.454.CMB.1.raw
  modified_base (170)..(171): a, c, t, g, unknown or other
  misc_feature (170)..(171): n is a, c, g, or t

SEQ ID NO: 86853 - DNA, 357 bp, Homo sapiens
  misc_feature: GYAE6OF01AKY7N.1.89.I01.1.454.CMB.1.raw
  modified_base (347)..(357): a, c, t, g, unknown or other
  misc_feature (347)..(357): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggccaccctcctccaagacgcacctcgtgggggcacagccggcctgggctgcctggtcaaggactacttccgagtgcgtctctgagcgggctggcaaggcgcatagnnnnnnnnnnn

SEQ ID NO: 86854 - DNA, 192 bp, Homo sapiens
  misc_feature: GYAE6OF01BBTVT.1.89.I01.1.454.CMB.1.raw
  modified_base (170)..(192): a, c, t, g, unknown or other
  misc_feature (170)..(192): n is a, c, g, or t
tcagacgagtgcgtcacgaccggtgctcgatttagtatgctagtagtcgcggggggtgttcggcggagggaccaaactgaccgtcctaggtaagcccaaggctgccccctcggtcactctgttcccacctcctcacgtagcgtgctgagcgggctggcaaggcgcatagnnnnnnnnnnnnnnnnnnnnnnn

SEQ ID NO: 86855 - DNA, 270 bp, Homo sapiens
  misc_feature: GYAE6OF01EKW15.1.89.I01.1.454.CMB.1.raw
  modified_base (219)..(219): a, c, t, g, unknown or other
  misc_feature (219)..(219): n is a, c, g, or t
  modified_base (235)..(270): a, c, t, g, unknown or other
  misc_feature (235)..(270): n is a, c, g, or t
tcagacgagtgcgtcacgaccggtgctcgatttagtatgctagtagttcggcgggggcccaggcagatgatgagtctacttactagttgtgtcctttacttgcgtgatggcattttggctgttcggcggagggaccaaagtgaccgtcctgggtcaggcccaaggctggccccctggtcactctgttcccaccctcctctgtcgagcgtctgagcgggntggcaaggcgcatagnnnnnnnnnnnnnnnnnnnnnnnnnnnnnnnnnnnn

SEQ ID NO: 86856 - DNA, 221 bp, Homo sapiens
  misc_feature: GYAE6OF01A1DAX.1.89.I01.1.454.CMB.1.raw
  modified_base (173)..(221): a, c, t, g, unknown or other
  misc_feature (173)..(221): n is a, c, g, or t
tcagacgagtgcgtcacgaccggtgctcgatttagtatgctagtatcgcgggggggtgttcggcggtagggacctaactgaccgtcctaggtctagcccaaggctgccccctggtcactctgttacccaccctcctctatacgatcgctgagcgggctggcaaggcgcatagnnnnnnnnnnnnnnnnnnnnnnnnnnnnnnnnnnnnnnnnnnnnnnnnn

SEQ ID NO: 86857 - DNA, 172 bp, Homo sapiens; identical to SEQ ID NO: 86593
  misc_feature: GYAE6OF01DH81Y.1.89.I01.1.454.CMB.1.raw
  modified_base (171)..(172): a, c, t, g, unknown or other
  misc_feature (171)..(172): n is a, c, g, or t

SEQ ID NO: 86858 - DNA, 169 bp, Homo sapiens; identical to SEQ ID NO: 86430
  misc_feature: GYAE6OF01DZ1QS.1.89.I01.1.454.CMB.1.raw
  modified_base (169)..(169): a, c, t, g, unknown or other
  misc_feature (169)..(169): n is a, c, g, or t

SEQ ID NO: 86859 - DNA, 546 bp, Homo sapiens
  misc_feature: GYAE6OF01BXXXY.1.89.I01.1.454.CMB.1.raw
  modified_base (196)..(196): a, c, t, g, unknown or other
  misc_feature (196)..(196): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggcctcccaggctcctcatctatgatacatccaacgagggccacgtggcactcccagccaggttcagtggcaggtgggtctggggacagtacttcactctcaccatcagcagcctagacgcctagaatatttgcttagtttactactgtacagtcagcgtagctaacgtggcctctctaccgtttccggcccgtagggaacctaaggtcggaatacgtaaccgaaacgtacgtggtacggtctcgaccaccgtattcttagttccttcacgtttccccg

SEQ ID NO: 86860 - DNA, 227 bp, Homo sapiens
  misc_feature: GYAE6OF01AQQAK.1.89.I01.1.454.CMB.1.raw
  modified_base (57)..(57): a, c, t, g, unknown or other
  misc_feature (57)..(57): n is a, c, g, or t
  modified_base (162)..(162): a, c, t, g, unknown or other
  misc_feature (162)..(162): n is a, c, g, or t
  modified_base (168)..(227): a, c, t, g, unknown or other
  misc_feature (168)..(227): n is a, c, g, or t
tcagacgagtgcgtcacgaccggtgctcgatttagtatgctagtatcgcggggggtnttcggcggagggaccaaactgaccgtcctaggtcagcccaaggctgccccctggtcacctctgttcccaccctcctctactgctagtctgagcggctggcaggcncatagnnnnnnnnnnnnnnnnnnnnnnnnnnnnnnnnnnnnnnnnnnnnnnnnnnnnnnnnnnnn

SEQ ID NO: 86861 - DNA, 207 bp, Homo sapiens
  misc_feature: GYAE6OF01APCHJ.1.89.I01.1.454.CMB.1.raw
  modified_base (173)..(207): a, c, t, g, unknown or other
  misc_feature (173)..(207): n is a, c, g, or t
tcagacgagtgcgtcacgaccggtgctcgatttagtatgctagtatcggcggggggtgttcggcggagggaccaaactgaccgtcctaggtcagcccaaggcctgccccctcggtcactctgttcccaccctcctcatagcgtactctgagcgggctggcaaggtcgcatagnnnnnnnnnnnnnnnnnnnnnnnnnnnnnnnnnnn

SEQ ID NO: 86862 - DNA, 193 bp, Homo sapiens
  misc_feature: GYAE6OF01DFKJ7.1.89.I01.1.454.CMB.1.raw
  modified_base (172)..(193): a, c, t, g, unknown or other
  misc_feature (172)..(193): n is a, c, g, or t
tcagacgagtgcgtcacgaccggtgctcgatttagtatgctagtagtcgcgggggggtgttcggcggagggaccaaactgaccgtcctaggtcagcccaaggctgccccctcggtcactctgttcccgccctcctcatagctactctgagcgggctggcaaggcgtcatagnnnnnnnnnnnnnnnnnnnnnn

SEQ ID NO: 86863 - DNA, 189 bp, Homo sapiens; identical to SEQ ID NO: 86573
  misc_feature: GYAE6OF01B2ND9.1.89.I01.1.454.CMB.1.raw
  modified_base (187)..(189): a, c, t, g, unknown or other
  misc_feature (187)..(189): n is a, c, g, or t

SEQ ID NO: 86864 - DNA, 223 bp, Homo sapiens
  misc_feature: GYAE6OF01AT52H.1.89.I01.1.454.CMB.1.raw
  modified_base (219)..(223): a, c, t, g, unknown or other
  misc_feature (219)..(223): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttctcgctctcctctagagacacgctgagcgggctggcaaggcgcatagnnnnn

SEQ ID NO: 86865 - DNA, 172 bp, Homo sapiens; identical to SEQ ID NO: 86723
  misc_feature: GYAE6OF01CLBRH.1.89.I01.1.454.CMB.1.raw
  modified_base (171)..(172): a, c, t, g, unknown or other
  misc_feature (171)..(172): n is a, c, g, or t

SEQ ID NO: 86866 - DNA, 169 bp, Homo sapiens
  misc_feature: GYAE6OF01BRZAP.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtcttcggagctgggaccaaggtcaccgtcctaggtaagcccaaggccaaccccactgtcactctgttcccgccctcctcacgtctactgctgagcgggctggcaaggcgcatagn

SEQ ID NO: 86867 - DNA, 169 bp, Homo sapiens
  misc_feature: GYAE6OF01B9XZR.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccacctcctcacgtctactgctgagcgggctggcaaggcgcatagnn

SEQ ID NO: 86868 - DNA, 170 bp, Homo sapiens; identical to SEQ ID NO: 86404
  misc_feature: GYAE6OF01B6O6B.1.89.I01.1.454.CMB.1.raw
  modified_base (170)..(170): a, c, t, g, unknown or other
  misc_feature (170)..(170): n is a, c, g, or t

SEQ ID NO: 86869 - DNA, 222 bp, Homo sapiens
  misc_feature: GYAE6OF01EPLN7.1.89.I01.1.454.CMB.1.raw
  modified_base (219)..(222): a, c, t, g, unknown or other
  misc_feature (219)..(222): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccaccctcctctagagacacgctgagcgggctggcaaggcgcatagnnnn

SEQ ID NO: 86870 - DNA, 171 bp, Homo sapiens; identical to SEQ ID NO: 86391
  misc_feature: GYAE6OF01AXYVY.1.89.I01.1.454.CMB.1.raw
  modified_base (170)..(171): a, c, t, g, unknown or other
  misc_feature (170)..(171): n is a, c, g, or t

SEQ ID NO: 86871 - DNA, 171 bp, Homo sapiens; identical to SEQ ID NO: 86706
  misc_feature: GYAE6OF01CRYQD.1.89.I01.1.454.CMB.1.raw
  modified_base (171)..(171): a, c, t, g, unknown or other
  misc_feature (171)..(171): n is a, c, g, or t

SEQ ID NO: 86872 - DNA, 179 bp, Homo sapiens
  misc_feature: GYAE6OF01AMXGF.1.89.I01.1.454.CMB.1.raw
  modified_base (169)..(179): a, c, t, g, unknown or other
  misc_feature (169)..(179): n is a, c, g, or t
tcagacgagtgcgtcacgaccggtgctcgatttagtatgctagtatcgcgggggtgttcggcggagggaccgaaacgtgaccgtcctaggtcagcccaaggctgcccctcggtcactctgttcccaccctcctctactgctagtctgagcggctggcaaggcgcatagnnnnnnnnnnn

SEQ ID NO: 86873 - DNA, 622 bp, Homo sapiens
  misc_feature: GYAE6OF01AWL7X.1.89.I01.1.454.CMB.1.raw
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccgaggggaaggggcttcgagggacctcgtgggctgatccttggtctcctgctcctcaggctcgaccgggccagcactgactcacgtggcatgttcgttcctcccttactttccagtacgttccgtcgggccctagtcctcgcctgacctcgacgtcctgcccttccgtgttcgtggtcctcgtggactgtcatccactntcctcngcacgtacgaacngctaggtgtacggtttggtagttatcggtacttagtcgttcctaccgttacggtaaccctaacgtactacccgaacccgacggtaaccaacccggcccctaagtaccgtactagttacgtaatttacgaggtacgtactacggtcctacggtacccggtccttagggtacgggtttactacgttccgtacttcgtcgtcggtacctacgtaacgtccgtaggtaccctaaccgtcccgtcctacccgcgtacctacc

SEQ ID NO: 86874 - DNA, 169 bp, Homo sapiens
  misc_feature: GYAE6OF01CERJK.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtaagcccaaggctgccccctcggtcactctgttcccacctcctcacgtagcgtgctgagcgggctggcaaggcgcatagn

SEQ ID NO: 86875 - DNA, 173 bp, Homo sapiens; identical to SEQ ID NO: 86733
  misc_feature: GYAE6OF01DWRCB.1.89.I01.1.454.CMB.1.raw
  modified_base (171)..(173): a, c, t, g, unknown or other
  misc_feature (171)..(173): n is a, c, g, or t

SEQ ID NO: 86876 - DNA, 170 bp, Homo sapiens; identical to SEQ ID NO: 86433
  misc_feature: GYAE6OF01BJQQA.1.89.I01.1.454.CMB.1.raw
  modified_base (170)..(170): a, c, t, g, unknown or other
  misc_feature (170)..(170): n is a, c, g, or t

SEQ ID NO: 86877 - DNA, 247 bp, Homo sapiens
  misc_feature: GYAE6OF01AR2X6.1.89.I01.1.454.CMB.1.raw
  modified_base (239)..(247): a, c, t, g, unknown or other
  misc_feature (239)..(247): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccatgtcactctgttcccaccctcctcacgcactcgtctgagcgggctggcaaggcgcatagnnnnnnnnn

SEQ ID NO: 86878 - DNA, 170 bp, Homo sapiens; identical to SEQ ID NO: 86381
  misc_feature: GYAE6OF01EFFJ3.1.89.I01.1.454.CMB.1.raw
  modified_base (170)..(170): a, c, t, g, unknown or other
  misc_feature (170)..(170): n is a, c, g, or t

SEQ ID NO: 86879 - DNA, 170 bp, Homo sapiens; identical to SEQ ID NO: 86296
  misc_feature: GYAE6OF01DZMEN.1.89.I01.1.454.CMB.1.raw
  modified_base (169)..(170): a, c, t, g, unknown or other
  misc_feature (169)..(170): n is a, c, g, or t

SEQ ID NO: 86880 - DNA, 174 bp, Homo sapiens
  misc_feature: GYAE6OF01CWC94.1.89.I01.1.454.CMB.1.raw
  modified_base (172)..(174): a, c, t, g, unknown or other
  misc_feature (172)..(174): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccgccatctgaatagcgtactctgagcgggctggcaaggcgcatagnnn

SEQ ID NO: 86881 - DNA, 173 bp, Homo sapiens
  misc_feature: GYAE6OF01ARSDA.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctcctacagtgcctctgaggcgggctggcaaggcgcatagnnn

SEQ ID NO: 86882 - DNA, 171 bp, Homo sapiens; identical to SEQ ID NO: 86763
  misc_feature: GYAE6OF01EXKL2.1.89.I01.1.454.CMB.1.raw
  modified_base (171)..(171): a, c, t, g, unknown or other
  misc_feature (171)..(171): n is a, c, g, or t

SEQ ID NO: 86883 - DNA, 244 bp, Homo sapiens
  misc_feature: GYAE6OF01CDUEV.1.89.I01.1.454.CMB.1.raw
  modified_base (240)..(244): a, c, t, g, unknown or other
  misc_feature (240)..(244): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccactgtcactctgttcccgccctcctctcgtagcactctgagcgggctggcaaggcgcatagnnnnn

SEQ ID NO: 86884 - DNA, 404 bp, Homo sapiens
  misc_feature: GYAE6OF01DCQH9.1.89.I01.1.454.CMB.1.raw
  modified_base (381)..(404): a, c, t, g, unknown or other
  misc_feature (381)..(404): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccaagggcagggtcagcagtgctggccgtgggccctctctcagccaggaccaaggacagcagcctccaccaaggcccagtcggtccttccccgtggccaccctccaccaagacgcctacctcgtcgggggcacgacgccggcccgtgggctcgccccgtggtacaacggaccttaccttccgtcgtaagcctacgttccaggacgccgggctggacgaacggcgacaacgtagcnnnnnnnnnnnnnnnnnnnnnnnn

SEQ ID NO: 86885 - DNA, 172 bp, Homo sapiens
  misc_feature: GYAE6OF01B7PPT.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcggcggggggtgttcggcggaggaccaaactgaccgtcctaggtcagcccaaggctcgccccctcggtcactctgttcccgccctcctctactgctagtctgagcgggctggcaaggcgcatagnn

SEQ ID NO: 86886 - DNA, 171 bp, Homo sapiens; identical to SEQ ID NO: 86695
  misc_feature: GYAE6OF01CCVFF.1.89.I01.1.454.CMB.1.raw
  modified_base (171)..(171): a, c, t, g, unknown or other
  misc_feature (171)..(171): n is a, c, g, or t

SEQ ID NO: 86887 - DNA, 348 bp, Homo sapiens
  misc_feature: GYAE6OF01EAKWO.1.89.I01.1.454.CMB.1.raw
  modified_base (342)..(348): a, c, t, g, unknown or other
  misc_feature (342)..(348): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggccaccctcctccaagagcacctctgggggcacagcggcctgggctgcctggtcaaggactacttccgagtgcgtctgagcgggctggcaaggcgcatagnnnnnnn

SEQ ID NO: 86888 - DNA, 170 bp, Homo sapiens
  misc_feature: GYAE6OF01CUMV3.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccgccatctgaatagcgtactctgagcgggctggcaaggcgcatag

SEQ ID NO: 86889 - DNA, 236 bp, Homo sapiens
  misc_feature: GYAE6OF01C6G4E.1.89.I01.1.454.CMB.1.raw
  modified_base (160)..(160): a, c, t, g, unknown or other
  misc_feature (160)..(160): n is a, c, g, or t
  modified_base (166)..(236): a, c, t, g, unknown or other
  misc_feature (166)..(236): n is a, c, g, or t
tcagacgagtgcgtcacgaccggtgctcgatttagtatgctagtatcgcgggggtcttcggagctgggaccaaggtcaccgtcctaggtcagcccaaggccaaccccatgtcactctgttcccacctcctcacgtctactgctgagcggctggcaaggcncatagnnnnnnnnnnnnnnnnnnnnnnnnnnnnnnnnnnnnnnnnnnnnnnnnnnnnnnnnnnnnnnnnnnnnnnn

SEQ ID NO: 86890 - DNA, 172 bp, Homo sapiens
  misc_feature: GYAE6OF01AB735.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcggggggtgttcggcggagggaccaactgaccgtcctaggtcagcccaaggctgccccctcggtcactctgttcccaccctcctcacgtagcgtgctgagcgggctggcaaggcgcatagnnnn

SEQ ID NO: 86891 - DNA, 173 bp, Homo sapiens; identical to SEQ ID NO: 86733
  misc_feature: GYAE6OF01CFRDI.1.89.I01.1.454.CMB.1.raw
  modified_base (171)..(173): a, c, t, g, unknown or other
  misc_feature (171)..(173): n is a, c, g, or t

SEQ ID NO: 86892 - DNA, 172 bp, Homo sapiens
  misc_feature: GYAE6OF01ATHRQ.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtaagcccaaggctgccccctcggtcactctgttcccgccctcctcacgtagcgtgctgagcgggctggcaaggcgcatagnn

SEQ ID NO: 86893 - DNA, 249 bp, Homo sapiens
  misc_feature: GYAE6OF01CJQOX.1.89.I01.1.454.CMB.1.raw
  modified_base (231)..(249): a, c, t, g, unknown or other
  misc_feature (231)..(249): n is a, c, g, or t
tcagacgagtgcgtcacgaccggtgctcgatttagtatgctagtatcggcgggggcccaggcagatgatgagtctacttactattgtgtcctttacttgcgtgatggcatttggctgttcggcggagggaccaaagtgaccgtcctgggtcaagcccaaggctgccccctggtcactctgttcccaccctcctctgtccgagcgtctgagcgggctggcaaggcgcatagnnnnnnnnnnnnnnnnnnn

SEQ ID NO: 86894 - DNA, 174 bp, Homo sapiens
  misc_feature: GYAE6OF01AZ7ZA.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnnnn

SEQ ID NO: 86895 - DNA, 172 bp, Homo sapiens; identical to SEQ ID NO: 86593
  misc_feature: GYAE6OF01B7LIF.1.89.I01.1.454.CMB.1.raw
  modified_base (171)..(172): a, c, t, g, unknown or other
  misc_feature (171)..(172): n is a, c, g, or t

SEQ ID NO: 86896 - DNA, 170 bp, Homo sapiens; identical to SEQ ID NO: 86417
  misc_feature: GYAE6OF01AFLY2.1.89.I01.1.454.CMB.1.raw
  modified_base (170)..(170): a, c, t, g, unknown or other
  misc_feature (170)..(170): n is a, c, g, or t

SEQ ID NO: 86897 - DNA, 352 bp, Homo sapiens
  misc_feature: GYAE6OF01DBTYL.1.89.I01.1.454.CMB.1.raw
  modified_base (345)..(352): a, c, t, g, unknown or other
  misc_feature (345)..(352): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtccttccccctggccaccctcctccaagagcacctctgggggcacagcggcctggctgcctggtcaaggacctacttccgagtgcgtctctgagcgggctggcaaggcgcatagnnnnnnnn

SEQ ID NO: 86898 - DNA, 180 bp, Homo sapiens
  misc_feature: GYAE6OF01EQZ96.1.89.I01.1.454.CMB.1.raw
  modified_base (172)..(180): a, c, t, g, unknown or other
  misc_feature (172)..(180): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccaccccctctgtcgagcgtctgagcgggctgggcaaggcgcatagnnnnnnnnn

SEQ ID NO: 86899 - DNA, 171 bp, Homo sapiens
  misc_feature: GYAE6OF01DDENH.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcacgtctactgctgagcgggctggcaaggcgcatagn

SEQ ID NO: 86900 - DNA, 168 bp, Homo sapiens
  misc_feature: GYAE6OF01CJZEO.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctactgctgagcggctggcaaggcgcatagn

SEQ ID NO: 86901 - DNA, 171 bp, Homo sapiens; identical to SEQ ID NO: 86706
  misc_feature: GYAE6OF01BNUPE.1.89.I01.1.454.CMB.1.raw
  modified_base (171)..(171): a, c, t, g, unknown or other
  misc_feature (171)..(171): n is a, c, g, or t

SEQ ID NO: 86902 - DNA, 201 bp, Homo sapiens
  misc_feature: GYAE6OF01EDIPL.1.89.I01.1.454.CMB.1.raw
  modified_base (168)..(168): a, c, t, g, unknown or other
  misc_feature (168)..(168): n is a, c, g, or t
  modified_base (173)..(201): a, c, t, g, unknown or other
  misc_feature (173)..(201): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccaccctcctctactgctagtctgagcgggctggcaaggtcgnatagnnnnnnnnnnnnnnnnnnnnnnnnnnnnn

SEQ ID NO: 86903 - DNA, 190 bp, Homo sapiens
  misc_feature: GYAE6OF01DY2MZ.1.89.I01.1.454.CMB.1.raw
  modified_base (187)..(190): a, c, t, g, unknown or other
  misc_feature (187)..(190): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagcgggctggcaaggcgcatagnnnn

SEQ ID NO: 86904 - DNA, 172 bp, Homo sapiens
  misc_feature: GYAE6OF01CXWES.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctccgtgtctgatctgagcgggctggcaaggcgcatagnn

SEQ ID NO: 86905 - DNA, 170 bp, Homo sapiens
  misc_feature: GYAE6OF01ETJWJ.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcggggaatgttcggcgggggaccaagctgaccgtcttaggtcagcccaaggctgccccctggtcactctgttcccgccctcctctgtcgagcgtctgagcgggctggcaaggcgcatagnnn

SEQ ID NO: 86906 - DNA, 175 bp, Homo sapiens
  misc_feature: GYAE6OF01BJN3O.1.89.I01.1.454.CMB.1.raw
  modified_base (171)..(175): a, c, t, g, unknown or other
  misc_feature (171)..(175): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatagnnnnn

SEQ ID NO: 86907 - DNA, 169 bp, Homo sapiens; identical to SEQ ID NO: 86866
  misc_feature: GYAE6OF01ARJ6L.1.89.I01.1.454.CMB.1.raw
  modified_base (169)..(169): a, c, t, g, unknown or other
  misc_feature (169)..(169): n is a, c, g, or t

SEQ ID NO: 86908 - DNA, 169 bp, Homo sapiens
  misc_feature: GYAE6OF01B5AGC.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatag

SEQ ID NO: 86909 - DNA, 172 bp, Homo sapiens
  misc_feature: GYAE6OF01CIOVP.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnn

SEQ ID NO: 86910 - DNA, 175 bp, Homo sapiens
  misc_feature: GYAE6OF01E2WYM.1.89.I01.1.454.CMB.1.raw
  modified_base (164)..(164): a, c, t, g, unknown or other
  misc_feature (164)..(164): n is a, c, g, or t
  modified_base (170)..(175): a, c, t, g, unknown or other
  misc_feature (170)..(175): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctcatagcgtactctgagcgggctggcaaggcncatagnnnnnn

SEQ ID NO: 86911 - DNA, 177 bp, Homo sapiens
  misc_feature: GYAE6OF01DXOTS.1.89.I01.1.454.CMB.1.raw
  modified_base (172)..(177): a, c, t, g, unknown or other
  misc_feature (172)..(177): n is a, c, g, or t
tcagacgagtgcgtcacgaccggtgctcgatttagtatgctagtatcgcgggggggtggttcggcggagggaccaaactgaccgtcctaggtcagcccaaggctgccccctcggtcactctgttcccgccctcctccgtgtctgatctgagcgggctggcaaggcgcatagnnnnnn

SEQ ID NO: 86912 - DNA, 200 bp, Homo sapiens
  misc_feature: GYAE6OF01EV44G.1.89.I01.1.454.CMB.1.raw
  modified_base (176)..(200): a, c, t, g, unknown or other
  misc_feature (176)..(200): n is a, c, g, or t
tcagacgagtgcgtcacgaccggtgctcgatttagtatgctagtatcggcggggggggtgttcggcggagggaccaaactgaccgtcctaggtcagcccaaggctgccccctggtcactctcgttcccgccctcctctactgctagtctgagcgggctggacaaggtcgcaatagnnnnnnnnnnnnnnnnnnnnnnnnn

SEQ ID NO: 86913 - DNA, 257 bp, Homo sapiens; identical to SEQ ID NO: 86386
  misc_feature: GYAE6OF01B1BCO.1.89.I01.1.454.CMB.1.raw
  modified_base (255)..(257): a, c, t, g, unknown or other
  misc_feature (255)..(257): n is a, c, g, or t

SEQ ID NO: 86914 - DNA, 174 bp, Homo sapiens
  misc_feature: GYAE6OF01AVK1T.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnnnnn

SEQ ID NO: 86915 - DNA, 169 bp, Homo sapiens
  misc_feature: GYAE6OF01BRZK5.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctccgtgtctgatctgagcgggctggcaaggcgcatag

SEQ ID NO: 86916 - DNA, 169 bp, Homo sapiens
  misc_feature: GYAE6OF01CTIZ4.1.89.I01.1.454.CMB.1.raw
  modified_base (167)..(169): a, c, t, g, unknown or other
  misc_feature (167)..(169): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctctagagacacgagcgggctggcaaggcgcatagnnn

SEQ ID NO: 86917 - DNA, 171 bp, Homo sapiens; identical to SEQ ID NO: 86710
  misc_feature: GYAE6OF01B4ABL.1.89.I01.1.454.CMB.1.raw
  modified_base (171)..(171): a, c, t, g, unknown or other
  misc_feature (171)..(171): n is a, c, g, or t

SEQ ID NO: 86918 - DNA, 197 bp, Homo sapiens
  misc_feature: GYAE6OF01A4PO6.1.89.I01.1.454.CMB.1.raw
  modified_base (178)..(178): a, c, t, g, unknown or other
  misc_feature (178)..(178): n is a, c, g, or t
  modified_base (184)..(197): a, c, t, g, unknown or other
  misc_feature (184)..(197): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaacccatgtcactctgttcccacctcctctctctcgactctgagcgggctggcaaggcncatagnnnnnnnnnnnnnn

SEQ ID NO: 86919 - DNA, 171 bp, Homo sapiens
  misc_feature: GYAE6OF01DVNCN.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccatctgaatagcgtactctgagcgggctggcaaggcgcatagn

SEQ ID NO: 86920 - DNA, 188 bp, Homo sapiens
  misc_feature: GYAE6OF01BX2FX.1.89.I01.1.454.CMB.1.raw
  modified_base (172)..(188): a, c, t, g, unknown or other
  misc_feature (172)..(188): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcacgtctgttcccaccctcctcacgtagcgtgctgagcgggctggcaaggcgcatagnnnnnnnnnnnnnnnnn

SEQ ID NO: 86921 - DNA, 170 bp, Homo sapiens
  misc_feature: GYAE6OF01AYEAT.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatag

SEQ ID NO: 86922 - DNA, 174 bp, Homo sapiens
  misc_feature: GYAE6OF01BEE2G.1.89.I01.1.454.CMB.1.raw
  modified_base (169)..(174): a, c, t, g, unknown or other
  misc_feature (169)..(174): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcgggctggcaaggcgcatagnnnnnn

SEQ ID NO: 86923 - DNA, 195 bp, Homo sapiens
  misc_feature: GYAE6OF01BYJXB.1.89.I01.1.454.CMB.1.raw
  modified_base (181)..(181): a, c, t, g, unknown or other
  misc_feature (181)..(181): n is a, c, g, or t
  modified_base (187)..(195): a, c, t, g, unknown or other
  misc_feature (187)..(195): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctctctctcgactctgagcgggctggcaaggcncatagnnnnnnnnn

SEQ ID NO: 86924 - DNA, 172 bp, Homo sapiens
  misc_feature: GYAE6OF01EIIOX.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctgtcgagcgtctgagcgggctggcaaggcgcatagnn

SEQ ID NO: 86925 - DNA, 172 bp, Homo sapiens
  misc_feature: GYAE6OF01CQ7YI.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcgagtgcgtctctgagcgggctggcaaggcgcatagnn

SEQ ID NO: 86926 - DNA, 186 bp, Homo sapiens
  misc_feature: GYAE6OF01BDUWN.1.89.I01.1.454.CMB.1.raw
  modified_base (171)..(186): a, c, t, g, unknown or other
  misc_feature (171)..(186): n is a, c, g, or t
tcagacgagtgcgtcacgaccggtgctcgatttagtatgctagtatcggcggggggtgttcggcggagggaccaaactgaccgtcctaggtaagcccaaggctgccccctcggtcactctgttcccaccctcctcacgtagcgtgctgagcgggctggcaaggcgcatagnnnnnnnnnnnnnnnn

SEQ ID NO: 86927 - DNA, 172 bp, Homo sapiens; identical to SEQ ID NO: 86844
  misc_feature: GYAE6OF01E5MMH.1.89.I01.1.454.CMB.1.raw
  modified_base (171)..(172): a, c, t, g, unknown or other
  misc_feature (171)..(172): n is a, c, g, or t

SEQ ID NO: 86928 - DNA, 171 bp, Homo sapiens
  misc_feature: GYAE6OF01CE9GC.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctgtcgagcgtctgagcgggctggcaaggcgcatagn

SEQ ID NO: 86929 - DNA, 319 bp, Homo sapiens
  misc_feature: GYAE6OF01C60R2.1.89.I01.1.454.CMB.1.raw
  modified_base (313)..(313): a, c, t, g, unknown or other
  misc_feature (313)..(313): n is a, c, g, or t
  modified_base (318)..(319): a, c, t, g, unknown or other
  misc_feature (318)..(319): n is a, c, g, or t
tcagacgagtgcgtcacgaccggtgctcgatttagtatgctagtatcgcgggctcctcatttttgacaatgataaacgaccctcaggaatttctgaccgattctctggctccaagtctggcctgtcagcctccctgggcatcaccggactccaaaacgtggggacgaggccgattattactgcgagacatgggatagtaacttgaatggttggcgattcggcggaggacaagtgacgtctaggtcagccaagccaacccatcgtcactctcgttcccacctcctcctcgtctctactgagcggctgcaaggcnatagnn

SEQ ID NO: 86930 - DNA, 189 bp, Homo sapiens
  misc_feature: GYAE6OF01CA77D.1.89.I01.1.454.CMB.1.raw
  modified_base (169)..(189): a, c, t, g, unknown or other
  misc_feature (169)..(189): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctcgagtgcgtctctgagcgggctggcaaggcgcatagnnnnnnnnnnnnnnnnnnnnn

SEQ ID NO: 86931 - DNA, 199 bp, Homo sapiens
  misc_feature: GYAE6OF01BAIUC.1.89.I01.1.454.CMB.1.raw
  modified_base (168)..(199): a, c, t, g, unknown or other
  misc_feature (168)..(199): n is a, c, g, or t
tcagacgagtgcgtcacgaccggtgctcgatttagtatgctagtatcgcgggggtgttcggcggagggaccaaactgaccgtcctaggtcagcccaaggctgccccctggtcactctgttcccgccctcctctactgctagtctgagcgggctggcaaggcgcatagnnnnnnnnnnnnnnnnnnnnnnnnnnnnnnnn

SEQ ID NO: 86932 - DNA, 186 bp, Homo sapiens
  misc_feature: GYAE6OF01CSKGP.1.89.I01.1.454.CMB.1.raw
  modified_base (174)..(186): a, c, t, g, unknown or other
  misc_feature (174)..(186): n is a, c, g, or t
tcagacgagtgcgtcacgaccggtgctcgatttagtatgctagtatcggcggggggggtgttcggcggagggaccaaactgaccgtcctaggtcagcccaaggcctgcccccctggtcactctgttcccaccctcctcacgcactcgtctgagcgggctggcaaggcgcatagnnnnnnnnnnnnn

SEQ ID NO: 86933 - DNA, 173 bp, Homo sapiens
  misc_feature: GYAE6OF01B2DOI.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccatctgaatagcgtactctgagcgggctggcaaggcgcatagnnnn

SEQ ID NO: 86934 - DNA, 175 bp, Homo sapiens
  misc_feature: GYAE6OF01EZ9WH.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcgcggggggtcttcggagctgggaccaaggtcaccgtcctaggtcagcccaaggccaaccccactgtcactctgttcccaccctcctcacgtctactgctgagcgggctggcaaggcgcatagnnnnnn

SEQ ID NO: 86935 - DNA, 171 bp, Homo sapiens
  misc_feature: GYAE6OF01D8AQT.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcacgtagcgtgctgagcgggctggcaaggcgcatagn

SEQ ID NO: 86936 - DNA, 192 bp, Homo sapiens
  misc_feature: GYAE6OF01D246V.1.89.I01.1.454.CMB.1.raw
  modified_base (172)..(192): a, c, t, g, unknown or other
  misc_feature (172)..(192): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcggggctggcaaggcgcatagnnnnnnnnnnnnnnnnnnnnn

SEQ ID NO: 86937 - DNA, 172 bp, Homo sapiens
  misc_feature: GYAE6OF01CY3X6.1.89.I01.1.454.CMB.1.raw
  modified_base (172)..(172): a, c, t, g, unknown or other
  misc_feature (172)..(172): n is a, c, g, or t
tcagacgagtgcgtcacgaccggtgctcgatttagtatgctagtatcgcgggggggtgttcggcggagggaccaaactgaccgtcctaggtcagcccaaggcctgccccctggtcactctgttcccgccctcctctactgctagtctgagcgggctaggcaaggcgcatagn

SEQ ID NO: 86938 - DNA, 388 bp, Homo sapiens
  misc_feature: GYAE6OF01ACL9M.1.89.I01.1.454.CMB.1.raw
  modified_base (372)..(388): a, c, t, g, unknown or other
  misc_feature (372)..(388): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtccttccccctggccaccctcctccaagacgccacctcgtgggggccacgacgccggcccgtggggcctcggcctggtaccaagggaccttaccttccctcgtacgccactcgtggacgcgggtctggcaacggcgcatagnnnnnnnnnnnnnnnnn

SEQ ID NO: 86939 - DNA, 345 bp, Homo sapiens
  misc_feature: GYAE6OF01DRV0A.1.89.I01.1.454.CMB.1.raw
  modified_base (326)..(326): a, c, t, g, unknown or other
  misc_feature (326)..(326): n is a, c, g, or t
  modified_base (331)..(345): a, c, t, g, unknown or other
  misc_feature (331)..(345): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggcagcagcctcaccaagggccatcggtctcccctggcacctctccagagcacctctggggcacagcgcctggctgcctggtcaaggactactccgagtgcgtctctgagcgggctggcaaggcgnatagnnnnnnnnnnnnnnn

SEQ ID NO: 86940 - DNA, 174 bp, Homo sapiens
  misc_feature: GYAE6OF01CH3YW.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcgggggaatgttcggcgggggaccaagctgaccgtcttaggtcagcccaaggctgcccccctggtcactctgttcccgccctcctctgtcgagcgtctgagcgggctggcaaggcgcatagnnnnn

SEQ ID NO: 86941 - DNA, 352 bp, Homo sapiens
  misc_feature: GYAE6OF01A9Y41.1.89.I01.1.454.CMB.1.raw
  modified_base (344)..(352): a, c, t, g, unknown or other
  misc_feature (344)..(352): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagacgcacctctgggggcacagcggcctgggctgcctggtcaaggactacttccgagtgcgtctctgagcgggctggcaaggcgcatagnnnnnnnnn

SEQ ID NO: 86942 - DNA, 172 bp, Homo sapiens; identical to SEQ ID NO: 86745
  misc_feature: GYAE6OF01D3CXZ.1.89.I01.1.454.CMB.1.raw
  modified_base (171)..(172): a, c, t, g, unknown or other
  misc_feature (171)..(172): n is a, c, g, or t

SEQ ID NO: 86943 - DNA, 171 bp, Homo sapiens; identical to SEQ ID NO: 86832
  misc_feature: GYAE6OF01EEE7E.1.89.I01.1.454.CMB.1.raw
  modified_base (171)..(171): a, c, t, g, unknown or other
  misc_feature (171)..(171): n is a, c, g, or t

SEQ ID NO: 86944 - DNA, 390 bp, Homo sapiens
  misc_feature: GYAE6OF01AE3IL.1.89.I01.1.454.CMB.1.raw
  modified_base (380)..(390): a, c, t, g, unknown or other
  misc_feature (380)..(390): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtcttccccctggccaccctcctccaagacgccaccctcgtcgggggccacgacgccggcccgtgggcctcggcccgtggtaccaagggtaccttaaccttcccggaagtcgccgtcctcgtggacggcgggctggacaaggccgcagtagnnnnnnnnnnn

SEQ ID NO: 86945 - DNA, 170 bp, Homo sapiens
  misc_feature: GYAE6OF01EBX9O.1.89.I01.1.454.CMB.1.raw
  modified_base (165)..(165): a, c, t, g, unknown or other
  misc_feature (165)..(165): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcccaccctcctctactgctagtctgagcgggctggcaaggcncatag

SEQ ID NO: 86946 - DNA, 171 bp, Homo sapiens
  misc_feature: GYAE6OF01ATOG9.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctccgtgtctgatctgagcgggctggcaaggcgcatagnn

SEQ ID NO: 86947 - DNA, 175 bp, Homo sapiens
  misc_feature: GYAE6OF01BJOWZ.1.89.I01.1.454.CMB.1.raw
  modified_base (171)..(175): a, c, t, g, unknown or other
  misc_feature (171)..(175): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctccgtgtctgatctgagcgggctggcaaggcgcatagnnnnn

SEQ ID NO: 86948 - DNA, 170 bp, Homo sapiens
  misc_feature: GYAE6OF01CF8UT.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcgagtgcgtctctgagcgggctggcaaggcgcatag

SEQ ID NO: 86949 - DNA, 734 bp, Homo sapiens
  misc_feature: GYAE6OF01D9RBE.1.89.I01.1.454.CMB.1.raw
  modified_base (195)..(195): a, c, t, g, unknown or other
  misc_feature (195)..(195): n is a, c, g, or t
  modified_base (257)..(257): a, c, t, g, unknown or other
  misc_feature (257)..(257): n is a, c, g, or t
  modified_base (705)..(705): a, c, t, g, unknown or other
  misc_feature (705)..(705): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtgttagcagtctacttacgcctaggtaaccaanacgaaacctggaccaggccctcccgaggcctcctcatctatcgaatacattacccaaacgcgggaccacgtcggacctactccccgaggacccgtaggtttaccgaaggttcgggaccgtagggttcgggggttcgtacggggggaacctacggtaccctttaccgtaaccgtttctacccgtaacccctagttacccgacgggacctaacggtacccgttaacggaccgtaccgttaaggttaaaggttttacgtttttcgaacgttttaaggtttttaactttacggttacggttaccgaggtacgtacggtaccgttacgacctaacgtccggtcccttcgttacccgttaccggtttcccgggacccgttacggggtaaacctaagggtggtaacttacgtaaaccgaaaccgtacgttgggacgtcgtaccgacctaaccgtnttcgtttacgtaccttcgtctttcccccg

SEQ ID NO: 86950 - DNA, 197 bp, Homo sapiens
  misc_feature: GYAE6OF01BFURJ.1.89.I01.1.454.CMB.1.raw
  modified_base (179)..(179): a, c, t, g, unknown or other
  misc_feature (179)..(179): n is a, c, g, or t
  modified_base (185)..(197): a, c, t, g, unknown or other
  misc_feature (185)..(197): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaagccaaccccactgtcactctgttcccaccctctctctctcgactctgagcgggctggcaaggcncatagnnnnnnnnnnnnn

SEQ ID NO: 86951 - DNA, 225 bp, Homo sapiens
  misc_feature: GYAE6OF01CF1HK.1.89.I01.1.454.CMB.1.raw
  modified_base (57)..(57): a, c, t, g, unknown or other
  misc_feature (57)..(57): n is a, c, g, or t
  modified_base (169)..(225): a, c, t, g, unknown or other
  misc_feature (169)..(225): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 86952 - DNA, 190 bp, Homo sapiens
  misc_feature: GYAE6OF01BMXL7.1.89.I01.1.454.CMB.1.raw
  modified_base (187)..(190): a, c, t, g, unknown or other
  misc_feature (187)..(190): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccgccctcctctctctcgactctgagcgggctggcaaggcgcatagnnnn

SEQ ID NO: 86953 - DNA, 512 bp, Homo sapiens
  misc_feature: GYAE6OF01BIFAD.1.89.I01.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (507)..(507): a, c, t, g, unknown or other
  misc_feature (507)..(507): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctnatctatgatacatccaacagggcccactggcactcccagcccaggttcagtggcaggtgggtctgggacagacttcactctcaccatcagcagcctagacgcctagaagtattttgctaagtttattactgtcagcagcgtagcaacgtcggcctctctactttccggcccgtgggaccaaggtgatatacaaacgtactgtggctgcacctatctgtccttcnttccc

SEQ ID NO: 86954 - DNA, 395 bp, Homo sapiens
  misc_feature: GYAE6OF01A19UG.1.89.I01.1.454.CMB.1.raw
  modified_base (381)..(395): a, c, t, g, unknown or other
  misc_feature (381)..(395): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtgggccctcctctcagccaggaccaaggacagcagcctccaccaacgggcccatccggtccttccccctggccaccctcctccaagcgccaccctcgtcggggccaccgaggccggcccgtcgggctcggcccgtggtaccgaaggtacctacctttccggagtcggccgtctcgtggacgccgggtcgtaggacaaggccgcatagnnnnnnnnnnnnnnn

SEQ ID NO: 86955 - DNA, 361 bp, Homo sapiens
  misc_feature: GYAE6OF01CFLSG.1.89.I01.1.454.CMB.1.raw
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
  modified_base (353)..(361): a, c, t, g, unknown or other
  misc_feature (353)..(361): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccagtccggtccttcccccgtggcccaccctcctccaagacgccacctcgtgggggccacgagccggcctggctgcctggtcaacggctacttcctctctacgactcngagcggctggcgagcncatagnnnnnnnnn

SEQ ID NO: 86956 - DNA, 172 bp, Homo sapiens
  misc_feature: GYAE6OF01B53LI.1.89.I01.1.454.CMB.1.raw
  modified_base (164)..(164): a, c, t, g, unknown or other
  misc_feature (164)..(164): n is a, c, g, or t
  modified_base (170)..(172): a, c, t, g, unknown or other
  misc_feature (170)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctctcgtactgcgctgagcgggctggcaaggcncatagnnn

SEQ ID NO: 86957 - DNA, 176 bp, Homo sapiens
  misc_feature: GYAE6OF01D3E3B.1.89.I01.1.454.CMB.1.raw
  modified_base (170)..(176): a, c, t, g, unknown or other
  misc_feature (170)..(176): n is a, c, g, or t
tcagacgagtgcgtcacgaccggtgctcgatttagtatgctagtatcggcggggggtgttcggcggagggaccaactgaccgtcctaggtcagcccaaggctgccccctcggtcactctgttcccaccctcctcacgtagcgtgctgagcgggctggcaaggcgcatagnnnnnnn

SEQ ID NO: 86958 - DNA, 174 bp, Homo sapiens
  misc_feature: GYAE6OF01CQPFB.1.89.I01.1.454.CMB.1.raw
  modified_base (172)..(174): a, c, t, g, unknown or other
  misc_feature (172)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctcgttcccgccctcctctactgctagtctgagcgggctggcaaggcgcatagnnn

SEQ ID NO: 86959 - DNA, 180 bp, Homo sapiens
  misc_feature: GYAE6OF01B6DE7.1.89.I01.1.454.CMB.1.raw
  modified_base (170)..(180): a, c, t, g, unknown or other
  misc_feature (170)..(180): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcgggctggcaaggcgcatagnnnnnnnnnnn

SEQ ID NO: 86960 - DNA, 171 bp, Homo sapiens; identical to SEQ ID NO: 86935
  misc_feature: GYAE6OF01DUW3D.1.89.I01.1.454.CMB.1.raw
  modified_base (171)..(171): a, c, t, g, unknown or other
  misc_feature (171)..(171): n is a, c, g, or t

SEQ ID NO: 86961 - DNA, 192 bp, Homo sapiens
  misc_feature: GYAE6OF01EFBBR.1.89.I01.1.454.CMB.1.raw
  modified_base (171)..(192): a, c, t, g, unknown or other
  misc_feature (171)..(192): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnn

SEQ ID NO: 86962 - DNA, 743 bp, Homo sapiens
  misc_feature: GYAE6OF01EEN18.1.89.I01.1.454.CMB.1.raw
tcagacgagtgcgtcacgaccggtgctcgatttagtatgctagtatcggcggggggggtctcaggaggcagcgctctcaggacatctccaccatggcctggctctgctgctcctcaccctcctcactcagggcacaggtgacgcctccgaggggaagggcttcgagggacctcgtgggctgacttccgttggtctcctgctcctcgaggcctacgaccgggccagcactgactcacgtggcagttgttcgtttcctcccttctttccgagtacgtccgtcgggccctagtcctcgcccttgactcgagtccctgtccctccggtgtccgttcggtcctcgtaggactacgttccgactaccgacctctccgtcctgacctacgtacggaaccctggtacgtggtacgtacgggtttgggttacgttaacgtcgtacttagttcgttaccttccgtaacggtaaccaacgtactaccgaaccgacggaaccgaaaccggtccccaagaccttacgagtttcgtaacgtttacgcggtaacggtctacggtaccgtaaccggttcccggttacccgttaacgggtttaaccggggtttacttaaccggttccgtttacccgtttaccgttaccggttacccgggttaccctttaacccggtaaccggtttcccggtaacccgggaaaccccttaaacccggtccccggttaccccccgtttaacgccccggtaacccttacccgg

SEQ ID NO: 86963 - DNA, 187 bp, Homo sapiens
  misc_feature: GYAE6OF01AOGUU.1.89.I01.1.454.CMB.1.raw
  modified_base (168)..(168): a, c, t, g, unknown or other
  misc_feature (168)..(168): n is a, c, g, or t
  modified_base (174)..(187): a, c, t, g, unknown or other
  misc_feature (174)..(187): n is a, c, g, or t
tcagacgagtgcgtcacgaccggtgctcgatttagtatgctagtagtcggcggggggggtgttcggcggagggaccaaactgaccgtcctaggtcagcccaaggctgccccctcggtcactctgttcccgccctcctcacgtagcgtgctgagcgggctggcaaggcncatagnnnnnnnnnnnnnn

SEQ ID NO: 86964 - DNA, 171 bp, Homo sapiens; identical to SEQ ID NO: 86695
  misc_feature: GYAE6OF01EJKUM.1.89.I01.1.454.CMB.1.raw
  modified_base (171)..(171): a, c, t, g, unknown or other
  misc_feature (171)..(171): n is a, c, g, or t

SEQ ID NO: 86965 - DNA, 177 bp, Homo sapiens
  misc_feature: GYAE6OF01AD0SU.1.89.I01.1.454.CMB.1.raw
  modified_base (172)..(177): a, c, t, g, unknown or other
  misc_feature (172)..(177): n is a, c, g, or t
tcagacgagtgcgtcacgaccggtgctcgatttagtatgctagtatcgcgggggggtgttcggcggagggaccaaactgaccgtcctacggtcagcccaaggctgccccctcggtcactctgttcccaccctcctctgtcgagcgtctgagcgggctggcaaggcgcatagnnnnnn

SEQ ID NO: 86966 - DNA, 222 bp, Homo sapiens
  misc_feature: GYAE6OF01CN1S8.1.89.I01.1.454.CMB.1.raw
  modified_base (195)..(222): a, c, t, g, unknown or other
  misc_feature (195)..(222): n is a, c, g, or t
tcagacgagtgcgtcacgaccggtgctcgatttagtatgctagtatgggagtggccacctgagtggtctttgggtgttcggcggggggaccaagctgaccgtcctaggtcagcccaaggcctcgccccctcggtcactctcgttcccgccatctgatcctctcgactctgaggcgggctggccaaggcgcatagnnnnnnnnnnnnnnnnnnnnnnnnnnnn

SEQ ID NO: 86967 - DNA, 361 bp, Homo sapiens
  misc_feature: GYAE6OF01CB2US.1.89.I01.1.454.CMB.1.raw
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (343)..(361): a, c, t, g, unknown or other
  misc_feature (343)..(361): n is a, c, g, or t
tcagacgagtgcgtcacgaccggtgctcgatttagtatgctagtatgggcacggaccgacctgagctcaggaggcagcagagcgagggaggaggagaggccccaggtgaacggaggggcttgtccaggccggcagcatcaccggagcccagggcagggtcagcagtgctggccgtggggccctctctcagccaggaccaaggacagcagcctccacacgggcccatccggtcttccccctggccaccctcctccaagagcacctcgtggggcacagccgcctgggctgcctggcaaggctacttccncgtagcactntgagcggctggcaaggcgnagtacgnnnnnnnnnnnnnnnnnnn

SEQ ID NO: 86968 - DNA, 187 bp, Homo sapiens; identical to SEQ ID NO: 86384
  misc_feature: GYAE6OF01BHEA4.1.89.I01.1.454.CMB.1.raw
  modified_base (187)..(187): a, c, t, g, unknown or other
  misc_feature (187)..(187): n is a, c, g, or t

SEQ ID NO: 86969 - DNA, 171 bp, Homo sapiens
  misc_feature: GYAE6OF01AL1KS.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctagagacacgctgagcgggctggcaaggcgcatagn

SEQ ID NO: 86970 - DNA, 424 bp, Homo sapiens
  misc_feature: GYAE6OF01BYU2K.1.89.I01.1.454.CMB.1.raw
  modified_base (370)..(370): a, c, t, g, unknown or other
  misc_feature (370)..(370): n is a, c, g, or t
  modified_base (404)..(424): a, c, t, g, unknown or other
  misc_feature (404)..(424): n is a, c, g, or t
tcagacgagtgcgtcacgaccggtgctcgatttagtatgctagtatgggcacgaccgacctgagctcaggaggcagcagagcgagggaggaggagaggccccaggtagaacgggagggtcttgccgagggccggcagcaatccgaccggacgcccgagggcgagggtcagcagtgcgtggccggtcgggcccctcctcacagccgaaggaccgaaggacagcacgcccaccaccgaacgggcccagtccggttccttccccgtgccacccctcctacgaaagccaccaccctcggcggggacacgacggtccggccgtgggcctcgccgtggtaccgaacggtaccttacgtccgagtcgtccgtctcgnggacggtcggcgtcggacgaacggcgtacagtgnnnnnnnnnnnnnnnnnnnnn

SEQ ID NO: 86971 - DNA, 183 bp, Homo sapiens
  misc_feature: GYAE6OF01ER48K.1.89.I01.1.454.CMB.1.raw
  modified_base (168)..(183): a, c, t, g, unknown or other
  misc_feature (168)..(183): n is a, c, g, or t
tcagacgagtgcgtcacgaccggtgctcgatttagtatgctagtatcggcgggggtgttcggcggaggaccaaactgaccgtcctaggtcagcccaaggctgccccctggtcactctgttcccaccctcctctactgctagtctgagcgggctggcaaggcgcatagnnnnnnnnnnnnnnnn

SEQ ID NO: 86972 - DNA, 172 bp, Homo sapiens; identical to SEQ ID NO: 86765
  misc_feature: GYAE6OF01CDXTY.1.89.I01.1.454.CMB.1.raw
  modified_base (171)..(172): a, c, t, g, unknown or other
  misc_feature (171)..(172): n is a, c, g, or t

SEQ ID NO: 86973 - DNA, 172 bp, Homo sapiens
  misc_feature: GYAE6OF01B6833.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcgagtgcgtctctgagcgggctggcaaggcgcatagnn

SEQ ID NO: 86974 - DNA, 181 bp, Homo sapiens
  misc_feature: GYAE6OF01BILKQ.1.89.I01.1.454.CMB.1.raw
  modified_base (171)..(181): a, c, t, g, unknown or other
  misc_feature (171)..(181): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccatctgaatagcgtactctgagcgggctggcaaggcgcatagnnnnnnnnnnn

SEQ ID NO: 86975 - DNA, 188 bp, Homo sapiens
  misc_feature: GYAE6OF01C3U63.1.89.I01.1.454.CMB.1.raw
  modified_base (185)..(188): a, c, t, g, unknown or other
  misc_feature (185)..(188): n is a, c, g, or t
tcagacgagtgcgtcacgaccggtgctcgatttagtatgctagtatgggatgacagcctgagtgcccttatgtcttcggaactgggaccaaggtcaccgtctaggtcagcccaaggccaaccccatgtcactctgttcccaccctcctctctctcgactctgagcgggctggcaaggcgcatagnnnn

SEQ ID NO: 86976 - DNA, 173 bp, Homo sapiens; identical to SEQ ID NO: 86733
  misc_feature: GYAE6OF01BU7C1.1.89.I01.1.454.CMB.1.raw
  modified_base (171)..(173): a, c, t, g, unknown or other
  misc_feature (171)..(173): n is a, c, g, or t

SEQ ID NO: 86977 - DNA, 178 bp, Homo sapiens
  misc_feature: GYAE6OF01BMOL9.1.89.I01.1.454.CMB.1.raw
  modified_base (170)..(178): a, c, t, g, unknown or other
  misc_feature (170)..(178): n is a, c, g, or t
tcagacgagtgcgtcacgaccggtgctcgatttagtatgctagtatcgcgggggggtgttcggcggagggaccaaactgaccgtcctaggtaagcccaaggctgccccctggtcactctgttcccaccctcctcacgtagcgtgctgagcgggctggcaaggcgcatagnnnnnnnnn

SEQ ID NO: 86978 - DNA, 247 bp, Homo sapiens
  misc_feature: GYAE6OF01C8LAW.1.89.I01.1.454.CMB.1.raw
  modified_base (239)..(247): a, c, t, g, unknown or other
  misc_feature (239)..(247): n is a, c, g, or t
tcagacgagtgcgtcacgaccggtgctcgatttagtatgctagtatcgcgggaccatctctggctccaggctgaggacgaggctgattatttctgcagctcatatacaaccagcagcaccaagtcttcggaactgggaccagggtcaccgtcctaggtcacgcccaaggccaaccccatgtcactctcgttcccaccctcctcacgcactcgtctgacgcggctggcaaggcgcatagnnnnnnnnn

SEQ ID NO: 86979 - DNA, 778 bp, Homo sapiens
  misc_feature: GYAE6OF01BU9QY.1.89.I01.1.454.CMB.1.raw
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
tcagacgagtgcgtcacgaccggtgctcgatttagtatgctagtatgggggaggaactgctcagttaggacccagagggaaccatggaagccccagctcagcttctcttcctctgctactctggctcccagactaccgaccggagaaattgtgttgacacagtctccagccacctgttctttcgtctccgaaggggaaacncgcctaccctctccngcgacggccagtcaggagtgttagcacgacttacgttacgccgtacggtaaccaaacgaacgaaaccgtcggaccgacggcctccgaggtccctcctacacttctaatcgaacttaaccgactacccgaaacggaccgggcctaacgtcggacctaccgtacccgaacggtccgtaacggttccgaagggttcggacgtagggttcggggtacgtaggggaactacggtaccttaccgaccgttcctaaccacctaactccggaaacgccgaaccggtaccgtaacgggacgtacccggttaagggtaaacgtttacggtttttacgaacgtttaacggtttttaataccgttggtaacgtaacggacgttaacggtaccggtttaacgaacccgttaaccggttccggtaacccttcccggtttaaccgtacccgggtttacccggacccggttaacgggaaaccgtaaaggtcggtaaactacgtaacccgaaacgttacggtgggtaccgctaccgtacctaccgtacttccgttaccgttaccttcgtcccgttaccg

SEQ ID NO: 86980 - DNA, 172 bp, Homo sapiens
  misc_feature: GYAE6OF01AGAPA.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtaagcccaaggctgccccctcggtcactctgttaccaccctcctcacgtagcgtgctgagcgggctggcaaggcgcatagnnn

SEQ ID NO: 86981 - DNA, 173 bp, Homo sapiens
  misc_feature: GYAE6OF01C6JRD.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 86982 - DNA, 226 bp, Homo sapiens
  misc_feature: GYAE6OF01DVA81.1.89.I01.1.454.CMB.1.raw
  modified_base (58)..(58): a, c, t, g, unknown or other
  misc_feature (58)..(58): n is a, c, g, or t
  modified_base (170)..(226): a, c, t, g, unknown or other
  misc_feature (170)..(226): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 86983 - DNA, 214 bp, Homo sapiens
  misc_feature: GYAE6OF01ENQCR.1.89.I01.1.454.CMB.1.raw
  modified_base (59)..(59): a, c, t, g, unknown or other
  misc_feature (59)..(59): n is a, c, g, or t
  modified_base (170)..(214): a, c, t, g, unknown or other
  misc_feature (170)..(214): n is a, c, g, or t
tcagacgagtgcgtcacgaccggtgctcgatttagtatgctagtatcgcggggggggtnttcggcggagggaccaaactgaccgtcctaggcagcccaaggctgccccctggtcactctgttcccaccctcctctactgctagtctgagcgggctggcaaggcgcatagnnnnnnnnnnnnnnnnnnnnnnnnnnnnnnnnnnnnnnnnnnnnn

SEQ ID NO: 86984 - DNA, 249 bp, Homo sapiens
  misc_feature: GYAE6OF01B4MD3.1.89.I01.1.454.CMB.1.raw
  modified_base (135)..(135): a, c, t, g, unknown or other
  misc_feature (135)..(135): n is a, c, g, or t
  modified_base (159)..(159): a, c, t, g, unknown or other
  misc_feature (159)..(159): n is a, c, g, or t
  modified_base (165)..(249): a, c, t, g, unknown or other
  misc_feature (165)..(249): n is a, c, g, or t
tcagacgagtgcgtcacgaccggtgctcgatttagtatgctagtatcgcgggggggtttcggcggaggaccaaactgaccgtcctaggtcagcccaaggctgccccctggtcactctgttcccaccctctctacngctagtctgagcggctggcaggcncatagnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 86985 - DNA, 171 bp, Homo sapiens
  misc_feature: GYAE6OF01DVDMP.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcgggggaatgttcggcggggggaccaagctgaccgtcttaggtcagcccaaggctgccccctggtcactctgttcccaccctcctctgtcgagcgtctgagcgggctggcaaggcgcatagnn

SEQ ID NO: 86986 - DNA, 219 bp, Homo sapiens
  misc_feature: GYAE6OF01AR4WY.1.89.I01.1.454.CMB.1.raw
  modified_base (58)..(58): a, c, t, g, unknown or other
  misc_feature (58)..(58): n is a, c, g, or t
  modified_base (160)..(160): a, c, t, g, unknown or other
  misc_feature (160)..(160): n is a, c, g, or t
  modified_base (165)..(219): a, c, t, g, unknown or other
  misc_feature (165)..(219): n is a, c, g, or t
tcagacgagtgcgtcacgaccggtgctcgatttagtatgctagtatcgcgggggggtnttcggcggagggaccaaactgaccgtcctaggtcagcccaaggctgcccctggtcactctgttcccacctctctactgctagtctgagcggctggcaaggcncatgnnnnnnnnnnnnnnnnnnnnnnnnnnnnnnnnnnnnnnnnnnnnnnnnnnnnnnn

SEQ ID NO: 86987 - DNA, 225 bp, Homo sapiens
  misc_feature: GYAE6OF01DS85B.1.89.I01.1.454.CMB.1.raw
  modified_base (167)..(225): a, c, t, g, unknown or other
  misc_feature (167)..(225): n is a, c, g, or t
tcagacgagtgcgtcacgaccggtgctcgatttagtatgctagtatcgcggaggtcttcggagctgggaccaaggtcaccgtcctaggtaagcccaaggccaaccccactgtcactctgttcccacctctcacgtctactgctgagcgggctggcaaggcgcatagnnnnnnnnnnnnnnnnnnnnnnnnnnnnnnnnnnnnnnnnnnnnnnnnnnnnnnnnnnn

SEQ ID NO: 86988 - DNA, 175 bp, Homo sapiens
  misc_feature: GYAE6OF01ESUJ5.1.89.I01.1.454.CMB.1.raw
  modified_base (162)..(162): a, c, t, g, unknown or other
  misc_feature (162)..(162): n is a, c, g, or t
  modified_base (168)..(175): a, c, t, g, unknown or other
  misc_feature (168)..(175): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctctcacgtctactgctgagcgggctggcaaggcncatagnnnnnnnn

SEQ ID NO: 86989 - DNA, 175 bp, Homo sapiens
  misc_feature: GYAE6OF01DP512.1.89.I01.1.454.CMB.1.raw
  modified_base (164)..(164): a, c, t, g, unknown or other
  misc_feature (164)..(164): n is a, c, g, or t
  modified_base (170)..(175): a, c, t, g, unknown or other
  misc_feature (170)..(175): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcccacccttctctactgctagtctgagcggctggcaaggcncatagnnnnnn

SEQ ID NO: 86990 - DNA, 348 bp, Homo sapiens
  misc_feature: GYAE6OF01DDNV5.1.89.I01.1.454.CMB.1.raw
  modified_base (256)..(256): a, c, t, g, unknown or other
  misc_feature (256)..(256): n is a, c, g, or t
  modified_base (335)..(348): a, c, t, g, unknown or other
  misc_feature (335)..(348): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtgggccctcctctcagccaggaccaaggacagcagcctccaccaaggcccatcgtctcccctgccacctcctcagagcacctntggggcacagccggcctgggctgcctgtcaaggactactccgagtgcgtctctgacgcgggctggacaaggcgcatagnnnnnnnnnnnnnn

SEQ ID NO: 86991 - DNA, 181 bp, Homo sapiens
  misc_feature: GYAE6OF01AVIJO.1.89.I01.1.454.CMB.1.raw
  modified_base (171)..(181): a, c, t, g, unknown or other
  misc_feature (171)..(181): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnnnnnnnnnnn

SEQ ID NO: 86992 - DNA, 173 bp, Homo sapiens
  misc_feature: GYAE6OF01DCE4P.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactcgagcgggctggcaaggcgcatagnnnn

SEQ ID NO: 86993 - DNA, 627 bp, Homo sapiens
  misc_feature: GYAE6OF01BPZDB.1.89.I01.1.454.CMB.1.raw
  modified_base (193)..(193): a, c, t, g, unknown or other
  misc_feature (193)..(193): n is a, c, g, or t
  modified_base (603)..(603): a, c, t, g, unknown or other
  misc_feature (603)..(603): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccacctgtctttgctcgaggggaangccacctctcctgcagggccagtcagagtgttagcagctacttagcctaggtaccaacagaaacctggccaggcctcccgaggcctcctcatctatgactacataccaacgacgggccacgtggactactcccagccgtaggttcaggtggactaggtgggtctggggacagtacttcactctacacctatcgacgactacgactacggacgtccgtaggtaagttacttttgacttaagttttacttacgttgtactagtcgtaggtaccgtagaccgtaacgtcggtacccttcgttaccgttaccgtttccggaccccgttagggaacccttaagggtacggtaacttaacgtaaccgtaaaaccggtcttagggtcggtactaccgtacctaccgtactttccgtntttacccttccgtccttaccccgg

SEQ ID NO: 86994 - DNA, 178 bp, Homo sapiens
  misc_feature: GYAE6OF01EYY63.1.89.I01.1.454.CMB.1.raw
  modified_base (171)..(178): a, c, t, g, unknown or other
  misc_feature (171)..(178): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctactgctagtctgagcgggctggcaaggcgcatagnnnnnnnn

SEQ ID NO: 86995 - DNA, 297 bp, Homo sapiens
  misc_feature: GYAE6OF01A6PIT.1.89.I01.1.454.CMB.1.raw
  modified_base (51)..(51): a, c, t, g, unknown or other
  misc_feature (51)..(51): n is a, c, g, or t
  modified_base (231)..(232): a, c, t, g, unknown or other
  misc_feature (231)..(232): n is a, c, g, or t
  modified_base (234)..(241): a, c, t, g, unknown or other
  misc_feature (234)..(241): n is a, c, g, or t
  modified_base (243)..(297): a, c, t, g, unknown or other
  misc_feature (243)..(297): n is a, c, g, or t
tcagacgagtgcgtcacgaccggtgctcgatttagtatgctagtatcgggnggggacgaggcccgattattactgcgggacctggggattaccagttctgagttctgtggtgttcggcggagggaccaagctgaccgtcgcaggttcagcccaagttcgttcgccccctcggtcacttctgttcccgccctctctagagacacgctgagcgggctggcgaaggcgcatagnngnnnnnnnngnnnnnnnnnnnnnnnnnnnnnnnnnnnnnnnnnnnnnnnnnnnnnnnnnnnnnnn

SEQ ID NO: 86996 - DNA, 190 bp, Homo sapiens
  misc_feature: GYAE6OF01BT9B1.1.89.I01.1.454.CMB.1.raw
  modified_base (112)..(112): a, c, t, g, unknown or other
  misc_feature (112)..(112): n is a, c, g, or t
  modified_base (175)..(190): a, c, t, g, unknown or other
  misc_feature (175)..(190): n is a, c, g, or t
tcagacgagtgcgtcacgaccggtgctcgatttagtatgctagtatcggcgggggggtgttcggcggagggaccaaactgaccgtcctaggtcagcccaaggctgccccctntgtcactctgttccccaccctcctctgtcgagcgtctgagcgggctggcaagggcgctatagnnnnnnnnnnnnnnnn

SEQ ID NO: 86997 - DNA, 714 bp, Homo sapiens
  misc_feature: GYAE6OF01B73RU.1.89.I01.1.454.CMB.1.raw
  modified_base (199)..(199): a, c, t, g, unknown or other
  misc_feature (199)..(199): n is a, c, g, or t
  modified_base (696)..(696): a, c, t, g, unknown or other
  misc_feature (696)..(696): n is a, c, g, or t
tcagacgagtgcgtcacgaccggtgctcgatttagtatgctagtatgggggaggaactgctcagttaggacccagagggaaccatggaagccccagctcagcttctcttcctctgctactctggctccagactaccaccggagaaattgtgttgacacagtctccagcccacctgttctttgtcctccgaaggggaaancgcccaccctctcctgcgagggccagtcaggtagtgttagcagtcttaacgttacgccgttaggtaaccaaacgaacgaaaccgttggacccaagggtcccttaccccggaaggtcccttccctacaacttcctaattcgaaacttaacctacgtaacccgaaacggaccgggacccaaggtcggacctaccgttacccccgaaggccccgttaagggttccagggttcggaccggtaggttcggggtccgttagggggaacctaggtccctttacgacctttccgacaacctatccgaagtccgaagtccgtaagaccgtacgtacgtaagtttctttagacgtttaagtttacgttcgtacggtacacgtacgtacgtcggtaacaccgttaacgtccggttaaccctccttaccggtttacccgttccgggaccgttaacggaacctaaggtcgtaactacgtaaacgaacgtcgtggacggtcacgctacctntcttagtcttctcgtccc

SEQ ID NO: 86998 - DNA, 173 bp, Homo sapiens
  misc_feature: GYAE6OF01CDKVR.1.89.I01.1.454.CMB.1.raw
  modified_base (169)..(173): a, c, t, g, unknown or other
  misc_feature (169)..(173): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcctacagtgctctgagcgggctggcaaggcgcatagnnnnn

SEQ ID NO: 86999 - DNA, 194 bp, Homo sapiens
  misc_feature: GYAE6OF01D4SYW.1.89.I01.1.454.CMB.1.raw
  modified_base (173)..(194): a, c, t, g, unknown or other
  misc_feature (173)..(194): n is a, c, g, or t
tcagacgagtgcgtcacgaccggtgctcgatttagtatgctagtatcggcggggggggtgttcggcggagggaccaaacgtgaccgtcctaggtcagcccaaggctgccccctggtcactctgttcccgccctcctctgtcgagcgtctgagcgggctggcaaggcgcatagnnnnnnnnnnnnnnnnnnnnnn

SEQ ID NO: 87000 - DNA, 172 bp, Homo sapiens; identical to SEQ ID NO: 86723
  misc_feature: GYAE6OF01AIOAM.1.89.I01.1.454.CMB.1.raw
  modified_base (171)..(172): a, c, t, g, unknown or other
  misc_feature (171)..(172): n is a, c, g, or t

SEQ ID NO: 87001 - DNA, 171 bp, Homo sapiens
  misc_feature: GYAE6OF01EAUGR.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcgtcactctgttcccaccctcctcacgtctactgctgagcgggctggcaaggcgcatagnnn

SEQ ID NO: 87002 - DNA, 172 bp, Homo sapiens
  misc_feature: GYAE6OF01CLOE5.1.89.I01.1.454.CMB.1.raw
  modified_base (172)..(172): a, c, t, g, unknown or other
  misc_feature (172)..(172): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccaccctcctcacgtctactgctgagcgggctggcaaggcgcatagn

SEQ ID NO: 87003 - DNA, 192 bp, Homo sapiens
  misc_feature: GYAE6OF01BG9AV.1.89.I01.1.454.CMB.1.raw
  modified_base (187)..(192): a, c, t, g, unknown or other
  misc_feature (187)..(192): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctcacgtagcgtgctgagcgggctggcaaggcgcatagnnnnnn

SEQ ID NO: 87004 - DNA, 173 bp, Homo sapiens; identical to SEQ ID NO: 86981
  misc_feature: GYAE6OF01E2WME.1.89.I01.1.454.CMB.1.raw
  modified_base (171)..(173): a, c, t, g, unknown or other
  misc_feature (171)..(173): n is a, c, g, or t

SEQ ID NO: 87005 - DNA, 173 bp, Homo sapiens; identical to SEQ ID NO: 86981
  misc_feature: GYAE6OF01BFSDS.1.89.I01.1.454.CMB.1.raw
  modified_base (171)..(173): a, c, t, g, unknown or other
  misc_feature (171)..(173): n is a, c, g, or t

SEQ ID NO: 87006 - DNA, 669 bp, Homo sapiens
  misc_feature: GYAE6OF01C3DGX.1.89.I01.1.454.CMB.1.raw
tcagacgagtgcgtcacgaccggtgctcgatttagtatgctagtatcggcgggggggggtctcaggaggcagcgctctcaggacatctccaccatggcctgggctctgctgctcctcaccctctcactcagggcacaggtgacgcctccgaggggaaggggcttcgagggacctcgtgggctgatccttggtctcctgctctcaggctcgaccgggccagcactgactcacgtggctattggtcttttcctccttctttccgaagtcgttccgtcgggccctaggtcctcgcccctagacctcgacgccctgcccttccggtgttccgtacgggttcctaccgtgggaactggttcactaccaccctatttccctcgtgaccgtaacgtacggaaacccaggccgtaaggttcgtacgggttttgggtaacggttatcgggtaacttacgttcgttaccgtccgtaacggttaacccaaacgtactacccgaacccgaacgggaacccgaaaccggcccctaagtacctacgtaagttacgtaatttagaggtaacggtactacgtacgtacgtccggtacccttaggtacgggtttactaacgttccgtacttctcgtacgtctacgtacgtcgtacggacctaaccgaccgtccctacctgcctacg

SEQ ID NO: 87007 - DNA, 165 bp, Homo sapiens
  misc_feature: GYAE6OF01CY5BA.1.89.I01.1.454.CMB.1.raw
  modified_base (161)..(161): a, c, t, g, unknown or other
  misc_feature (161)..(161): n is a, c, g, or t
  modified_base (165)..(165): a, c, t, g, unknown or other
  misc_feature (165)..(165): n is a, c, g, or t
tcagacgagtgcgtcacgaccggtgctcgatttagtatgctagtatcgcgggggggtgttcggcggagggaccaaactgaccgtcctaggtcagcccaaggctgcccctggtcactctgttcccaccctctctactgctagtctgagcggctggcaaggcnatgn

SEQ ID NO: 87008 - DNA, 172 bp, Homo sapiens
  misc_feature: GYAE6OF01BPKF2.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgcccccccggtcactctgttcccgccctcctcatagcgtactctgagcgggctggcaaggcgcatagnn

SEQ ID NO: 87009 - DNA, 170 bp, Homo sapiens
  misc_feature: GYAE6OF01CPMV6.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctcgtactgcgctgagcgggctggcaaggcgcatagnn

SEQ ID NO: 87010 - DNA, 174 bp, Homo sapiens
  misc_feature: GYAE6OF01AQD6J.1.89.I01.1.454.CMB.1.raw
  modified_base (164)..(164): a, c, t, g, unknown or other
  misc_feature (164)..(164): n is a, c, g, or t
  modified_base (170)..(174): a, c, t, g, unknown or other
  misc_feature (170)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcgggctggcaaggcncatagnnnnn

SEQ ID NO: 87011 - DNA, 198 bp, Homo sapiens
  misc_feature: GYAE6OF01EHFRC.1.89.I01.1.454.CMB.1.raw
  modified_base (174)..(198): a, c, t, g, unknown or other
  misc_feature (174)..(198): n is a, c, g, or t
tcagacgagtgcgtcacgaccggtgctcgatttagtatgctagtatcggcggggggggtagttcggcggagggaccaaactgaccgtcctaggtcagcccaaggctgccccctcggtcactctgttcccaccctcctcacgtagcgtgctgagcgggctggcaaggcgcatagnnnnnnnnnnnnnnnnnnnnnnnnn

SEQ ID NO: 87012 - DNA, 221 bp, Homo sapiens
  misc_feature: GYAE6OF01ERFN3.1.89.I01.1.454.CMB.1.raw
  modified_base (161)..(161): a, c, t, g, unknown or other
  misc_feature (161)..(161): n is a, c, g, or t
  modified_base (167)..(221): a, c, t, g, unknown or other
  misc_feature (167)..(221): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctctcacgtctactgctgagcggctggcaaggcncatagnnnnnnnnnnnnnnnnnnnnnnnnnnnnnnnnnnnnnnnnnnnnnnnnnnnnnnn

SEQ ID NO: 87013 - DNA, 636 bp, Homo sapiens
  misc_feature: GYAE6OF01BRBSD.1.89.I01.1.454.CMB.1.raw
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
  modified_base (487)..(487): a, c, t, g, unknown or other
  misc_feature (487)..(487): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacagagtcctgggcccagtctgccctgactcagcctgcctccgtgtctgggtctctggacagtcgatcacatcctctgcactcggaaccagcagtgtacggttggtggttangactatcgtctcctaggtaccaacactccaaccgaggacaaacggccccaagactcatgtattanggtagtctagtcacgtccgaccgttcgtaggggtttactaagttccgtactttctcgtcggtaccttaccgaaacgttcgtacgacgtaaccgaccggtccctcccgtacgacctactccgtcgtcgtccctacgacggtcgtaggacggtacgacggcttagttacttagttacgngactacgtacctactaacgtaactaacgaagtacgtaaacgtaacgtaaccgttacggttaaacggggtttccgaaacgggaaccggtaaacgaacggttccgtaaccggtaccgtacgtaacgggtaccacgggtacccgaaacccgg

SEQ ID NO: 87014 - DNA, 178 bp, Homo sapiens
  misc_feature: GYAE6OF01EOL4Z.1.89.I01.1.454.CMB.1.raw
  modified_base (165)..(165): a, c, t, g, unknown or other
  misc_feature (165)..(165): n is a, c, g, or t
  modified_base (171)..(178): a, c, t, g, unknown or other
  misc_feature (171)..(178): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcccaccctcctcatagcgtactctgagcgggctggcaaggcncatagnnnnnnnn

SEQ ID NO: 87015 - DNA, 172 bp, Homo sapiens; identical to SEQ ID NO: 86723
  misc_feature: GYAE6OF01DWCX4.1.89.I01.1.454.CMB.1.raw
  modified_base (171)..(172): a, c, t, g, unknown or other
  misc_feature (171)..(172): n is a, c, g, or t

SEQ ID NO: 87016 - DNA, 197 bp, Homo sapiens
  misc_feature: GYAE6OF01CL6TP.1.89.I01.1.454.CMB.1.raw
  modified_base (173)..(197): a, c, t, g, unknown or other
  misc_feature (173)..(197): n is a, c, g, or t
tcagacgagtgcgtcacgaccggtgctcgatttagtatgctagtatcggcggggggggtgttcggcggagggaccaaactgaccgtcctaggtcagcccaaggctgccccctcggtcactctgttcccaccctcctctactgctagtctgagcgggctggcaaggcgcatagnnnnnnnnnnnnnnnnnnnnnnnnn

SEQ ID NO: 87017 - DNA, 172 bp, Homo sapiens; identical to SEQ ID NO: 86723
  misc_feature: GYAE6OF01A1AQS.1.89.I01.1.454.CMB.1.raw
  modified_base (171)..(172): a, c, t, g, unknown or other
  misc_feature (171)..(172): n is a, c, g, or t

SEQ ID NO: 87018 - DNA, 740 bp, Homo sapiens
  misc_feature: GYAE6OF01CXZEK.1.89.I01.1.454.CMB.1.raw
  modified_base (418)..(418): a, c, t, g, unknown or other
  misc_feature (418)..(418): n is a, c, g, or t
tcagacgagtgcgtcacgaccggtgctcgatttagtatgctagtatcggcggggggggtctcaggaggcagcgctctcaggacatctccaccatggcctgggctctgctgctcctcaccctcctcactcgagggcacaggtgacgcctccgaggggaaggggcttcgagggacctcgtgggctgatccttggtctcctgcctcctcaggcctccgaccgggcccagcactgactcactggctagtgttcgtttcctcccttactttccgaagtcgttccgtcgggccctaggttcctcggacccctggacctcgacgtccctcgccccttccggtgtccgttcgggtccttacccgtagggacctaggttccaacttccaaccgtacttccgtcctgacctaaccgtagggaaacccnggtccgtaggttacggtacggtttgggtttaggtttaatcgggtaacctttgttccgttaccgttaccgttacgggtaaaccctaaactaccgttaacccaacccggaacggaaccgaaaacccgggcccctaaggtaccttacaagttacgttaattttaagacggtacggtacacggttacctacggtacccggtacccgttacggttacgggttttactacgttccggtcctttccgtcgtcggtacccttacgtaacggttcccgtacgggtacctaacccgtacccgggtccccttacccgtacggtaacccttccg

SEQ ID NO: 87019 - DNA, 172 bp, Homo sapiens
  misc_feature: GYAE6OF01EY78U.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtcgagcgggctggcaaggcgcatagnnn

SEQ ID NO: 87020 - DNA, 190 bp, Homo sapiens
  misc_feature: GYAE6OF01DOZNV.1.89.I01.1.454.CMB.1.raw
  modified_base (58)..(58): a, c, t, g, unknown or other
  misc_feature (58)..(58): n is a, c, g, or t
  modified_base (170)..(190): a, c, t, g, unknown or other
  misc_feature (170)..(190): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccgccctcctcatagcgtactctgagcgggctggcaaggcgcatagnnnnnnnnnnnnnnnnnnnnn

SEQ ID NO: 87021 - DNA, 549 bp, Homo sapiens
  misc_feature: GYAE6OF01A4PVR.1.89.I01.1.454.CMB.1.raw
  modified_base (174)..(175): a, c, t, g, unknown or other
  misc_feature (174)..(175): n is a, c, g, or t
  modified_base (177)..(179): a, c, t, g, unknown or other
  misc_feature (177)..(179): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (242)..(243): a, c, t, g, unknown or other
  misc_feature (242)..(243): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (537)..(537): a, c, t, g, unknown or other
  misc_feature (537)..(537): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgcctcctctactgctagtctgagcgggctggcaaggcgacagtagctgnngnnngtacgcgtcgcgacgcgcgngtcgacncgagtcagtcgacgctgngacncgtncgncgancgnngancngntcgtacgngtcgtanacgtgngacgctgtcgcgtcgacgtcgcttcgacggctgaaccggngtacgngtagacgtcacgtacgagtacacgtagaccgtgacgtgtaaccgtagcgacgttcgaagacgtacgtacgtacgtcgtacgcgtacgtacgtacgtacgacgtacgacgtacgacgtacgacgacgacgtagacgtacgtacgacgacgtcgacgtacgacgtagtacgacgcgacgacgacgagtacgtcgtacgtagtcgacgtacgtacgacgacgngacgtccgtgcg

SEQ ID NO: 87022 - DNA, 384 bp, Homo sapiens
  misc_feature: GYAE6OF01CGP3F.1.89.I01.1.454.CMB.1.raw
  modified_base (367)..(384): a, c, t, g, unknown or other
  misc_feature (367)..(384): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccggtgggccctcctctcagccaggaccaaggacagcacgcctaccaaccaacgggcccagtccggtccttcccccgtggcctacccctcctaccaagcgccacctcgtgggggcacgacgccggcccgtgggcctcgcctgggcaaggctacttccgagtcgcgtctctgacgcgggctggcgaaggcgcagtagnnnnnnnnnnnnnnnnnn

SEQ ID NO: 87023 - DNA, 755 bp, Homo sapiens
  misc_feature: GYAE6OF01EKUZG.1.89.I01.1.454.CMB.1.raw
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtcttttgtcctccgaaggggaaagacgcccaccctctcctgcgacgggccagtcagagtgttagcagccttacttagcctaggtaccaacacgaaacctggccaggcctcccgaggcctcctcatctatgatacactccaacgacgggccaacgtcggaccacgtcccaggccctaagggtttcaggttcggcgtaggtcggggtcgtagggggacacggtactttccaaccgttctaccaccctagtaccaggaccacggtacccgtaaggacgtacccgttaaggtaaacgttagtttttacggacctttaagttttaacttacgttacgtacacggtacgtaggtacggttaacgaccgaacgttccggtacccttccgttaccgttaccgttttcccgggaccccggttaacggggtaaacccgtaaacggggttacggtaaaccttaaccggttaaaccgaaaacccgggttaaccggttacgggttaccgggtccgttaccggtaacccgttaacccgttaacgtttaccgttaccggttttacccttttaccgtacccgttttaccccccgg

SEQ ID NO: 87024 - DNA, 170 bp, Homo sapiens
  misc_feature: GYAE6OF01CKFUT.1.89.I01.1.454.CMB.1.raw
tcagacgagtgcgtcacgaccggtgctcgatttagtatgctagtatcgcgggggaatgttcggcgggggaccaagctgaccgtcttaggtcagcccaaggctgcccccctcggtcactctgttcccaccctcctctgtcgagcgtctgagcgggctggcaaggcgcatag

SEQ ID NO: 87025 - DNA, 208 bp, Homo sapiens
  misc_feature: GYAE6OF01EYC62.1.89.I01.1.454.CMB.1.raw
  modified_base (173)..(208): a, c, t, g, unknown or other
  misc_feature (173)..(208): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccgccctcctcacgtagcgtgctgaggcgggctggcaaggcgcatagnnnnnnnnnnnnnnnnnnnnnnnnnnnnnnnnnnnn

SEQ ID NO: 87026 - DNA, 220 bp, Homo sapiens
  misc_feature: GYAE6OF01AZZI7.1.89.I01.1.454.CMB.1.raw
  modified_base (58)..(58): a, c, t, g, unknown or other
  misc_feature (58)..(58): n is a, c, g, or t
  modified_base (169)..(220): a, c, t, g, unknown or other
  misc_feature (169)..(220): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccgccctctctactgctagtctgagcgggctggcaaggcgcatagnnnnnnnnnnnnnnnnnnnnnnnnnnnnnnnnnnnnnnnnnnnnnnnnnnnn

SEQ ID NO: 87027 - DNA, 235 bp, Homo sapiens
  misc_feature: GYAE6OF01BXQZR.1.89.I01.1.454.CMB.1.raw
  modified_base (117)..(117): a, c, t, g, unknown or other
  misc_feature (117)..(117): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (179)..(235): a, c, t, g, unknown or other
  misc_feature (179)..(235): n is a, c, g, or t
tcagacgagtgcgtcacgaccggtgctcgatttagtatgctagtatcgcggggggggtgttcgggcggagggtaccaaactgaccgtcctaggtcagcccaaggctgccccctggtnactctgttcccaccctcctcatgcgtactctgagcgggtctggcaagggcgtcatagntncnnnnnnnnnnnnnnnnnnnnnnnnnnnnnnnnnnnnnnnnnnnnnnnnnnnnnnnnn

SEQ ID NO: 87028 - DNA, 172 bp, Homo sapiens; identical to SEQ ID NO: 86723
  misc_feature: GYAE6OF01ERCLX.1.89.I01.1.454.CMB.1.raw
  modified_base (171)..(172): a, c, t, g, unknown or other
  misc_feature (171)..(172): n is a, c, g, or t

SEQ ID NO: 87029 - DNA, 185 bp, Homo sapiens
  misc_feature: GYAE6OF01D4WCZ.1.89.I01.1.454.CMB.1.raw
  modified_base (172)..(185): a, c, t, g, unknown or other
  misc_feature (172)..(185): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccgccctcctctactgctagtctgagcgggctggcaaggcgcatagnnnnnnnnnnnnnn

SEQ ID NO: 87030 - DNA, 186 bp, Homo sapiens
  misc_feature: GYAE6OF01D1COQ.1.89.I01.1.454.CMB.1.raw
  modified_base (174)..(186): a, c, t, g, unknown or other
  misc_feature (174)..(186): n is a, c, g, or t
tcagacgagtgcgtcacgaccggtgctcgatttagtatgctagtatcggcgggggggtgttcggcggagggaccaaactgaccgtcctaggtcagcccaaggccaaccccactgtccactctgttcccaccctcctcgagtcgcgtctctgacgcgggctggcaaggcgcatgnnnnnnnnnnnnn

SEQ ID NO: 87031 - DNA, 171 bp, Homo sapiens; identical to SEQ ID NO: 86763
  misc_feature: GYAE6OF01D56R3.1.89.I01.1.454.CMB.1.raw
  modified_base (171)..(171): a, c, t, g, unknown or other
  misc_feature (171)..(171): n is a, c, g, or t

SEQ ID NO: 87032 - DNA, 182 bp, Homo sapiens
  misc_feature: GYAE6OF01AT1W3.1.89.I01.1.454.CMB.1.raw
  modified_base (165)..(165): a, c, t, g, unknown or other
  misc_feature (165)..(165): n is a, c, g, or t
  modified_base (170)..(182): a, c, t, g, unknown or other
  misc_feature (170)..(182): n is a, c, g, or t
tcagacgagtgcgtcacgaccggtgctcgatttagtatgctagtatcgcggggggtgttcggcggagggaccgaaacgtgaccgtcctaggtcagcccaaggctgcccctcggtcacctctgttcccaccctcctcacgtagcgtgctgagcggctggcaaggcncatgnnnnnnnnnnnnn

SEQ ID NO: 87033 - DNA, 224 bp, Homo sapiens
  misc_feature: GYAE6OF01B7G8X.1.89.I01.1.454.CMB.1.raw
  modified_base (184)..(184): a, c, t, g, unknown or other
  misc_feature (184)..(184): n is a, c, g, or t
  modified_base (189)..(224): a, c, t, g, unknown or other
  misc_feature (189)..(224): n is a, c, g, or t
tcagacgagtgcgtcacgaccggtgctcgatttagtatgctagtatgggatgacgagcctgacgtgcccttatgtcttcggaactgggtaccaaggtcaccgtcctaggtcagccaaggccaaccccactgcactctcgttccgccctctcacgtatcgtgctgagtcggtctggtacaaggcncatgnnnnnnnnnnnnnnnnnnnnnnnnnnnnnnnnnnnn

SEQ ID NO: 87034 - DNA, 168 bp, Homo sapiens
  misc_feature: GYAE6OF01DM3LM.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgcctcctcctacagtgctctgagcgggctggcaaggcgcatagn

SEQ ID NO: 87035 - DNA, 202 bp, Homo sapiens
  misc_feature: GYAE6OF01CUQXT.1.89.I01.1.454.CMB.1.raw
  modified_base (164)..(164): a, c, t, g, unknown or other
  misc_feature (164)..(164): n is a, c, g, or t
  modified_base (170)..(202): a, c, t, g, unknown or other
  misc_feature (170)..(202): n is a, c, g, or t
tcagacgagtgcgtcacgaccggtgctcgatttagtatgctagtatcggcggggggtgttcggcggagggaccaaactgaccgtcctaggtcagcccaaggtctgccccctggtcactctgttcccaccctcctcacgtagcgtgctgagcggctggcaaggcncatagnnnnnnnnnnnnnnnnnnnnnnnnnnnnnnnnn

SEQ ID NO: 87036 - DNA, 172 bp, Homo sapiens
  misc_feature: GYAE6OF01ESGKZ.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctcgccccctggtcactctgttcccgccctcctcacgtagcgtgctgagcgggctggcaaggcgcatagnn

SEQ ID NO: 87037 - DNA, 172 bp, Homo sapiens; identical to SEQ ID NO: 86593
  misc_feature: GYAE6OF01EOOTY.1.89.I01.1.454.CMB.1.raw
  modified_base (171)..(172): a, c, t, g, unknown or other
  misc_feature (171)..(172): n is a, c, g, or t

SEQ ID NO: 87038 - DNA, 173 bp, Homo sapiens
  misc_feature: GYAE6OF01CAT7J.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttctcaccctcctctgtcgagcgtctgagcgggctggcaaggcgcatagnnn

SEQ ID NO: 87039 - DNA, 174 bp, Homo sapiens
  misc_feature: GYAE6OF01AVHO5.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcacgtagcgtgctgagcgggctggcaaggcgcatagnnnn

SEQ ID NO: 87040 - DNA, 615 bp, Homo sapiens
  misc_feature: GYAE6OF01D4LY8.1.89.I01.1.454.CMB.1.raw
  modified_base (249)..(249): a, c, t, g, unknown or other
  misc_feature (249)..(249): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (381)..(381): a, c, t, g, unknown or other
  misc_feature (381)..(381): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccgagggaaggggcttcgagggacctcgtgggctgatccttggtctcctgctctcaggctcgaccggggccagcactgactcactggcatgtgtttctccctnttccagtacgtcctgggcccagtctgccctgactcagcctgccttcgtgtcgtggtctcgtggacagtcgatccacctntcctccngcacgtaggaaccagcgtagtcgtacggttggtagtatgtaacttntcgtcttccgtacggtaaccaactactaccgaaccgacggaaccgtaaccgggaccccaagtacctcgtaagtacgtaactttagtacggtaggtacgacgtccgtacgttccggtcccttacggttacggggtttactaacgttccgtacgttccttaccggtcggtaccttacccgtaagttccgtacggaccctaaccggtacccgtcccgttacccgtcgaacccttacg

SEQ ID NO: 87041 - DNA, 171 bp, Homo sapiens; identical to SEQ ID NO: 86695
  misc_feature: GYAE6OF01CHTIY.1.89.I01.1.454.CMB.1.raw
  modified_base (171)..(171): a, c, t, g, unknown or other
  misc_feature (171)..(171): n is a, c, g, or t

SEQ ID NO: 87042 - DNA, 357 bp, Homo sapiens
  misc_feature: GYAE6OF01AN69T.1.89.I01.1.454.CMB.1.raw
  modified_base (344)..(357): a, c, t, g, unknown or other
  misc_feature (344)..(357): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctgggggcacagcggccctgggctgcctggtcaaggactacttccgagtgcgtctctgagtcgggctggcaaggcgcatagnnnnnnnnnnnnnn

SEQ ID NO: 87043 - DNA, 175 bp, Homo sapiens
  misc_feature: GYAE6OF01DSD2C.1.89.I01.1.454.CMB.1.raw
  modified_base (173)..(175): a, c, t, g, unknown or other
  misc_feature (173)..(175): n is a, c, g, or t
tcagacgagtgcgtcacgaccggtgctcgatttagtatgctagtatcggcggggggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 87044 - DNA, 174 bp, Homo sapiens; identical to SEQ ID NO: 86688
  misc_feature: GYAE6OF01D58IE.1.89.I01.1.454.CMB.1.raw
  modified_base (171)..(174): a, c, t, g, unknown or other
  misc_feature (171)..(174): n is a, c, g, or t

SEQ ID NO: 87045 - DNA, 206 bp, Homo sapiens
  misc_feature: GYAE6OF01ENVVP.1.89.I01.1.454.CMB.1.raw
  modified_base (172)..(206): a, c, t, g, unknown or other
  misc_feature (172)..(206): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccgccctcctctcgtactgcgctggagcgggctggcaaggcgcatagnnnnnnnnnnnnnnnnnnnnnnnnnnnnnnnnnnn

SEQ ID NO: 87046 - DNA, 390 bp, Homo sapiens
  misc_feature: GYAE6OF01CY1YU.1.89.I01.1.454.CMB.1.raw
  modified_base (266)..(266): a, c, t, g, unknown or other
  misc_feature (266)..(266): n is a, c, g, or t
  modified_base (366)..(366): a, c, t, g, unknown or other
  misc_feature (366)..(366): n is a, c, g, or t
  modified_base (373)..(390): a, c, t, g, unknown or other
  misc_feature (373)..(390): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtgggccctcctctcagccaggaccaaggacagcagcctccaaccgaagggcccatccggtccttcccccgtggcctaccctcctccaacgacnccaccgtcggtcggggccaacgacggccggcccgtgggctcgccgtggtacaacggtacctacgtccgagtcgcgttctctggacgcggctggacaggcntagtagnnnnnnnnnnnnnnnnnn

SEQ ID NO: 87047 - DNA, 171 bp, Homo sapiens; identical to SEQ ID NO: 86763
  misc_feature: GYAE6OF01BAQXE.1.89.I01.1.454.CMB.1.raw
  modified_base (171)..(171): a, c, t, g, unknown or other
  misc_feature (171)..(171): n is a, c, g, or t

SEQ ID NO: 87048 - DNA, 241 bp, Homo sapiens
  misc_feature: GYAE6OF01A9LWO.1.89.I01.1.454.CMB.1.raw
  modified_base (226)..(241): a, c, t, g, unknown or other
  misc_feature (226)..(241): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccgagggcagggtcagcagtgctggccgtcggggccctcctcacgtctactgctgagcgggctggcgaaggcgctatagnnnnnnnnnnnnnnnn

SEQ ID NO: 87049 - DNA, 389 bp, Homo sapiens
  misc_feature: GYAE6OF01EZ495.1.89.I01.1.454.CMB.1.raw
  modified_base (372)..(372): a, c, t, g, unknown or other
  misc_feature (372)..(372): n is a, c, g, or t
  modified_base (379)..(389): a, c, t, g, unknown or other
  misc_feature (379)..(389): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcgaccggagcccagggcagggtcagcagtgctggccgtgggccctcctctcagccaggaccaaggacagcacgcctccaccgaagggcccatccggtccttccccccgtggccacccctcctccaaagacgccaccctcgtgggggccacgacggccggcctgggctcggccgtggtacaaggacctaccgtttccggagtcggccgtactcgtggacgcgggtctggcaaggcncatacgnnnnnnnnnnn

SEQ ID NO: 87050 - DNA, 173 bp, Homo sapiens
  misc_feature: GYAE6OF01EJEHA.1.89.I01.1.454.CMB.1.raw
  modified_base (172)..(173): a, c, t, g, unknown or other
  misc_feature (172)..(173): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccaccctcctcatagcgtactctgagcgggctggcaaggcgcatagnn

SEQ ID NO: 87051 - DNA, 183 bp, Homo sapiens
  misc_feature: GYAE6OF01C9KLQ.1.89.I01.1.454.CMB.1.raw
  modified_base (168)..(168): a, c, t, g, unknown or other
  misc_feature (168)..(168): n is a, c, g, or t
  modified_base (173)..(183): a, c, t, g, unknown or other
  misc_feature (173)..(183): n is a, c, g, or t
tcagacgagtgcgtcacgaccggtgctcgatttagtatgctagtatcggcggggggggtgttcggcggagggaccaaactgaccgtctaggtcagcccaaggctgccccctggtcactctcgttcccgccctcctcatagcgtactctgaggcgggctggcaaggcgnaatgnnnnnnnnnnn

SEQ ID NO: 87052 - DNA, 233 bp, Homo sapiens
  misc_feature: GYAE6OF01DGVBL.1.89.I01.1.454.CMB.1.raw
  modified_base (224)..(233): a, c, t, g, unknown or other
  misc_feature (224)..(233): n is a, c, g, or t
tcagacgagtgcgtcacgaccggtgctcgatttagtatgctagtatcgcgggggcccaggcagatgatgaatctaattattactgtttgctttattttgatagtggctgggtgttcggcggcggaccaagctgaccgtcctaggtcagcccaaggctgtcccctggtcactctgttcccaccctcctctatacgatcgctgagcgggctggcaaggcgcatagnnnnnnnnnn

SEQ ID NO: 87053 - DNA, 175 bp, Homo sapiens
  misc_feature: GYAE6OF01A73JC.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcggcggggggtgttcggcggaggaccaaactgaccgtcctaggtcagcccaaggctgccccctcggtcactctgttcccaccctcctctactgctagtctgagcgggctggcaaggcgcatagnnnnnn

SEQ ID NO: 87054 - DNA, 174 bp, Homo sapiens; identical to SEQ ID NO: 86894
  misc_feature: GYAE6OF01DUFOV.1.89.I01.1.454.CMB.1.raw
  modified_base (171)..(174): a, c, t, g, unknown or other
  misc_feature (171)..(174): n is a, c, g, or t

SEQ ID NO: 87055 - DNA, 177 bp, Homo sapiens
  misc_feature: GYAE6OF01EAXV6.1.89.I01.1.454.CMB.1.raw
  modified_base (172)..(177): a, c, t, g, unknown or other
  misc_feature (172)..(177): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgctatagnnnnnn

SEQ ID NO: 87056 - DNA, 367 bp, Homo sapiens
  misc_feature: GYAE6OF01BJAH3.1.89.I01.1.454.CMB.1.raw
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
  modified_base (350)..(367): a, c, t, g, unknown or other
  misc_feature (350)..(367): n is a, c, g, or t
tcagacgagtgcgtcacgaccggtgctcgatttagtatgctagtatgggcacgaccgacctgagctcaggagtcagcagagcgagggaggaggagaggccccaggtgaacggaggggcttgtccaggccggcagcatcaccgaagcccagggcagggtcagcagtgctggccgtggggccctcctctcagccaggaccaaggacagcagcctccaccaagggcccatcggtccttccccctggccaccctcctccaagacgccaccgtcgtgggggcacgagccggccctgggctgcctggtcaaggctacttccncgtagcactctgagcggctggcaaggcncatagnnnnnnnnnnnnnnnnnn

SEQ ID NO: 87057 - DNA, 190 bp, Homo sapiens
  misc_feature: GYAE6OF01B6EZI.1.89.I01.1.454.CMB.1.raw
  modified_base (188)..(190): a, c, t, g, unknown or other
  misc_feature (188)..(190): n is a, c, g, or t
tcagacgagtgcgtcacgaccggtgctcgatttagtatgctagtatgggatgacagcctgagtgcccttatgtcttcggaactgggaccaaggtcaccgtcctaggtcagccaaggccaaccccactgtcactctcgttcccaccctcctctctctcgactctgaggcgggctggcaaggcgcatagnnn

SEQ ID NO: 87058 - DNA, 183 bp, Homo sapiens
  misc_feature: GYAE6OF01DOQVR.1.89.I01.1.454.CMB.1.raw
  modified_base (58)..(58): a, c, t, g, unknown or other
  misc_feature (58)..(58): n is a, c, g, or t
  modified_base (171)..(183): a, c, t, g, unknown or other
  misc_feature (171)..(183): n is a, c, g, or t
tcagacgagtgcgtcacgaccggtgctcgatttagtatgctagtatcgcgggggggtnttcggcggagggaccaaactgaccgtcctaggtcagcccaaggctgcccccctggtcactctgttccccaccctcctctagagacacgctgagcggctggcaaggcgcatagnnnnnnnnnnnnn

SEQ ID NO: 87059 - DNA, 178 bp, Homo sapiens
  misc_feature: GYAE6OF01A2HJ8.1.89.I01.1.454.CMB.1.raw
  modified_base (170)..(178): a, c, t, g, unknown or other
  misc_feature (170)..(178): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccccctcatagcgtactctgagcgggctggcaaggcgcatagnnnnnnnnn

SEQ ID NO: 87060 - DNA, 171 bp, Homo sapiens
  misc_feature: GYAE6OF01DNMTP.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcggcggggggggtgttcggcggagggaccaaactgaccgtcctaggtcagcccaaggctgccccctcggtcactctgttccaccctctctactgctgtctgaggcggctggcaaggcgcatagnn

SEQ ID NO: 87061 - DNA, 174 bp, Homo sapiens
  misc_feature: GYAE6OF01C7WMG.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctccgtgtctgatctgagcgggctggcaaggcgcatagnnnn

SEQ ID NO: 87062 - DNA, 671 bp, Homo sapiens
  misc_feature: GYAE6OF01C7LDK.1.89.I01.1.454.CMB.1.raw
  modified_base (655)..(655): a, c, t, g, unknown or other
  misc_feature (655)..(655): n is a, c, g, or t
  modified_base (664)..(664): a, c, t, g, unknown or other
  misc_feature (664)..(664): n is a, c, g, or t
tcagacgagtgcgtcacgaccggtgctcgatttagtatgctagtatcggcggggggggtctcaggaggcagcgctctcaggacatctccaccatggcctgggctctgctgcctcctcaccctcctcactcgagggcacaggtgacgcctaccgaaggggaaggggcttcgaggggacctcgtgggctgactccgttggtcctcctgctcctcaggcctcggacccgggcccagccactgacctcacgtggctagttgttcgttttcctccttcctttcgaagtcgtcccgtggccctaggtcctcgcccttgacctcacgtccgtcgtcccgtcgtgtcgtcggtacctcgtacggactagtcgactacctacctacttccgtctcgactacgtacggaacctaggcgtacggttcggtacggttttagggttacggttattacgtaactttgttccggttccttacccgttaacggtaccaaactaccgttacccgaaccgtaacggaaccgaaccgaccctaacgtaccagttacgttacgttatttacggtacggtagtagtaccgtacgaccgtccggtacccttgggtacggtttactaccgttctcttgtcggtcgtactacgtacgtccgacggtaccaccggtaccnccttcccgntactccg

SEQ ID NO: 87063 - DNA, 448 bp, Homo sapiens
  misc_feature: GYAE6OF01AZSL0.1.89.I01.1.454.CMB.1.raw
  modified_base (264)..(264): a, c, t, g, unknown or other
  misc_feature (264)..(264): n is a, c, g, or t
  modified_base (400)..(400): a, c, t, g, unknown or other
  misc_feature (400)..(400): n is a, c, g, or t
  modified_base (402)..(403): a, c, t, g, unknown or other
  misc_feature (402)..(403): n is a, c, g, or t
  modified_base (405)..(448): a, c, t, g, unknown or other
  misc_feature (405)..(448): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccgaagggcccatccggtccttcccccgtggccaccctcctccaagacnccacctcgtggggccacaggccggcccgtgggctcgccgtcggtacaacgggtaccttaccgttccggacgtcggccgttctcggtcgacggcggggtacctgggaccgaagggccgtacaacgtagctagcacgngnnannnnnnnnnnnnnnnnnnnnnnnnnnnnnnnnnnnnnnnnnnnn

SEQ ID NO: 87064 - DNA, 505 bp, Homo sapiens
  misc_feature: GYAE6OF01EUAAO.1.89.I01.1.454.CMB.1.raw
  modified_base (438)..(438): a, c, t, g, unknown or other
  misc_feature (438)..(438): n is a, c, g, or t
  modified_base (450)..(452): a, c, t, g, unknown or other
  misc_feature (450)..(452): n is a, c, g, or t
  modified_base (455)..(505): a, c, t, g, unknown or other
  misc_feature (455)..(505): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtcggggccctccgtctcacgccaggaccaaggacagcacgcctaccaaccgaacgggccctagtccgggtcccttccccccgtggccctacccctcccgtaccgaaacggtacgaccctacccgttcggtcggggggaccaacggaccggccgggtcccgtggggcctcggcccgtgggtaccgaaacgggtaccttaccgttccggagtcgtccgttctcgtaggcggcgggctcgggacgaacgggcgacaaacgtgctgctncgactgatgctnnncgnnnnnnnnnnnnnnnnnnnnnnnnnnnnnnnnnnnnnnnnnnnnnnnnnnn

SEQ ID NO: 87065 - DNA, 171 bp, Homo sapiens; identical to SEQ ID NO: 86391
  misc_feature: GYAE6OF01BBHNJ.1.89.I01.1.454.CMB.1.raw
  modified_base (170)..(171): a, c, t, g, unknown or other
  misc_feature (170)..(171): n is a, c, g, or t

SEQ ID NO: 87066 - DNA, 182 bp, Homo sapiens
  misc_feature: GYAE6OF01B3YA5.1.89.I01.1.454.CMB.1.raw
  modified_base (169)..(182): a, c, t, g, unknown or other
  misc_feature (169)..(182): n is a, c, g, or t
tcagacgagtgcgtcacgaccggtgctcgatttagtatgctagtatcgcgggggaatgttcggcgggggaccaagctgaccgtcttaggtcagcccaaggctgccccctggtcactctgttcccaccctcctctgtcgagcgtctgagcgggctggcaaggcgcatagnnnnnnnnnnnnnn

SEQ ID NO: 87067 - DNA, 175 bp, Homo sapiens
  misc_feature: GYAE6OF01E0BAV.1.89.I01.1.454.CMB.1.raw
  modified_base (172)..(175): a, c, t, g, unknown or other
  misc_feature (172)..(175): n is a, c, g, or t
tcagacgagtgcgtcacgaccggtgctcgatttagtatgctagtatcgcgggggggtgttcggcggagggaccaaactgaccgtcctaggtcagcccaaggctgcccccctcggtcactctgttcccaccctcctccgtgtctgatctgagcgggctggcaaggcgcatagnnnn

SEQ ID NO: 87068 - DNA, 194 bp, Homo sapiens
  misc_feature: GYAE6OF01DG79P.1.89.I01.1.454.CMB.1.raw
  modified_base (173)..(194): a, c, t, g, unknown or other
  misc_feature (173)..(194): n is a, c, g, or t
tcagacgagtgcgtcacgaccggtgctcgatttagtatgctagtatcggtcgggggggtgttcggcggagggaccaaactggaccgtcctaggtcagcccaaggctgccccctcggtcactctgttcccgccctcctcatagcgtactctgagcgggctggcaaggcgcatgnnnnnnnnnnnnnnnnnnnnnn

SEQ ID NO: 87069 - DNA, 757 bp, Homo sapiens
  misc_feature: GYAE6OF01BIYBQ.1.89.I01.1.454.CMB.1.raw
  modified_base (434)..(434): a, c, t, g, unknown or other
  misc_feature (434)..(434): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccgaggggaaggggcttcgagggacctcgtgggctgatccttggtctcctgctcctcgaggctccgaccgggcccagcactgactcacgtggctagtgttcgtttccttcccttctttccgagtccgttcccggtcgggtcccctaggttccgtccgaccctcgtacctccgacgtcccgtccgtcccgttccggttcggttccggttcggggtacccttccggtagggaccgtacgttccgaactcccacctccttccctaccgtgaccgtacggtaccggaaaccncggtcgtaggtccggttaggtttcggttaggttatacgttacgttacgttccggttcccttaccggttaaccggtaaccaacgtccctacccggaacccggaacggtacccgaaacccggtcccctaagttcccgtatagtttagttaacgtttcgggtagtacgttaccgtaagtcccggtaccgttcccgggttacccgttaaggggttaccggtttaccaccggttcgtttccttccggtccgtcggtaccctaccggttaggtcccgtacccggtaaaccacccggtccccgggtttaccccacccgttgaacccttcg

SEQ ID NO: 87070 - DNA, 184 bp, Homo sapiens
  misc_feature: GYAE6OF01EUSN8.1.89.I01.1.454.CMB.1.raw
  modified_base (168)..(184): a, c, t, g, unknown or other
  misc_feature (168)..(184): n is a, c, g, or t
tcagacgagtgcgtcacgaccggtgctcgatttagtatgctagtatcgcgggggggtgttcggcggagggaccaaactgaccgtcctaggtcagcccaggctgccccctggtcactctgttcccgccctctcgagtgcgtctctgagcgggctggcaaggcgcatagnnnnnnnnnnnnnnnnn

SEQ ID NO: 87071 - DNA, 182 bp, Homo sapiens
  misc_feature: GYAE6OF01DMZTV.1.89.I01.1.454.CMB.1.raw
  modified_base (169)..(182): a, c, t, g, unknown or other
  misc_feature (169)..(182): n is a, c, g, or t
tcagacgagtgcgtcacgaccggtgctcgatttagtatgctagtatcggcgggggtcttcggagctgggaccaaggtcaccgtcctaggtaagcccaaggccaaccccactgtcactctgttcccaccctcctcacgtctactgctgagcgggctggcaggcgcatagnnnnnnnnnnnnnn

SEQ ID NO: 87072 - DNA, 182 bp, Homo sapiens
  misc_feature: GYAE6OF01EKHHS.1.89.I01.1.454.CMB.1.raw
  modified_base (172)..(182): a, c, t, g, unknown or other
  misc_feature (172)..(182): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccgccctcctctactgctagtctgagcgggctggcaaggcgcatagnnnnnnnnnnn

SEQ ID NO: 87073 - DNA, 181 bp, Homo sapiens
  misc_feature: GYAE6OF01CVQ2U.1.89.I01.1.454.CMB.1.raw
  modified_base (171)..(181): a, c, t, g, unknown or other
  misc_feature (171)..(181): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcccgccctcctcgagtgcgtctctgagcgggctggcaaggcgcatagnnnnnnnnnnn

SEQ ID NO: 87074 - DNA, 509 bp, Homo sapiens
  misc_feature: GYAE6OF01BNW4K.1.89.I01.1.454.CMB.1.raw
  modified_base (119)..(119): a, c, t, g, unknown or other
  misc_feature (119)..(119): n is a, c, g, or t
  modified_base (159)..(159): a, c, t, g, unknown or other
  misc_feature (159)..(159): n is a, c, g, or t
  modified_base (459)..(459): a, c, t, g, unknown or other
  misc_feature (459)..(459): n is a, c, g, or t
  modified_base (479)..(509): a, c, t, g, unknown or other
  misc_feature (479)..(509): n is a, c, g, or t
tcagacgagtgcgtcacgaccggtgctcgatttagtatgctagtatggggtcgacgacgacctgagctccaggaggcgagcagagcgagggaggaggagacggccccaggtgaacgggnggggctttcgccgaggcccggagagcgagtcgaccggacncccgagggcagggtcagacagtcgcgtacgggccggtcgggtccctcctcgtaccgacggaccgacggaaccgaaacggaccgacgtcccgaccgtccccgtaccgaacccgaaccgggtccctaccgttcccgggttccccttccccccgtaggtaccctaccccgttccgtaccgaaggaccggccgtaccggtcgggacggggaccaccggccgggtccggccggtcggaccgtcggtaccgtacggaacgacggttacctccgtcggcgtcgccgtactcgacggcggcgggtacnggaacgacggcctagagtgnnnnnnnnnnnnnnnnnnnnnnnnnnnnnnn

SEQ ID NO: 87075 - DNA, 150 bp, Homo sapiens
  misc_feature: GYAE6OF01AC7UJ.1.89.I01.1.454.CMB.1.raw
  modified_base (138)..(138): a, c, t, g, unknown or other
  misc_feature (138)..(138): n is a, c, g, or t
  modified_base (144)..(150): a, c, t, g, unknown or other
  misc_feature (144)..(150): n is a, c, g, or t
tcagacgagtgcgtcacgaccggtgctcgatttagtatgctagtatgggggaggccaccatcaattgaactgtgctgcaccatctgtcttcatccttcccaccctctcacgcactcgtctgagcgggctggcaaggcncatagnnnnnnn

SEQ ID NO: 87076 - DNA, 172 bp, Homo sapiens
  misc_feature: GYAE6OF01A2OQC.1.89.I01.1.454.CMB.1.raw
  modified_base (59)..(59): a, c, t, g, unknown or other
  misc_feature (59)..(59): n is a, c, g, or t
  modified_base (172)..(172): a, c, t, g, unknown or other
  misc_feature (172)..(172): n is a, c, g, or t
tcagacgagtgcgtcacgaccggtgctcgatttagtatgctagtatcgcggggggggtnttcggcggagggaccaaactgaccgtcctaggtcagcccaaggctgccccctcggtcactctgttcccgccctcctcgagtgcgtctctgagcgggctggcaaggcgcatagn

SEQ ID NO: 87077 - DNA, 234 bp, Homo sapiens
  misc_feature: GYAE6OF01AQ1BV.1.89.I01.1.454.CMB.1.raw
  modified_base (220)..(234): a, c, t, g, unknown or other
  misc_feature (220)..(234): n is a, c, g, or t
tcagacgagtgcgtcacgaccggtgctcgatttagtatgctagtatggggccaagggaccactgtcaccgtctcctcagcctccaccaacgggcccatcggtccttcccctggccaccctcctaccaagagccacctcgtggggcacaggccggccctgggctgcctggtcaaggactacttccacgcactcgtctgagcgggctggcaaggcgcatagnnnnnnnnnnnnnnn

SEQ ID NO: 87078 - DNA, 180 bp, Homo sapiens
  misc_feature: GYAE6OF01BP6OF.1.89.I01.1.454.CMB.1.raw
  modified_base (174)..(180): a, c, t, g, unknown or other
  misc_feature (174)..(180): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctcgttcccaccctcctctactgctagtctggagcgggctggcaaggcgcatagnnnnnnn

SEQ ID NO: 87079 - DNA, 170 bp, Homo sapiens
  misc_feature: GYAE6OF01CAB56.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcggctggcaaggcgcatagnn

SEQ ID NO: 87080 - DNA, 181 bp, Homo sapiens
  misc_feature: GYAE6OF01CIQZ9.1.89.I01.1.454.CMB.1.raw
  modified_base (178)..(181): a, c, t, g, unknown or other
  misc_feature (178)..(181): n is a, c, g, or t
tcagacgagtgcgtcacgaccggtgctcgatttagtatgctagtatcggcgggggggtgttcggcggagggaccaaactgaccgtcctaggtcagcccaaggcctcgccccctggtcactctcgttcccaccctcctctgtcgagcgtctgaggcgggctgggacaagggcgcatagnnnn

SEQ ID NO: 87081 - DNA, 172 bp, Homo sapiens
  misc_feature: GYAE6OF01CPFSM.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctcacgtagcgtgctgagcgggctggacaaggcgcatagnn

SEQ ID NO: 87082 - DNA, 174 bp, Homo sapiens
  misc_feature: GYAE6OF01B9FT2.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccaccctcctctactgctagtctgagcgggctggcaaggcgcatagnnnn

SEQ ID NO: 87083 - DNA, 172 bp, Homo sapiens
  misc_feature: GYAE6OF01ELZFS.1.89.I01.1.454.CMB.1.raw
  modified_base (172)..(172): a, c, t, g, unknown or other
  misc_feature (172)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcacgtagcgtgctgaggcgggctggcaaggcgcatagn

SEQ ID NO: 87084 - DNA, 731 bp, Homo sapiens
  misc_feature: GYAE6OF01BY8SP.1.89.I01.1.454.CMB.1.raw
  modified_base (381)..(381): a, c, t, g, unknown or other
  misc_feature (381)..(381): n is a, c, g, or t
tcagacgagtgcgtcacgaccggtgctcgatttagtatgctagtatcggcggggggggtctcaggaggcagcgctctcaggacatctccaccatggcctggctctgctgctcctcaccctcctcactcgaggcacgaggtgaccgcctccgaaggggaagggcttcgagggacctcgtgggctgactccgttggtcctcctgcctcctcgacggccgtccgacccggggccagccactgcctacgacgtggactagttcggttcgtttccctcccttcgttccgagtacgttccgtcggccctagtctccgcctgacctcgacgtcctcgccttccggtgtccgtcgggtcctcggtagacgtacgtcactccactctccncgtcgacacgtacgaacagtcgtaggtcgtacggtttggtacgttactcgtaacttgttcgtaccgttaccgtacgtaacccaactacgtaccgaacccgacgggaacccaaccggacccgtaacgaccttacgaagttacgtttaacgttagtacgggtacgtacgtacgtcgtaaccggttccccggttaacccgttaagggtttaccggttttaaccccgtaagtttccccggtttccttaccgtttaccggtacccggttacccttaaccggtaccgttccggtaacccggtaaccgtaacccccggtacccggtttacccctacccggtaacccgtcccttaccg

SEQ ID NO: 87085 - DNA, 241 bp, Homo sapiens
  misc_feature: GYAE6OF01DG4PM.1.89.I01.1.454.CMB.1.raw
  modified_base (177)..(179): a, c, t, g, unknown or other
  misc_feature (177)..(179): n is a, c, g, or t
  modified_base (181)..(186): a, c, t, g, unknown or other
  misc_feature (181)..(186): n is a, c, g, or t
  modified_base (188)..(188): a, c, t, g, unknown or other
  misc_feature (188)..(188): n is a, c, g, or t
  modified_base (190)..(191): a, c, t, g, unknown or other
  misc_feature (190)..(191): n is a, c, g, or t
  modified_base (194)..(241): a, c, t, g, unknown or other
  misc_feature (194)..(241): n is a, c, g, or t
tcagacgagtgcgtcacgaccggtgctcgatttagtatgctagtatcggcgggggggtgttcggcggagggaccaaactgaccgtcctaggtccagcccaaggctgccccctcggtcactctcgttcccaccctctctactgactagtctggacgcggtctggcaaggcgcagtagnnntnnnnnngnanncgnnnnnnnnnnnnnnnnnnnnnnnnnnnnnnnnnnnnnnnnnnnnnnnn

SEQ ID NO: 87086 - DNA, 678 bp, Homo sapiens
  misc_feature: GYAE6OF01BY86Z.1.89.I01.1.454.CMB.1.raw
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
tcagacgagtgcgtcacgaccggtgctcgatttagtatgctagtatcggcgggggggggtctcaggaggcagcgctctcaggacatctccaccatggcctgggctctgctgctcctcaccctcctcactcagggcacaggtgacgcctcgaggggaaggggcttcgagggacctcgtgggctgactccgttggtctcctgctcctcaggcctcgaccggggccagcactgactcacgtggcattgttcgtttcctcccttctttaccaggtcgttccgtcgggccctagtcctcgccctgacctcgacgtcctcgtccctcgtcgtcgtcgggtcctcgtggactgtcgatccactntcctcgtgacacgtacgaacngcgtagtcggtacggttggtagttangtacttgttcgtacttccgtacggtaccaactctaccgaccgtaagggacccaaccgggtccccaaggtacctcgtaagtttacgttaacgtttaggacggtacggtactaaccggttaccgtaaccggttcccgggttacccgtttacggggtttaaccggttttacttaaccggtccgtttccgtttaccgtacggttccggtaacccttacggtacgttcccgtacggtaccctaaccggtacccggtccccttaccggtcgaacccttcg

SEQ ID NO: 87087 - DNA, 1028 bp, Homo sapiens
  misc_feature: GYAE6OF01BU6LW.1.89.I01.1.454.CMB.1.raw
tcagacgagtgcgtcacgaccggtgctcgatttagtatgctagtatcgcggggggggtctcaggaggcagcgctctcaggacatctccaccatggcctggctctgctgctcctcaccctcctcactcagggcacagacgtcctcgggcccagtctcggcctagacctcacgcctcgtcccttccggtggtccgttggggttcctccgtagggaacctggtacgaacttccacctaattcctcctgacctaaccgtacgggaaccagaccgaaggttcggtaacggtttgggtacggtttaatacggtaacgttacgttcgttaccgtaccgttacgggtaacccaaacgtaacgtaccgaaacccggaacgggaaccaaaaccgggaccccaaggtacctacgtaacgttacgttaagttttagtacggaacggtaccgtaacgtacctaacgtccggtaccccgttacggtttaaacggggtttccttaaaacgttccgttccgtttacgtaccggttacggttacccgttaaccgtaaaccggtttaccggtaccgggaaacccggtaaacccgtaccccgggggttaacccctttacccgtaacccggttaacccgttaccggtttaccccgtttacccgggtacccgggttaccccgtaaccgggttaaccggggtaccgggttaaacggggaaccggggtaaacggttacggggttaaccgtttacggtttaaacgttttaaacggtttaacccgttacggaaccgttaaccggtaccgttttaaaacgaacctttaaacgggttaaaccgggtaacgtaaaaccgggttaaaacctttaaacgggggttaaaccccgtttaacgggggttttaaaccggggggttttacccgtaaacgggggaaaacccggggttaaaccccgtaaacgggttaccccgggttaaacccggtaaaccccgggtttaacggttaaacccgggtaccgttaaaccccggggtaaccccggttaaaaccccgggg

SEQ ID NO: 87088 - DNA, 188 bp, Homo sapiens
  misc_feature: GYAE6OF01CUT82.1.89.I01.1.454.CMB.1.raw
  modified_base (171)..(171): a, c, t, g, unknown or other
  misc_feature (171)..(171): n is a, c, g, or t
  modified_base (176)..(188): a, c, t, g, unknown or other
  misc_feature (176)..(188): n is a, c, g, or t
tcagacgagtgcgtcacgaccggtgctcgatttagtatgctagtatcggcggggggggtgttcggcggagggaccaaactgaccgtcctaggtcagcccaaggcctgccccctggtcactctcgttcccaccctcctctactgctagtctggacgcgggctggcaaggctnatagnnnnnnnnnnnnn

SEQ ID NO: 87089 - DNA, 172 bp, Homo sapiens; identical to SEQ ID NO: 86700
  misc_feature: GYAE6OF01A5ULL.1.89.I01.1.454.CMB.1.raw
  modified_base (171)..(172): a, c, t, g, unknown or other
  misc_feature (171)..(172): n is a, c, g, or t

SEQ ID NO: 87090 - DNA, 191 bp, Homo sapiens
  misc_feature: GYAE6OF01AD364.1.89.I01.1.454.CMB.1.raw
  modified_base (172)..(191): a, c, t, g, unknown or other
  misc_feature (172)..(191): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccaccctcctctactgctagtctgagcgggctggcaaggcgcatagnnnnnnnnnnnnnnnnnnnn

SEQ ID NO: 87091 - DNA, 181 bp, Homo sapiens
  misc_feature: GYAE6OF01CEOCU.1.89.I01.1.454.CMB.1.raw
  modified_base (178)..(181): a, c, t, g, unknown or other
  misc_feature (178)..(181): n is a, c, g, or t
tcagacgagtgcgtcacgaccggtgctcgatttagtatgctagtatcggcgggggggtgttcggcggagggaccaaactgaccgtcctaggtcagcccaaggctcgccccctcggtcacctctcgttcccacccttcctccgtgtctgatctgagcgggctggacaagggcacatagnnnn

SEQ ID NO: 87092 - DNA, 176 bp, Homo sapiens
  misc_feature: GYAE6OF01CQRKG.1.89.I01.1.454.CMB.1.raw
  modified_base (171)..(176): a, c, t, g, unknown or other
  misc_feature (171)..(176): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnnnnnn

SEQ ID NO: 87093 - DNA, 179 bp, Homo sapiens
  misc_feature: GYAE6OF01DBQOT.1.89.I01.1.454.CMB.1.raw
  modified_base (165)..(165): a, c, t, g, unknown or other
  misc_feature (165)..(165): n is a, c, g, or t
  modified_base (171)..(179): a, c, t, g, unknown or other
  misc_feature (171)..(179): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctcatagcgtactctgagcgggctggcaagggcncatagnnnnnnnnn

SEQ ID NO: 87094 - DNA, 720 bp, Homo sapiens
  misc_feature: GYAE6OF01BFV8E.1.89.I01.1.454.CMB.1.raw
  modified_base (390)..(390): a, c, t, g, unknown or other
  misc_feature (390)..(390): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccagggaaggggcttcgagggacctctggggctgatccttggtctcctgcctcctcaggctccgaccggggcccaggcactgacctcactggcatgttgtttcctccccttctttcccagtacgtcccgtggggcccctagtcctcgcccctgacctcacgcctgcccttccggtgtctggggtcctccgtggacaggtcgacttccacctacttcctacccgtgacctacgtcgggaaacccnggccaggtcggtaaccggtttggggttaggttactcggtaaccttagttcgttacccgttaccgttacggtaaccccaacgtacttacccgaacccgtaacgggtaaccgaaaccgggaccccctaacggtaccttacgtaacttacgttaacgttttaacgtagggtaacggtaccgtaacggttacgtaccgtacccggtaccccgttacggttacggggtttacctaacgttccgtcctttaccgtccgtcggtacccttaccgtacggttccgtacggtaacccgtaaccgtacccggtacccttacccgtccggtaccctaccgg

SEQ ID NO: 87095 - DNA, 174 bp, Homo sapiens; identical to SEQ ID NO: 86688
  misc_feature: GYAE6OF01DNL5M.1.89.I01.1.454.CMB.1.raw
  modified_base (171)..(174): a, c, t, g, unknown or other
  misc_feature (171)..(174): n is a, c, g, or t

SEQ ID NO: 87096 - DNA, 179 bp, Homo sapiens
  misc_feature: GYAE6OF01DVZWR.1.89.I01.1.454.CMB.1.raw
  modified_base (171)..(179): a, c, t, g, unknown or other
  misc_feature (171)..(179): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnnnnnnnnn

SEQ ID NO: 87097 - DNA, 174 bp, Homo sapiens
  misc_feature: GYAE6OF01CY68A.1.89.I01.1.454.CMB.1.raw
  modified_base (172)..(174): a, c, t, g, unknown or other
  misc_feature (172)..(174): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 87098 - DNA, 171 bp, Homo sapiens
  misc_feature: GYAE6OF01D1PWO.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctctgtcgagcgtctgagcgggctggcaaggcgcatagnn

SEQ ID NO: 87099 - DNA, 192 bp, Homo sapiens
  misc_feature: GYAE6OF01B0IWQ.1.89.I01.1.454.CMB.1.raw
  modified_base (188)..(192): a, c, t, g, unknown or other
  misc_feature (188)..(192): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctcgttcccgccctcctcctcgtctctactgagcgggctggcaaggcgcatagnnnnn

SEQ ID NO: 87100 - DNA, 356 bp, Homo sapiens
  misc_feature: GYAE6OF01D0B0V.1.89.I01.1.454.CMB.1.raw
  modified_base (315)..(356): a, c, t, g, unknown or other
  misc_feature (315)..(356): n is a, c, g, or t
tcagacgagtgcgtcacgaccggtgctcgatttagtatgctagtatcggacgggggacaaagctgccctgaccctctcgggtgcgcagcctgacgatgaggctgacttattactgccttcctctccgtggcacggtgcctcgtggccggcggtttcgggcgggagggaccaaggtgactccgtcctaagtccagcccgtagggcctccggcccccgtcggtcaccttccttcgttccccgcctatcgtacgaattacgccgttaacttcgtgggaccggtccgggtacgtgggaccgaaacggcgacgaataggnnnnnnnnnnnnnnnnnnnnnnnnnnnnnnnnnnnnnnnnnn

SEQ ID NO: 87101 - DNA, 176 bp, Homo sapiens
  misc_feature: GYAE6OF01ASY3V.1.89.I01.1.454.CMB.1.raw
  modified_base (169)..(176): a, c, t, g, unknown or other
  misc_feature (169)..(176): n is a, c, g, or t
tcagacgagtgcgtcacgaccggtgctcgatttagtatgctagtatcgcgggggggtgttcggcggagggaccaaactgaccgtcctaggtaagcccaaggctgcccctggtcactctgttcccgccctcctcacgtagcgtgctgagcgggctggcaaggcgcatagnnnnnnnn

SEQ ID NO: 87102 - DNA, 175 bp, Homo sapiens
  misc_feature: GYAE6OF01D0T74.1.89.I01.1.454.CMB.1.raw
  modified_base (167)..(175): a, c, t, g, unknown or other
  misc_feature (167)..(175): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcggctggcaagcgcatagnnnnnnnnn

SEQ ID NO: 87103 - DNA, 752 bp, Homo sapiens
  misc_feature: GYAE6OF01CHX0B.1.89.I01.1.454.CMB.1.raw
  modified_base (144)..(144): a, c, t, g, unknown or other
  misc_feature (144)..(144): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctccagactaccaccgganaaattgtgttgacactagtctccacgccaccctgttcttttacgtcctaccgaagggggaaacgcgccctacccgtctccgtgccgacgggccacgtcgaggtacgttgtacgcacgtcttacgttacgccgttaggtaaccaacgtaacgaaaccgttcggaccacggtcctacccgacggtccctacctactacttacctagtagtacttaacacctaaccgaaccgacgggcccaacggtcggacctaccgtcccgacggtccgtagggttcgaaggtcggtacgtcgggttcgggtcggtcggggaacctacggtacttaccgtacttacctaccaacgtcgttaaccgacgaccgtaacgaccggttaacgtacggtaccgtaaggttaacgttactttagtacgtttaacgtttacgttcgtacgtacgtacgctacggtcgtaaccacgtaaccgtccgttaccttccgtaccgttacccgttaccgggttacccgtaacggggtactaacgggttctaaacgttaacctaacggtaaaccgtcggtcggtacgccgttaccgaccgtactacgttccttacgtcttacgttccctacccg

SEQ ID NO: 87104 - DNA, 202 bp, Homo sapiens
  misc_feature: GYAE6OF01BO71Y.1.89.I01.1.454.CMB.1.raw
  modified_base (184)..(202): a, c, t, g, unknown or other
  misc_feature (184)..(202): n is a, c, g, or t
tcagacgagtgcgtcacgaccggtgctcgatttagtatgctagtatgggatgacagcctgagtgcccttatgtcttcggaactgggaccaaggtcaccgtctaggtcagcccaaggccaaccccactgtcactctgttcccaccctctctctctcgactctgagcggctggcaaggcgcatagnnnnnnnnnnnnnnnnnnn

SEQ ID NO: 87105 - DNA, 178 bp, Homo sapiens
  misc_feature: GYAE6OF01CFBAV.1.89.I01.1.454.CMB.1.raw
  modified_base (171)..(178): a, c, t, g, unknown or other
  misc_feature (171)..(178): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnnnnnnnn

SEQ ID NO: 87106 - DNA, 191 bp, Homo sapiens
  misc_feature: GYAE6OF01CWU7N.1.89.I01.1.454.CMB.1.raw
  modified_base (177)..(191): a, c, t, g, unknown or other
  misc_feature (177)..(191): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccgccctcctcatagcgtactctgaggcgggctggaccaagggcgcaattagnnnnnnnnnnnnnnn

SEQ ID NO: 87107 - DNA, 433 bp, Homo sapiens
  misc_feature: GYAE6OF01BDSBP.1.89.I01.1.454.CMB.1.raw
  modified_base (379)..(380): a, c, t, g, unknown or other
  misc_feature (379)..(380): n is a, c, g, or t
  modified_base (382)..(383): a, c, t, g, unknown or other
  misc_feature (382)..(383): n is a, c, g, or t
  modified_base (385)..(387): a, c, t, g, unknown or other
  misc_feature (385)..(387): n is a, c, g, or t
  modified_base (390)..(392): a, c, t, g, unknown or other
  misc_feature (390)..(392): n is a, c, g, or t
  modified_base (394)..(433): a, c, t, g, unknown or other
  misc_feature (394)..(433): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatccggtcttccccctggccaccctcctccaagacgccacctcgtgggggccacagccggcccgtgggcctgcccgtggtcaagggtacctacgttccggagtcgccgtctcgtggaggccggggcgtcgggacgaagggccgcgaactagctnnannannncgnnngnnnnnnnnnnnnnnnnnnnnnnnnnnnnnnnnnnnnnnnn

SEQ ID NO: 87108 - DNA, 175 bp, Homo sapiens
  misc_feature: GYAE6OF01CQG9C.1.89.I01.1.454.CMB.1.raw
  modified_base (165)..(165): a, c, t, g, unknown or other
  misc_feature (165)..(165): n is a, c, g, or t
  modified_base (171)..(175): a, c, t, g, unknown or other
  misc_feature (171)..(175): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccaccctcctctgtgagcgtctgaggcgggctggcaaggcncatagnnnnn

SEQ ID NO: 87109 - DNA, 460 bp, Homo sapiens
  misc_feature: GYAE6OF01EPX24.1.89.I01.1.454.CMB.1.raw
  modified_base (418)..(418): a, c, t, g, unknown or other
  misc_feature (418)..(418): n is a, c, g, or t
  modified_base (420)..(421): a, c, t, g, unknown or other
  misc_feature (420)..(421): n is a, c, g, or t
  modified_base (426)..(428): a, c, t, g, unknown or other
  misc_feature (426)..(428): n is a, c, g, or t
  modified_base (430)..(460): a, c, t, g, unknown or other
  misc_feature (430)..(460): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcaggggtcagcagtgctggccgtggggccctcctctcagccaggaccaaggcagcagcctccaccacgggcccatccggtccttccccctggccaccctccctaccagacgccacctcgtcgggggccacgaggccggccgtgggcctcggcccgttggtaccgaacggtaccttacccgtttcccgttcggtaaccgccgtaaccgtcccgttagggacgggtccggggccgttcgggacgtaaacgggccgacgtaactacggngnngcagnnncnnnnnnnnnnnnnnnnnnnnnnnnnnnnnnn

SEQ ID NO: 87110 - DNA, 192 bp, Homo sapiens
  misc_feature: GYAE6OF01CHDD1.1.89.I01.1.454.CMB.1.raw
  modified_base (171)..(192): a, c, t, g, unknown or other
  misc_feature (171)..(192): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnn

SEQ ID NO: 87111 - DNA, 176 bp, Homo sapiens
  misc_feature: GYAE6OF01A1305.1.89.I01.1.454.CMB.1.raw
  modified_base (173)..(176): a, c, t, g, unknown or other
  misc_feature (173)..(176): n is a, c, g, or t
tcagacgagtgcgtcacgaccggtgctcgatttagtatgctagtatcggcggggggggtgttcggcggagggaccaaactgaccgtcctaggtcagcccaaggctgccccctggtcactctgttcccaccctcctcacgtctactgctggagcgggctggcaaggcgcatagnnnn

SEQ ID NO: 87112 - DNA, 174 bp, Homo sapiens
  misc_feature: GYAE6OF01ALOEG.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcacgtagcgtgctgagcgggctgggcaaggcgcatagnnnn

SEQ ID NO: 87113 - DNA, 258 bp, Homo sapiens
  misc_feature: GYAE6OF01A9ITI.1.89.I01.1.454.CMB.1.raw
  modified_base (199)..(199): a, c, t, g, unknown or other
  misc_feature (199)..(199): n is a, c, g, or t
  modified_base (236)..(258): a, c, t, g, unknown or other
  misc_feature (236)..(258): n is a, c, g, or t
tcagacgagtgcgtcacgaccggtgctcgatttagtatgctagtatcgcgggggcccaggcagatgatgagtctacttactattgtgtcctttacttgcgtgatggcatttggctgttcggcggagggaccaaagtgaccgtcctgggtcagcccaaggctgccccctggtcactctcgttccccaccctctctgtcgngcgtctggacggcgggcgtggacaaggcgacagtagnnnnnnnnnnnnnnnnnnnnnnn

SEQ ID NO: 87114 - DNA, 353 bp, Homo sapiens
  misc_feature: GYAE6OF01AY3HD.1.89.I01.1.454.CMB.1.raw
  modified_base (331)..(331): a, c, t, g, unknown or other
  misc_feature (331)..(331): n is a, c, g, or t
  modified_base (334)..(353): a, c, t, g, unknown or other
  misc_feature (334)..(353): n is a, c, g, or t
tcagacgagtgcgtcacgaccggtgctcgatttagtatgctagtatcgcgggctcctcatttttgacaatgataaacgaccctcaggaatttctgaccgattctctggctccaagtctggcctgtcagcctccctgggcatcaccggactccaaacgtgggggacgaggccgattattactgcgagacatgggatagtacttgatggtgggcgagttcggcggaggacagttgaccgtcctaggtcacgccaggaccaaccccactcgtcactctcgttcccaccctcgtcctcgtctctactgacggcggctcggacagggccgcatagncgnnnnnnnnnnnnnnnnnnnn

SEQ ID NO: 87115 - DNA, 238 bp, Homo sapiens
  misc_feature: GYAE6OF01B0HS3.1.89.I01.1.454.CMB.1.raw
  modified_base (167)..(167): a, c, t, g, unknown or other
  misc_feature (167)..(167): n is a, c, g, or t
  modified_base (173)..(238): a, c, t, g, unknown or other
  misc_feature (173)..(238): n is a, c, g, or t
tcagacgagtgcgtcacgaccggtgctcgatttagtatgctagtatcgcgggggtcgttcggagctgggaccaaggtcaccgtcctaggtccagcccaaggcctaaccccactgtcactctgttcccaccctcctcacgtctactgctgagcgggctggcaaggcgnaatagnnnnnnnnnnnnnnnnnnnnnnnnnnnnnnnnnnnnnnnnnnnnnnnnnnnnnnnnnnnnnnnnnn

SEQ ID NO: 87116 - DNA, 174 bp, Homo sapiens; identical to SEQ ID NO: 86688
  misc_feature: GYAE6OF01EGQJK.1.89.I01.1.454.CMB.1.raw
  modified_base (171)..(174): a, c, t, g, unknown or other
  misc_feature (171)..(174): n is a, c, g, or t

SEQ ID NO: 87117 - DNA, 191 bp, Homo sapiens
  misc_feature: GYAE6OF01BUKIK.1.89.I01.1.454.CMB.1.raw
  modified_base (179)..(191): a, c, t, g, unknown or other
  misc_feature (179)..(191): n is a, c, g, or t
tcagacgagtgcgtcacgaccggtgctcgatttagtatgctagtatcggcgggggggtgttcggcggagggaccaaactgacccgtcctaggtaagcccaaggctcgccccctggtcactctcgttccccacctcctcacgtagcgtgctggagcgggtctggacaaggcgcaagtagnnnnnnnnnnnnn

SEQ ID NO: 87118 - DNA, 365 bp, Homo sapiens
  misc_feature: GYAE6OF01EUJ5N.1.89.I01.1.454.CMB.1.raw
  modified_base (259)..(259): a, c, t, g, unknown or other
  misc_feature (259)..(259): n is a, c, g, or t
  modified_base (295)..(299): a, c, t, g, unknown or other
  misc_feature (295)..(299): n is a, c, g, or t
  modified_base (301)..(365): a, c, t, g, unknown or other
  misc_feature (301)..(365): n is a, c, g, or t
tcagacgagtgcgtcacgaccggtgctcgattttagtatgctagtattcggcggggggacaaaagctgccctgaccctctcgggtgcgcagcctggacgagtgaggctgactatactgcttcctctcctgcacggtgctcgtgccggtgttcggcggagggaccaaggtgacgttcggcctaagtcagcccgaaggccgtcgacccccgtggtctacttcctcgttcccgaccactctacggaattagcctaccttcgngacggtcggacgtggacgaaggcgtaccaagagcannnnngnnnnnnnnnnnnnnnnnnnnnnnnnnnnnnnnnnnnnnnnnnnnnnnnnnnnnnnnnnnnnnnnn

SEQ ID NO: 87119 - DNA, 442 bp, Homo sapiens
  misc_feature: GYAE6OF01AL601.1.89.I01.1.454.CMB.1.raw
  modified_base (417)..(418): a, c, t, g, unknown or other
  misc_feature (417)..(418): n is a, c, g, or t
  modified_base (420)..(442): a, c, t, g, unknown or other
  misc_feature (420)..(442): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccggtcggggccctcctctcacgccgaggaccaaggacagcacggccctaccgaccgaacgggcccagtccggtcccttcccccgtcgggcccaccccttccctaccgaacggacgccacccgtcggtcgggggccacgacggccggcccgtcgggcctcggccgtcggtaccgaacggtaccttaccgttccgacgtcggccgttccgtcgtggacggcgggcgtcgggcgaaggcgtcgagtagnncnnnnnnnnnnnnnnnnnnnnnnn

SEQ ID NO: 87120 - DNA, 201 bp, Homo sapiens
  misc_feature: GYAE6OF01B4NUA.1.89.I01.1.454.CMB.1.raw
  modified_base (59)..(59): a, c, t, g, unknown or other
  misc_feature (59)..(59): n is a, c, g, or t
  modified_base (173)..(201): a, c, t, g, unknown or other
  misc_feature (173)..(201): n is a, c, g, or t
tcagacgagtgcgtcacgaccggtgctcgatttagtatgctagtatcgcggggggggtnttcggcggagggaccaaactgaccgtcctaggtcagcccaaggctgccccctcggtcactctgttcccaccctcctctactgctagtctgagcgggctggcaaggcgcaatagnnnnnnnnnnnnnnnnnnnnnnnnnnnnn

SEQ ID NO: 87121 - DNA, 228 bp, Homo sapiens
  misc_feature: GYAE6OF01BIUM3.1.89.I01.1.454.CMB.1.raw
  modified_base (221)..(228): a, c, t, g, unknown or other
  misc_feature (221)..(228): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctcgccccctggtcactctcgttccccaccctcctctagagacacgctgagcgggctggcaaggcgcatagnnnnnnnn

SEQ ID NO: 87122 - DNA, 171 bp, Homo sapiens; identical to SEQ ID NO: 86706
  misc_feature: GYAE6OF01C24KC.1.89.I01.1.454.CMB.1.raw
  modified_base (171)..(171): a, c, t, g, unknown or other
  misc_feature (171)..(171): n is a, c, g, or t

SEQ ID NO: 87123 - DNA, 197 bp, Homo sapiens
  misc_feature: GYAE6OF01AVFMS.1.89.I01.1.454.CMB.1.raw
  modified_base (58)..(58): a, c, t, g, unknown or other
  misc_feature (58)..(58): n is a, c, g, or t
  modified_base (164)..(164): a, c, t, g, unknown or other
  misc_feature (164)..(164): n is a, c, g, or t
  modified_base (169)..(176): a, c, t, g, unknown or other
  misc_feature (169)..(176): n is a, c, g, or t
  modified_base (178)..(197): a, c, t, g, unknown or other
  misc_feature (178)..(197): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccaccctctcatagcgtactctgagcgggctggcaaggcgnatagnnnnnnnncnnnnnnnnnnnnnnnnnnnn

SEQ ID NO: 87124 - DNA, 184 bp, Homo sapiens
  misc_feature: GYAE6OF01A3Y33.1.89.I01.1.454.CMB.1.raw
  modified_base (172)..(184): a, c, t, g, unknown or other
  misc_feature (172)..(184): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccgccctcctcacgtctactgctgaggcgggctggcaaggcgcatagnnnnnnnnnnnnn

SEQ ID NO: 87125 - DNA, 213 bp, Homo sapiens
  misc_feature: GYAE6OF01B4IUJ.1.89.I01.1.454.CMB.1.raw
  modified_base (112)..(112): a, c, t, g, unknown or other
  misc_feature (112)..(112): n is a, c, g, or t
  modified_base (178)..(213): a, c, t, g, unknown or other
  misc_feature (178)..(213): n is a, c, g, or t
tcagacgagtgcgtcacgaccggtgctcgatttagtatgctagtaatcgcgggggggtgggttcggcggagggaccaaactgaccggtccctaggtcgagcccaaggactcncccctcggtcactctgttcccgccctcctctactgctagtctgagcgggctggcaaggcgcatagnnnnnnnnnnnnnnnnnnnnnnnnnnnnnnnnnnnn

SEQ ID NO: 87126 - DNA, 185 bp, Homo sapiens
  misc_feature: GYAE6OF01CQQY3.1.89.I01.1.454.CMB.1.raw
  modified_base (175)..(185): a, c, t, g, unknown or other
  misc_feature (175)..(185): n is a, c, g, or t
tcagacgagtgcgtcacgaccggtgctcgatttagtatgctagtatcggcggggggggtgttcggcggagggaccaaactgaccgtcctaggtcagcccaaggctgccccctcggtcactctgttcccaccctcctctactgctagtctgaggcgggctggcgaaggcgcatagnnnnnnnnnnn

SEQ ID NO: 87127 - DNA, 180 bp, Homo sapiens
  misc_feature: GYAE6OF01C7C4B.1.89.I01.1.454.CMB.1.raw
  modified_base (166)..(166): a, c, t, g, unknown or other
  misc_feature (166)..(166): n is a, c, g, or t
  modified_base (171)..(180): a, c, t, g, unknown or other
  misc_feature (171)..(180): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcccaccctcctctactgctagtctgagcgggctggcaaggcgnatagnnnnnnnnnn

SEQ ID NO: 87128 - DNA, 484 bp, Homo sapiens
  misc_feature: GYAE6OF01CTLUT.1.89.I01.1.454.CMB.1.raw
  modified_base (136)..(136): a, c, t, g, unknown or other
  misc_feature (136)..(136): n is a, c, g, or t
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (435)..(436): a, c, t, g, unknown or other
  misc_feature (435)..(436): n is a, c, g, or t
  modified_base (438)..(484): a, c, t, g, unknown or other
  misc_feature (438)..(484): n is a, c, g, or t
tcagacgagtgcgtcacgaccggtgctcgatttagtatgctagtatgggcacgaccgacctgagctcaggaggcagcagagcgagggaggaggagacggccccaggtggaacgggaggggcttggccagggccggnagcatccgaccggagcccgagggcagggtcagcagtgctggcccggtcgggccctcctctcgacgccgacggaccaaggacacgcagtcccnccaacgaacgggcccagtccggtcccttcccccgnggccctacccctcctaccgaacgacgccctaacccgtcggtacgggggcaccgacggtccggcccgttggggcctacggtcccgttgggtaccaaagggtacccttaccgttccggaatcggcgttctcgagggacgcgggtcngggacgaacggcgctaagtgncgancgnnannnnnnnnnnnnnnnnnnnnnnnnnnnnnnnnnnnnnnnnnnnnnnn

SEQ ID NO: 87129 - DNA, 375 bp, Homo sapiens
  misc_feature: GYAE6OF01DKKFP.1.89.I01.1.454.CMB.1.raw
  modified_base (113)..(113): a, c, t, g, unknown or other
  misc_feature (113)..(113): n is a, c, g, or t
  modified_base (167)..(167): a, c, t, g, unknown or other
  misc_feature (167)..(167): n is a, c, g, or t
  modified_base (215)..(215): a, c, t, g, unknown or other
  misc_feature (215)..(215): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (351)..(375): a, c, t, g, unknown or other
  misc_feature (351)..(375): n is a, c, g, or t
tcagacgagtgcgtcacgaccggtgctcgatttagtatgctagtatgggcacgaccgacctgagctcaggagcagcagagcgagggaggaggagacggcccaggtggaacggngggcttgccaggccgcagcatccgaccggagcccgaggcgtagggtcagcagtncgtcggccgcgggccctcgtctcacgccgagaccgagacagcacgccnccaacgacggcctagttccgtcctcccgcgccaccctccacagactccaccgtcgacggcacgcgccggcgtggctcgcgtaggacaacgtcctctccgtgtacgcacgtgacgtgcggntacggnacgnantncnnnnnnnnnnnnnnnnnnnnnnnnn

SEQ ID NO: 87130 - DNA, 829 bp, Homo sapiens
  misc_feature: GYAE6OF01ECAZW.1.89.I01.1.454.CMB.1.raw
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccgagggcagggtcagcgagtgcgtggccgtggggcccctccgtctcgagccgacggaccgaaggacgagcacgcctaccgaaccgaacgggccctaacgttccggtcccgtttaccccccgtgggtaccctacccccttaccgttacccgaaaggtaccggaccctaacccgttcggttaccgggggggaccttaaccggtaaccgggcccgggtaccccggttaacggggtaccgttccggggtaccccgttttacgggggtaaacccgtaaaaccgggggtaaccccttttaaccgttttaacccccgggaaggttccgggttacccggttaccttttaccggttaaccgggaacgggtccccgggggttaaacgttcccggggtaaaccgtaaaccggggtccgggaaccttaaaccggttaagggtctacgggtactaaccggtgtacggttacgacgtacgtacggtacgcgtacgtacgtacgtaacgtacgtacgtacgtacgtacgtacgtacgacgacgacgtacgtacgtcggtacgtacgtaccgtacgtacgtacgtacgtacggtacgtacgtacgtacgtacgacgacgtacgtacgtacgtacgtacgtagacgtacgtacgtacgtacgtacgtagtacgtaacgactacgtacgtacgacggtacg

SEQ ID NO: 87131 - DNA, 220 bp, Homo sapiens
  misc_feature: GYAE6OF01CBCUZ.1.89.I01.1.454.CMB.1.raw
  modified_base (150)..(150): a, c, t, g, unknown or other
  misc_feature (150)..(150): n is a, c, g, or t
  modified_base (176)..(220): a, c, t, g, unknown or other
  misc_feature (176)..(220): n is a, c, g, or t
tcagacgagtgcgtcacgaccggtgctcgatttagtatgctagtatcggcgggggggtgttcggcggagggaccaaactgaccgtcctaggtcagccaaggctcgcccctcgtcactctcgttcccacctcctctactgctagtctaggnggcgggctggcgaaggcgacagtagnnnnnnnnnnnnnnnnnnnnnnnnnnnnnnnnnnnnnnnnnnnnn

SEQ ID NO: 87132 - DNA, 259 bp, Homo sapiens
  misc_feature: GYAE6OF01B9S6R.1.89.I01.1.454.CMB.1.raw
  modified_base (226)..(226): a, c, t, g, unknown or other
  misc_feature (226)..(226): n is a, c, g, or t
  modified_base (232)..(259): a, c, t, g, unknown or other
  misc_feature (232)..(259): n is a, c, g, or t
tcagacgagtgcgtcacgaccggtgctcgatttagtatgctagtatcgcgggggcccaggcagatgatgagtctacttactattgtgtcctttacttgcgtgatggcatttggctgttcggcggagggaccaaagtgaccgtcctgggtcagcccaaggctgccccctcggtcactctgttccccacccttcctctgtcgacgcgtctgagcgggctggcaaggcncatagnnnnnnnnnnnnnnnnnnnnnnnnnnnn

SEQ ID NO: 87133 - DNA, 292 bp, Homo sapiens
  misc_feature: GYAE6OF01EYDEJ.1.89.I01.1.454.CMB.1.raw
  modified_base (258)..(258): a, c, t, g, unknown or other
  misc_feature (258)..(258): n is a, c, g, or t
  modified_base (264)..(292): a, c, t, g, unknown or other
  misc_feature (264)..(292): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggcctcgccccctcggtcactctcgttcccgccatctgaatgcgttactcgtggagcgggctcgggacaacggcncagtgnnnnnnnnnnnnnnnnnnnnnnnnnnnnn

SEQ ID NO: 87134 - DNA, 171 bp, Homo sapiens
  misc_feature: GYAE6OF01ECWJ0.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccaccctcctcatagcgtactctgagcgggctggcaaggcgcatagn

SEQ ID NO: 87135 - DNA, 247 bp, Homo sapiens
  misc_feature: GYAE6OF01EXUQZ.1.89.I01.1.454.CMB.1.raw
  modified_base (238)..(247): a, c, t, g, unknown or other
  misc_feature (238)..(247): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccatgtcactctgttcccaccctctcacgcactcgtctgagcgggctggcaaggcgcatagnnnnnnnnnn

SEQ ID NO: 87136 - DNA, 209 bp, Homo sapiens
  misc_feature: GYAE6OF01AUXTT.1.89.I01.1.454.CMB.1.raw
  modified_base (140)..(140): a, c, t, g, unknown or other
  misc_feature (140)..(140): n is a, c, g, or t
  modified_base (177)..(209): a, c, t, g, unknown or other
  misc_feature (177)..(209): n is a, c, g, or t
tcagacgagtgcgtcacgaccggtgctcgatttagtatgctagtatcgcggggggggtgttcggcggagggaccaaactgaccgtcctaggtcagcccaaggctcgcccccctcggtcactctcgttccccgccctcctnatcgcgtactctggagccggctggcaaggcgcaatgnnnnnnnnnnnnnnnnnnnnnnnnnnnnnnnnn

SEQ ID NO: 87137 - DNA, 455 bp, Homo sapiens
  misc_feature: GYAE6OF01AKM0G.1.89.I01.1.454.CMB.1.raw
  modified_base (422)..(422): a, c, t, g, unknown or other
  misc_feature (422)..(422): n is a, c, g, or t
  modified_base (429)..(455): a, c, t, g, unknown or other
  misc_feature (429)..(455): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccgagggcagggtcagcagtgctggccgtgggccctcctctcagccaggaccaaggacagcacgccctaccaccgaacggcccagtccggtccttccccccgtggcctacccctccctaccaagacgccctaacccgtcggtcggggggaccaccgaggcccgggtcccgttggggcctcggtccccgttggtacgaaacggtaccttaccgttcccggaagtcggccgttcctcgtcgacggccgggcgttcggcgaagggccgactaagtgagnagctagnnnnnnnnnnnnnnnnnnnnnnnnnnn

SEQ ID NO: 87138 - DNA, 173 bp, Homo sapiens
  misc_feature: GYAE6OF01AWFKX.1.89.I01.1.454.CMB.1.raw
  modified_base (165)..(165): a, c, t, g, unknown or other
  misc_feature (165)..(165): n is a, c, g, or t
  modified_base (170)..(173): a, c, t, g, unknown or other
  misc_feature (170)..(173): n is a, c, g, or t
tcagacgagtgcgtcacgaccggtgctcgatttagtatgctagtatcgcggggggggtgttcggcggagggaccaaactgaccgtcctaggtcagcccaaggctgccccctggtcactctgttcccaccctcctccgtgtctgatctgagcgggctggcaaggcnatagnnnn

SEQ ID NO: 87139 - DNA, 206 bp, Homo sapiens
  misc_feature: GYAE6OF01C6DBU.1.89.I01.1.454.CMB.1.raw
  modified_base (123)..(123): a, c, t, g, unknown or other
  misc_feature (123)..(123): n is a, c, g, or t
  modified_base (186)..(206): a, c, t, g, unknown or other
  misc_feature (186)..(206): n is a, c, g, or t
tcagacgagtgcgtcacgaccggtgctcgatttagtatgctagtatgggatgacagcctgagtcgcccttatgtctcggaactgggaccaggtcaccgtctaggcagcccaagcccaaccccntgtcactcgtcgtcccgccctctctctctcgactctgacgcgggtcaggcaggcctcaagtgnnnnnnnnnnnnnnnnnnnnn

SEQ ID NO: 87140 - DNA, 177 bp, Homo sapiens
  misc_feature: GYAE6OF01BY2I8.1.89.I01.1.454.CMB.1.raw
  modified_base (173)..(177): a, c, t, g, unknown or other
  misc_feature (173)..(177): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccaccctcctctactgctagtctgaggcgggctggcaaggcgcatagnnnnn

SEQ ID NO: 87141 - DNA, 184 bp, Homo sapiens
  misc_feature: GYAE6OF01C5ZD4.1.89.I01.1.454.CMB.1.raw
  modified_base (176)..(184): a, c, t, g, unknown or other
  misc_feature (176)..(184): n is a, c, g, or t
tcagacgagtgcgtcacgaccggtgctcgatttagtatgctagtatcggcggggggggtgttcggcggagggaccaaactgaccgtcctaggtcagcccaaggctcgccccctcggtcactctcgttcccaccctcctcacgtagcgtgctgaggcgggctggcaaggcgcatagnnnnnnnnn

SEQ ID NO: 87142 - DNA, 179 bp, Homo sapiens
  misc_feature: GYAE6OF01BOPI8.1.89.I01.1.454.CMB.1.raw
  modified_base (170)..(179): a, c, t, g, unknown or other
  misc_feature (170)..(179): n is a, c, g, or t
tcagacgagtgcgtcacgaccggtgctcgatttagtatgctagtatcggcgggggggtgttcggcggagggaccaaactgaccgtcctaggtaagcccaaggctgccccctcggtcactctcgtcccgcctcctcacgtagcgtgctgagcgggctggcaggcgcatagnnnnnnnnnn

SEQ ID NO: 87143 - DNA, 211 bp, Homo sapiens
  misc_feature: GYAE6OF01C5OGH.1.89.I01.1.454.CMB.1.raw
  modified_base (171)..(211): a, c, t, g, unknown or other
  misc_feature (171)..(211): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnnnnnnnnnnnnnnnnnnnnnnnnnnnnnnnnnnnnnnnnn

SEQ ID NO: 87144 - DNA, 770 bp, Homo sapiens
  misc_feature: GYAE6OF01BV6NM.1.89.I01.1.454.CMB.1.raw
  modified_base (445)..(445): a, c, t, g, unknown or other
  misc_feature (445)..(445): n is a, c, g, or t
tcagacgagtgcgtcacgaccggtgctcgatttagtatgctagtatcggcggggggggtctcgaggaggcagcgctctcaggacatctccaccatggcctgggctctgctgctcctcaccctctcactcagggcacgaggtgacgcctcgagggaaggggcttcgagggacctgtgggctgatccttggtctcctgctcctcacggctcggaccgggccagcctactgacctcacgttggctgttcgttcgtttaccttcccttacttttacccggaggtaccgttcccgtcggggaccccctaggttccgtccgccctacggaccttcgacggtccccttacggtccccgttccggttacggtcgtccggggttcctaccggttagggactacggtcgactcccactacttcccgtcctagtaccgtaacgcggtaaaacccgngacggtacggttacgtacggggttttagggttaggtttaacgttcggtaacctttgttcgttcccgtttaccggtaccggttaaaaccccaaccgtaccgtaaccccgaaacccgtacgggaaaaccccggtaaacccgggtaccctaacggtacctaacgttaacgttaacgttacgttttagacggttaagggtactacggtacgtcccgtaccggttcccgttaacgggttagtttacccgttagtccgtactttcgtaccgttcgtacccgtcgtaaagtccggtagtaacccaccgtcgaccccgttcaccggtctaccg

SEQ ID NO: 87145 - DNA, 767 bp, Homo sapiens
  misc_feature: GYAE6OF01CFBK7.1.89.I01.1.454.CMB.1.raw
  modified_base (144)..(144): a, c, t, g, unknown or other
  misc_feature (144)..(144): n is a, c, g, or t
  modified_base (208)..(208): a, c, t, g, unknown or other
  misc_feature (208)..(208): n is a, c, g, or t
  modified_base (406)..(406): a, c, t, g, unknown or other
  misc_feature (406)..(406): n is a, c, g, or t
tcagacgagtgcgtcacgaccggtgctcgatttagtatgctagtatgggggaggaactgctcagttaggacccagagggaaccatggaagcccagctcagcttctcttcctcctgctactctggctcccagactaccaccgganaaattgtgttagacacagtctaccagtccaccttgttcctttagtccgtacgaaggggaaacgngccctaccctctcctgcgacgggacccagtcaagtagttacggttagcgaatacgttacttacgccgttaacggaacctaacgacgtaaaccgtggccgtaggcctaccgagtcctccgactaatccgtatcgaactacacgtccgaacgccggtaccacgtcggtacaccgtacccgacgttaccggtaggttccgnggtacgtacggtcggttggtacgttacggggaactacgtacccttcgaccgttaccttacgaacccgtattaccgaacgcccgtaacggtacctacgggtaccgtacgttaaggttaacgttacgttttaggtaaccctttaggttttaaccttacgttcgttaacggtagtacctaaggttcggtaaccgaacttaccggtcgtacctttacccgtacgttcccgtaccgttaccggtaccggtaacgtaaacggtgttaaacgtactaacccggtaaacggttaccgtacgggtacccgcgtacccgtaactaacccggttcttaccggttattccccgttaacgtccgtttacccccg

SEQ ID NO: 87146 - DNA, 695 bp, Homo sapiens
  misc_feature: GYAE6OF01BACQB.1.89.I01.1.454.CMB.1.raw
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
  modified_base (399)..(399): a, c, t, g, unknown or other
  misc_feature (399)..(399): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacagagtccgtgggcccagtctgccctgactcagcctgcctcgtgtcgtgggtcctccgtggacagtcgatccacctntctcctgccacgtacggaaccgactaggtgtacggttggtgttatgaacttntcgtcctccgtacggtaaccaacgtactccgaaccgacggtaaccgaaccggccccagaccttcgaattgttaatttaggtgaggttctacgtctacgtcccgcccgttacggttacgggtttactagttcccgtnttccgttcgtcgtacctaccgtagttccggtacgacaacccgtacccggtccctacccgtacgtaccctacttcgttacccgttccgacctaccgacgggtcaggtaccgggacggtacgtcgtagtaacttccgtancggtanacgttcgtaaccgttaactacgtaaccgtacgaacgttaaggtaacgtaccgttacggttaccgggtttaacccggaacgggttaacggtaaacgtacgtaccggtacgtaccccgtcggtaaggtaccccgagtaacccccgggttacccg

SEQ ID NO: 87147 - DNA, 478 bp, Homo sapiens
  misc_feature: GYAE6OF01AKOZD.1.89.I01.1.454.CMB.1.raw
  modified_base (424)..(424): a, c, t, g, unknown or other
  misc_feature (424)..(424): n is a, c, g, or t
  modified_base (426)..(428): a, c, t, g, unknown or other
  misc_feature (426)..(428): n is a, c, g, or t
  modified_base (430)..(432): a, c, t, g, unknown or other
  misc_feature (430)..(432): n is a, c, g, or t
  modified_base (434)..(478): a, c, t, g, unknown or other
  misc_feature (434)..(478): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatccaccggagccccagggcagggtccagcagtgctggccggtggggcccctcctctcagccaggaccaaggacagcacgcctaccaccgaacggcccagtccggtccttccccctggccctaccctccctccaaacgacgcccgacccgttacggtcgggggccaccgacgggcccggtcccgtcggggcctcgtcccggttggtaccgaaacggtaccttacttcccgtacggtacgcctactcgtggacggtccgggctcgggacgaacggtccgacgacgtagcngnnngnnngnnnnnnnnnnnnnnnnnnnnnnnnnnnnnnnnnnnnnnnnnnnnn

SEQ ID NO: 87148 - DNA, 518 bp, Homo sapiens
  misc_feature: GYAE6OF01D0ZVE.1.89.I01.1.454.CMB.1.raw
  modified_base (192)..(192): a, c, t, g, unknown or other
  misc_feature (192)..(192): n is a, c, g, or t
  modified_base (256)..(256): a, c, t, g, unknown or other
  misc_feature (256)..(256): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (468)..(472): a, c, t, g, unknown or other
  misc_feature (468)..(472): n is a, c, g, or t
  modified_base (474)..(518): a, c, t, g, unknown or other
  misc_feature (474)..(518): n is a, c, g, or t
tcagacgagtgcgtcacgaccggtgctcgatttagtatgctagtatgggcacgaccgacctgagctcaggaggcagcagagcgaggggaggaggagacggccccaggtgaacggaggggcttgtcaggccgcagcatccaccggagcccgagggcagggtcaggcagttgcgtcggcgtcgggccctcctcncacgccgaggaccaaggcagcacgcctaccgaccgaaggccctagtccggttcccttcccccgnggtacccacccctcctaccaaacgaccgctaacccgtcggtacgggggtaccacgaccggcccggtccgtgggccgtcgtaccggtcggttaaccaacgggtaccctttaaccgtttcccgtaaccgttccgtccccgtaactttccggacggaccggtaccgggtcgtccggaactaacgggccacgtaacgtgcngtcgnatgactncgnnnnncnnnnnnnnnnnnnnnnnnnnnnnnnnnnnnnnnnnnnnnnnnnnn

SEQ ID NO: 87149 - DNA, 172 bp, Homo sapiens
  misc_feature: GYAE6OF01AJ57S.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctgtcgagcgtctgagcgggctggcaaggcgcatagnnn

SEQ ID NO: 87150 - DNA, 198 bp, Homo sapiens
  misc_feature: GYAE6OF01EIIC5.1.89.I01.1.454.CMB.1.raw
  modified_base (173)..(198): a, c, t, g, unknown or other
  misc_feature (173)..(198): n is a, c, g, or t
tcagacgagtgcgtcacgaccggtgctcgatttagtatgctagtatcgcggggggggtgttcggcggagggaccaaactgaccgtcctaggtcagcccaaggctgcccccctcggtcactctgttcccaccctcctctgtcgagcgtctgagcgggctggcaaggcgcatagnnnnnnnnnnnnnnnnnnnnnnnnnn

SEQ ID NO: 87151 - DNA, 185 bp, Homo sapiens
  misc_feature: GYAE6OF01ET8Y5.1.89.I01.1.454.CMB.1.raw
  modified_base (176)..(185): a, c, t, g, unknown or other
  misc_feature (176)..(185): n is a, c, g, or t
tcagacgagtgcgtcacgaccggtgctcgatttagtatgctagtatcgcggggggggtgttcggcggagggaccaaactgacccgtcctaggtcagcccaaggcctgccccctcggtcactctcgtcccaccctcctctactgctagtctgagcgggctggcgaaggcgacatagnnnnnnnnnn

SEQ ID NO: 87152 - DNA, 185 bp, Homo sapiens
  misc_feature: GYAE6OF01BN4T4.1.89.I01.1.454.CMB.1.raw
  modified_base (171)..(185): a, c, t, g, unknown or other
  misc_feature (171)..(185): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgcccttcctctagagacacgctgagcgggctggcaaggcgcatgnnnnnnnnnnnnnnn

SEQ ID NO: 87153 - DNA, 178 bp, Homo sapiens
  misc_feature: GYAE6OF01EEF1X.1.89.I01.1.454.CMB.1.raw
  modified_base (172)..(178): a, c, t, g, unknown or other
  misc_feature (172)..(178): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctcgagtgcgtctcgtgaggcgggctggcaaggcgcatagnnnnnnn

SEQ ID NO: 87154 - DNA, 174 bp, Homo sapiens; identical to SEQ ID NO: 86840
  misc_feature: GYAE6OF01CFWH6.1.89.I01.1.454.CMB.1.raw
  modified_base (170)..(174): a, c, t, g, unknown or other
  misc_feature (170)..(174): n is a, c, g, or t

SEQ ID NO: 87155 - DNA, 231 bp, Homo sapiens
  misc_feature: GYAE6OF01DKZ3O.1.89.I01.1.454.CMB.1.raw
  modified_base (152)..(152): a, c, t, g, unknown or other
  misc_feature (152)..(152): n is a, c, g, or t
  modified_base (176)..(231): a, c, t, g, unknown or other
  misc_feature (176)..(231): n is a, c, g, or t
tcagacgagtgcgtcacgaccggtgctcgatttagtatgctagtatcggcggggggggtattcggcggagggaccaaactgaccgtcctaggtcagccaaggcctgcccccctggtcactctcgttcccaccctcctctactgctagtctgnggcgggctggacaggcgcagtagnnnnnnnnnnnnnnnnnnnnnnnnnnnnnnnnnnnnnnnnnnnnnnnnnnnnnnnn

SEQ ID NO: 87156 - DNA, 198 bp, Homo sapiens
  misc_feature: GYAE6OF01ECT92.1.89.I01.1.454.CMB.1.raw
  modified_base (59)..(59): a, c, t, g, unknown or other
  misc_feature (59)..(59): n is a, c, g, or t
  modified_base (174)..(174): a, c, t, g, unknown or other
  misc_feature (174)..(174): n is a, c, g, or t
  modified_base (180)..(198): a, c, t, g, unknown or other
  misc_feature (180)..(198): n is a, c, g, or t
tcagacgagtgcgtcacgaccggtgctcgatttagtatgctagtatcgcggggggggtnttcggcggagggaccaaactgaccgtcctaggtcagcccaaggctcgccccctcggtcactctcgttccccgccctcctcatagcgtactcgtgacgcgggctggaccaagggcncatagnnnnnnnnnnnnnnnnnnn

SEQ ID NO: 87157 - DNA, 279 bp, Homo sapiens
  misc_feature: GYAE6OF01BFP63.1.89.I01.1.454.CMB.1.raw
  modified_base (235)..(279): a, c, t, g, unknown or other
  misc_feature (235)..(279): n is a, c, g, or t
tcagacgagtgcgtcacgaccggtgctcgatttagtatgctagtatcgcggggacgaggccgattattactgccgggacctgggataccagtctgagttctgtggtgttcggcggagggaccaagctgaccgtcgcaggtcagcccaagtcctcgccccctcggtcactcctcgttccccgccctcctctagacgacaccgctgacggcgggcgtcggacgaaggcgactagagnnnnnnnnnnnnnnnnnnnnnnnnnnnnnnnnnnnnnnnnnnnnn

SEQ ID NO: 87158 - DNA, 179 bp, Homo sapiens
  misc_feature: GYAE6OF01B0QKR.1.89.I01.1.454.CMB.1.raw
  modified_base (172)..(179): a, c, t, g, unknown or other
  misc_feature (172)..(179): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccaccctcctctactgctagtctgagcgggctggcaaggcgcatagnnnnnnnn

SEQ ID NO: 87159 - DNA, 181 bp, Homo sapiens
  misc_feature: GYAE6OF01B81SH.1.89.I01.1.454.CMB.1.raw
  modified_base (59)..(59): a, c, t, g, unknown or other
  misc_feature (59)..(59): n is a, c, g, or t
  modified_base (129)..(129): a, c, t, g, unknown or other
  misc_feature (129)..(129): n is a, c, g, or t
  modified_base (146)..(146): a, c, t, g, unknown or other
  misc_feature (146)..(146): n is a, c, g, or t
  modified_base (167)..(167): a, c, t, g, unknown or other
  misc_feature (167)..(167): n is a, c, g, or t
  modified_base (171)..(181): a, c, t, g, unknown or other
  misc_feature (171)..(181): n is a, c, g, or t
tcagacgagtgcgtcacgaccggtgctcgatttagtatgctagtatcggcgggggggtnttcggcggagggaccaaactgaccgtcctaggtcacgcccaaggctcgccccctgtcactctcgttcccncctctacacgtagcgtncgtgaggcggctggcaaggcnatgnnnnnnnnnnn

SEQ ID NO: 87160 - DNA, 944 bp, Homo sapiens
  misc_feature: GYAE6OF01E28QI.1.89.I01.1.454.CMB.1.raw
  modified_base (911)..(911): a, c, t, g, unknown or other
  misc_feature (911)..(911): n is a, c, g, or t
tcagacgagtgcgtcacgaccggtgctcgatttagtatgctagtagtgggggaggaactgctcagttacggacccagagggaaccatggaacgccccagctcagtcttcctcttcctcctgctactctcggcctcccagactaccgaccggaagtaaagttggttgttagacacgtacgtcctccacgccctaccgttgttctttcgtccgtacggaaggggaaacgaccgccctaccccgttccttcccgtacgaccggaccgggtccgtacggtaccgtaaacgggttggtttaacgttacggtaccgtaccggttacccgtttaaccgtttacccggtaccggttaacccggtaaacccgtaaaccgaaaccggttaacccgtaccgggaccggtacccggttcccctaccccggtaaccgggtacccttacccgttactaccgttacgttaacgtacgttaaccttaacccgtacccgttaaccgaaaccgggacccgggtaacccgtaccggtaccggtaacccgtaccccggtaacccgtaccgggttaccggtaccggtttccggtaacgggtcggaccggttacgggttcggtacgggttgggaccgttaagttccctaccttacctaccgtaccaacgtactacgtaccgcgtaccgtaaccgtcggtaacctggttaacgtttaaggtttctttagttaaccgttttacgttacgtttacgttccgtaggccgtacgtaacggtcggtaaccttaccgaccgtttccgactttacccgtaccgttttacccggtccgggttaaccctaacgggtacccttaagggtacgttaaaccgtagtaaacccgggtaacgtttcgggagttaccgttacgttacccggaactacccgttacgtttnttaaccccgtgttaccccgttccgtttaccccg

SEQ ID NO: 87161 - DNA, 216 bp, Homo sapiens
  misc_feature: GYAE6OF01CJGGM.1.89.I01.1.454.CMB.1.raw
  modified_base (64)..(64): a, c, t, g, unknown or other
  misc_feature (64)..(64): n is a, c, g, or t
  modified_base (110)..(110): a, c, t, g, unknown or other
  misc_feature (110)..(110): n is a, c, g, or t
  modified_base (170)..(170): a, c, t, g, unknown or other
  misc_feature (170)..(170): n is a, c, g, or t
  modified_base (176)..(216): a, c, t, g, unknown or other
  misc_feature (176)..(216): n is a, c, g, or t
tcagacgagtgcgtcacgaccggtgctcgatttagtatgctagtatcggcgggggtcttcgganctgggaccaaggtcaccgtcctaggtcagcccaaggcccaaccccntgtcactctcgttccccaccctcctcacgtctactgctggacgcgggctggcaaggccgnaatgcnnnnnnnnnnnnnnnnnnnnnnnnnnnnnnnnnnnnnnnnn

SEQ ID NO: 87162 - DNA, 165 bp, Homo sapiens
  misc_feature: GYAE6OF02IN4YV.1.89.I01.1.454.CMB.1.raw
  modified_base (164)..(165): a, c, t, g, unknown or other
  misc_feature (164)..(165): n is a, c, g, or t
tcagacgagtgcgtcacgaccggtgctcgatttagtatgctagtatcgcgggtgttcggcggaggaccaaactgaccgtcctaggtcagcccaaggctgccctcggtcactctgttcccgccctcctctactgctagtctgagcgggctggcaaggcgcatagnn

SEQ ID NO: 87163 - DNA, 168 bp, Homo sapiens; identical to SEQ ID NO: 86396
  misc_feature: GYAE6OF02HO3XD.1.89.I01.1.454.CMB.1.raw
  modified_base (167)..(168): a, c, t, g, unknown or other
  misc_feature (167)..(168): n is a, c, g, or t

SEQ ID NO: 87164 - DNA, 177 bp, Homo sapiens
  misc_feature: GYAE6OF02IGAIG.1.89.I01.1.454.CMB.1.raw
  modified_base (165)..(177): a, c, t, g, unknown or other
  misc_feature (165)..(177): n is a, c, g, or t
tcagacgagtgcgtcacgaccggtgctcgatttagtatgctagtatcgcggggtgttcggcggaggaccaactgaccgtcctaggtcagcccaaggctgcccctcggtcactctgttcccgccctcctccgtgtctgatctgagcgggctggcaaggcgcatagnnnnnnnnnnnnn

SEQ ID NO: 87165 - DNA, 204 bp, Homo sapiens
  misc_feature: GYAE6OF02FQTMT.1.89.I01.1.454.CMB.1.raw
  modified_base (171)..(204): a, c, t, g, unknown or other
  misc_feature (171)..(204): n is a, c, g, or t
tcagacgagtgcgtcacgaccggtgctcgatttagtatgctagtatcggcgggggtgttcggcggagggaccaaactgaccgtcctaggtcagcccaaggctgccccctcggtcactctgttcccaccctcctctactgctagtctgagcgggctggcaaggcgcatagcnnnnnnnnnnnnnnnnnnnnnnnnnnnnnnnnnn

SEQ ID NO: 87166 - DNA, 167 bp, Homo sapiens
  misc_feature: GYAE6OF02GJS0H.1.89.I01.1.454.CMB.1.raw
  modified_base (165)..(167): a, c, t, g, unknown or other
  misc_feature (165)..(167): n is a, c, g, or t
tcagacgagtgcgtcacgaccggtgctcgatttagtatgctagtatcgcgggtcttcggagctgggaccaaggtcaccgtcctaggtcagcccaaggccaacccactgtcactctgttcccacctcctcacgtctactgctgagcgggctggcaaggcgcatagnnn

SEQ ID NO: 87167 - DNA, 165 bp, Homo sapiens
  misc_feature: GYAE6OF02IX2LL.1.89.I01.1.454.CMB.1.raw
  modified_base (165)..(165): a, c, t, g, unknown or other
  misc_feature (165)..(165): n is a, c, g, or t
tcagacgagtgcgtcacgaccggtgctcgatttagtatgctagtatcgcgggtgttcggcggaggaccaaactgaccgtcctaggtcagcccaaggctgcccctcggtcactctgttcccaccctcctctgtcgagcgtctgagcgggctggcaaggcgcatagn

SEQ ID NO: 87168 - DNA, 167 bp, Homo sapiens
  misc_feature: GYAE6OF02F657L.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctagagacacgctgagcgggctggcaaggcgcatagn

SEQ ID NO: 87169 - DNA, 168 bp, Homo sapiens
  misc_feature: GYAE6OF02GO17S.1.89.I01.1.454.CMB.1.raw
  modified_base (165)..(168): a, c, t, g, unknown or other
  misc_feature (165)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcgccctcctctactgctagtctgagcgggctggcaaggcgcatagnnnn

SEQ ID NO: 87170 - DNA, 347 bp, Homo sapiens
  misc_feature: GYAE6OF02GVIQX.1.89.I01.1.454.CMB.1.raw
  modified_base (340)..(347): a, c, t, g, unknown or other
  misc_feature (340)..(347): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctccaccaagggcccatcggtcttcccctggcaccctcctccaagagcacctctggggcacagcggccctgggctgcctggtcaaggcctacttcctcgtagcactctgagcggctggcaaggcgcatagnnnnnnnn

SEQ ID NO: 87171 - DNA, 179 bp, Homo sapiens
  misc_feature: GYAE6OF02HAS3J.1.89.I01.1.454.CMB.1.raw
  modified_base (168)..(179): a, c, t, g, unknown or other
  misc_feature (168)..(179): n is a, c, g, or t
tcagacgagtgcgtcacgaccggtgctcgattagtatgctagtatcgcgggtgttcggcggagggtaccaaactgaccgtcctaaggtcagcccaaggctgcccctcggtcactctgttcccgccctcctctactgctaggtctgagcgggctggcaaggcgcatagnnnnnnnnnnnn

SEQ ID NO: 87172 - DNA, 170 bp, Homo sapiens
  misc_feature: GYAE6OF02IDT0T.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcacgtagcgtgctgagcgggctggcaaggcgcatagnnn

SEQ ID NO: 87173 - DNA, 167 bp, Homo sapiens
  misc_feature: GYAE6OF02FFMVW.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcacgtctactgctgagcgggctggcaaggcgcatagn

SEQ ID NO: 87174 - DNA, 185 bp, Homo sapiens
  misc_feature: GYAE6OF02H2A8B.1.89.I01.1.454.CMB.1.raw
  modified_base (185)..(185): a, c, t, g, unknown or other
  misc_feature (185)..(185): n is a, c, g, or t
tcagacgagtgcgtcacgaccggtgctcgatttagtatgctagtatggatgacagcctgagtgcccttatgtcttcggaactgggaccaaggtcaccgtcctaggtcagcccaaggccaacccactgtcactctgttcccgccctcctctctctcgactctgagcgggctggcaaggcgcatagn

SEQ ID NO: 87175 - DNA, 170 bp, Homo sapiens
  misc_feature: GYAE6OF02IKEZG.1.89.I01.1.454.CMB.1.raw
  modified_base (165)..(170): a, c, t, g, unknown or other
  misc_feature (165)..(170): n is a, c, g, or t
tcagacgagtgcgtcacgaccggtgctcgatttagtatgctagtatcgcggggtgttcggcggaggaccaactgaccgtcctaggtcagcccaaggctgcccctcggtcactctgttcccaccctcctctatacgatcgctgagcgggctggcaaggcgcatagnnnnnn

SEQ ID NO: 87176 - DNA, 168 bp, Homo sapiens; identical to SEQ ID NO: 86287
  misc_feature: GYAE6OF02GAL43.1.89.I01.1.454.CMB.1.raw
  modified_base (168)..(168): a, c, t, g, unknown or other
  misc_feature (168)..(168): n is a, c, g, or t

SEQ ID NO: 87177 - DNA, 187 bp, Homo sapiens; identical to SEQ ID NO: 86384
  misc_feature: GYAE6OF02INY72.1.89.I01.1.454.CMB.1.raw
  modified_base (187)..(187): a, c, t, g, unknown or other
  misc_feature (187)..(187): n is a, c, g, or t

SEQ ID NO: 87178 - DNA, 169 bp, Homo sapiens
  misc_feature: GYAE6OF02G9YZ2.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcacgtagcgtgctgagcgggctggcaaggcgcatagnn

SEQ ID NO: 87179 - DNA, 205 bp, Homo sapiens
  misc_feature: GYAE6OF02G7UBS.1.89.I01.1.454.CMB.1.raw
  modified_base (172)..(205): a, c, t, g, unknown or other
  misc_feature (172)..(205): n is a, c, g, or t
tcagacgagtgcgtcacgaccggtgctcgatttagtatgctagtagtcgcggggtggttcggcggaggacaaactgaccgtcctaggtcagtcccaaggctgcccctcggtcactctgttcccacctcctctacgtgctagttctgagcgggctggtccaaggcgcattagnnnnnnnnnnnnnnnnnnnnnnnnnnnnnnnnnn

SEQ ID NO: 87180 - DNA, 168 bp, Homo sapiens
  misc_feature: GYAE6OF02HH4J5.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctcgtactgcgctgagcgggctggcaaggcgcatagnn

SEQ ID NO: 87181 - DNA, 167 bp, Homo sapiens
  misc_feature: GYAE6OF02FYWIR.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctccgtgtctgatctgagcgggctggcaaggcgcatagn

SEQ ID NO: 87182 - DNA, 168 bp, Homo sapiens
  misc_feature: GYAE6OF02GGTUX.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcacgtctactgctgagcgggctggcaaggcgcatagn

SEQ ID NO: 87183 - DNA, 168 bp, Homo sapiens
  misc_feature: GYAE6OF02GC1I9.1.89.I01.1.454.CMB.1.raw
  modified_base (166)..(168): a, c, t, g, unknown or other
  misc_feature (166)..(168): n is a, c, g, or t
tcagacgagtgcgtcacgaccggtgctcgatttagtatgctagtatcgcgggggtgttcggcggaggaccaaactgaccgtcctaggtcagccaaggctgcccctcggtcactctgttcccaccctcctctgtcgagcgtctgagcgggctggcaaggcgcatagnnn

SEQ ID NO: 87184 - DNA, 169 bp, Homo sapiens
  misc_feature: GYAE6OF02HZJZ2.1.89.I01.1.454.CMB.1.raw
  modified_base (167)..(169): a, c, t, g, unknown or other
  misc_feature (167)..(169): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcacgcactcgtctgagcgggctggcaaggcgcatagnnn

SEQ ID NO: 87185 - DNA, 168 bp, Homo sapiens; identical to SEQ ID NO: 86325
  misc_feature: GYAE6OF02GPJMG.1.89.I01.1.454.CMB.1.raw
  modified_base (168)..(168): a, c, t, g, unknown or other
  misc_feature (168)..(168): n is a, c, g, or t

SEQ ID NO: 87186 - DNA, 188 bp, Homo sapiens
  misc_feature: GYAE6OF02GUKSP.1.89.I01.1.454.CMB.1.raw
  modified_base (184)..(188): a, c, t, g, unknown or other
  misc_feature (184)..(188): n is a, c, g, or t
tcagacgagtgcgtcacgaccggtgctcgatttagtatgctagtatgggatggccacctgagtggtctttggttgttcggcggggaccaagctgaccgtcctaggtcagcccaaggctgcccctcggtcactctgttcccgccatctgatctctcgactctgagcggctggcaaggcgcatagnnnnn

SEQ ID NO: 87187 - DNA, 194 bp, Homo sapiens
  misc_feature: GYAE6OF02JGYC8.1.89.I01.1.454.CMB.1.raw
  modified_base (187)..(194): a, c, t, g, unknown or other
  misc_feature (187)..(194): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagcgggctggcaaggcgcatagnnnnnnnn

SEQ ID NO: 87188 - DNA, 168 bp, Homo sapiens
  misc_feature: GYAE6OF02HNLWO.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctagagacacgctgagcgggctggcaaggcgcatagn

SEQ ID NO: 87189 - DNA, 165 bp, Homo sapiens
  misc_feature: GYAE6OF02G32BG.1.89.I01.1.454.CMB.1.raw
  modified_base (165)..(165): a, c, t, g, unknown or other
  misc_feature (165)..(165): n is a, c, g, or t
tcagacgagtgcgtcacgaccggtgctcgatttagtatgctagtatcgcggggtgttcggcggaggaccaaactgaccgtcctaggtcagccaaggctgcccctcggtcactctgttcccgccctcctctactgctagtctgagcgggctggcaaggcgcatagn

SEQ ID NO: 87190 - DNA, 169 bp, Homo sapiens; identical to SEQ ID NO: 86409
  misc_feature: GYAE6OF02IRCNH.1.89.I01.1.454.CMB.1.raw
  modified_base (169)..(169): a, c, t, g, unknown or other
  misc_feature (169)..(169): n is a, c, g, or t

SEQ ID NO: 87191 - DNA, 167 bp, Homo sapiens; identical to SEQ ID NO: 87181
  misc_feature: GYAE6OF02GZXHV.1.89.I01.1.454.CMB.1.raw
  modified_base (167)..(167): a, c, t, g, unknown or other
  misc_feature (167)..(167): n is a, c, g, or t

SEQ ID NO: 87192 - DNA, 253 bp, Homo sapiens
  misc_feature: GYAE6OF02GG01M.1.89.I01.1.454.CMB.1.raw
  modified_base (238)..(253): a, c, t, g, unknown or other
  misc_feature (238)..(253): n is a, c, g, or t
tcagacgagtgcgtcacgaccggtgctcgatttagtatgctagtatcgcgggaccgatctctgggctccaggctgaggacgaggctgattatttctgcagctcatatacaaccagcagcaccaaagtcttcggaactggaccagggtcacgtcctaggtcagcccaaggccaacccactgtcactctgttcccgccctcctctcgtagcactctgagcgggctggcaaggcgcatagnnnnnnnnnnnnnnnn

SEQ ID NO: 87193 - DNA, 188 bp, Homo sapiens
  misc_feature: GYAE6OF02H8LXA.1.89.I01.1.454.CMB.1.raw
  modified_base (186)..(188): a, c, t, g, unknown or other
  misc_feature (186)..(188): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaacccactgtcactctgttcccgccctcctctctctcgactctgagcgggctggcaaggcgcatagnnn

SEQ ID NO: 87194 - DNA, 168 bp, Homo sapiens; identical to SEQ ID NO: 86351
  misc_feature: GYAE6OF02IWN19.1.89.I01.1.454.CMB.1.raw
  modified_base (168)..(168): a, c, t, g, unknown or other
  misc_feature (168)..(168): n is a, c, g, or t

SEQ ID NO: 87195 - DNA, 167 bp, Homo sapiens
  misc_feature: GYAE6OF02FLFQS.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctcctacagtgctctgagcgggctggcaaggcgcatagn

SEQ ID NO: 87196 - DNA, 168 bp, Homo sapiens
  misc_feature: GYAE6OF02HRYND.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccacctcctctactgctagtctgagcgggctggcaaggcgcatagnn

SEQ ID NO: 87197 - DNA, 206 bp, Homo sapiens
  misc_feature: GYAE6OF02GI0YK.1.89.I01.1.454.CMB.1.raw
  modified_base (168)..(206): a, c, t, g, unknown or other
  misc_feature (168)..(206): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttccgccctcctctactgctagtctgagcgggctggcaaggcgtcatagnnnnnnnnnnnnnnnnnnnnnnnnnnnnnnnnnnnnnnn

SEQ ID NO: 87198 - DNA, 167 bp, Homo sapiens
  misc_feature: GYAE6OF02G0FUC.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtaagcccaaggctgcccctcggtcactctgttcccgccctcctcacgtagcgtgctgagcgggctggcaaggcgcatagn

SEQ ID NO: 87199 - DNA, 167 bp, Homo sapiens
  misc_feature: GYAE6OF02G2CWD.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcccacctcctcacgtagcgtgctgagcgggctggcaaggcgcatagn

SEQ ID NO: 87200 - DNA, 186 bp, Homo sapiens
  misc_feature: GYAE6OF02JIN46.1.89.I01.1.454.CMB.1.raw
  modified_base (169)..(186): a, c, t, g, unknown or other
  misc_feature (169)..(186): n is a, c, g, or t
tcagacgagtgcgtcacgaccggtgctcgatttagtatgctagtatcggcgggggtgttcggcggagggaccaaactgaccgtcctaggtcagcccaaggctgcccctcggtcactctgttcccgccctcctctactgctagtctgagcgggctggcaaggcgcatagnnnnnnnnnnnnnnnnnn

SEQ ID NO: 87201 - DNA, 225 bp, Homo sapiens
  misc_feature: GYAE6OF02I17EF.1.89.I01.1.454.CMB.1.raw
  modified_base (166)..(225): a, c, t, g, unknown or other
  misc_feature (166)..(225): n is a, c, g, or t
tcagacgagtgcgtcacgaccggtgctcgatttagtatgctagtatcgcgggggtgttcggcggagggaccaaactgaccgtcctaggtcagcccaaggctgcccctggtcactctgttcccgcctcctctactgctagtctgagcgggctggcaaggcgcatagnnnnnnnnnnnnnnnnnnnnnnnnnnnnnnnnnnnnnnnnnnnnnnnnnnnnnnnnnnnn

SEQ ID NO: 87202 - DNA, 170 bp, Homo sapiens; identical to SEQ ID NO: 87172
  misc_feature: GYAE6OF02GVSE9.1.89.I01.1.454.CMB.1.raw
  modified_base (168)..(170): a, c, t, g, unknown or other
  misc_feature (168)..(170): n is a, c, g, or t

SEQ ID NO: 87203 - DNA, 169 bp, Homo sapiens
  misc_feature: GYAE6OF02F7PSB.1.89.I01.1.454.CMB.1.raw
  modified_base (165)..(169): a, c, t, g, unknown or other
  misc_feature (165)..(169): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccacctcctctactgctagtctgagcggctggcaaggcgcatagnnnnn

SEQ ID NO: 87204 - DNA, 170 bp, Homo sapiens; identical to SEQ ID NO: 86440
  misc_feature: GYAE6OF02F4X1U.1.89.I01.1.454.CMB.1.raw
  modified_base (170)..(170): a, c, t, g, unknown or other
  misc_feature (170)..(170): n is a, c, g, or t

SEQ ID NO: 87205 - DNA, 171 bp, Homo sapiens
  misc_feature: GYAE6OF02HHMOD.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctgtcgagcgtctgagcgggctggcaaggcgcatagnnnn

SEQ ID NO: 87206 - DNA, 167 bp, Homo sapiens
  misc_feature: GYAE6OF02HKWSD.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctgtcgagcgtctgagcgggctggcaaggcgcatagn

SEQ ID NO: 87207 - DNA, 168 bp, Homo sapiens; identical to SEQ ID NO: 86527
  misc_feature: GYAE6OF02IX5EA.1.89.I01.1.454.CMB.1.raw
  modified_base (168)..(168): a, c, t, g, unknown or other
  misc_feature (168)..(168): n is a, c, g, or t

SEQ ID NO: 87208 - DNA, 170 bp, Homo sapiens; identical to SEQ ID NO: 86485
  misc_feature: GYAE6OF02F7PV9.1.89.I01.1.454.CMB.1.raw
  modified_base (168)..(170): a, c, t, g, unknown or other
  misc_feature (168)..(170): n is a, c, g, or t

SEQ ID NO: 87209 - DNA, 146 bp, Homo sapiens; identical to SEQ ID NO: 86294
  misc_feature: GYAE6OF02IJK7V.1.89.I01.1.454.CMB.1.raw
  modified_base (146)..(146): a, c, t, g, unknown or other
  misc_feature (146)..(146): n is a, c, g, or t

SEQ ID NO: 87210 - DNA, 168 bp, Homo sapiens
  misc_feature: GYAE6OF02HCW4S.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctcatagcgtactctgagcgggctggcaaggcgcatagnn

SEQ ID NO: 87211 - DNA, 168 bp, Homo sapiens; identical to SEQ ID NO: 86543
  misc_feature: GYAE6OF02IB0WW.1.89.I01.1.454.CMB.1.raw
  modified_base (168)..(168): a, c, t, g, unknown or other
  misc_feature (168)..(168): n is a, c, g, or t

SEQ ID NO: 87212 - DNA, 169 bp, Homo sapiens; identical to SEQ ID NO: 86337
  misc_feature: GYAE6OF02INOY7.1.89.I01.1.454.CMB.1.raw
  modified_base (168)..(169): a, c, t, g, unknown or other
  misc_feature (168)..(169): n is a, c, g, or t

SEQ ID NO: 87213 - DNA, 170 bp, Homo sapiens
  misc_feature: GYAE6OF02J0KS9.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcccaccctcctcacgtagcgtgctgagcgggctggcaaggcgcatagnnn

SEQ ID NO: 87214 - DNA, 167 bp, Homo sapiens
  misc_feature: GYAE6OF02JIWD0.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctcacgcactcgtctgagcgggctggcaaggcgcatagn

SEQ ID NO: 87215 - DNA, 185 bp, Homo sapiens
  misc_feature: GYAE6OF02GBSNC.1.89.I01.1.454.CMB.1.raw
  modified_base (170)..(185): a, c, t, g, unknown or other
  misc_feature (170)..(185): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctcgtagcactctgagcgggctggcaaggcgcatagnnnnnnnnnnnnnnnn

SEQ ID NO: 87216 - DNA, 168 bp, Homo sapiens; identical to SEQ ID NO: 86655
  misc_feature: GYAE6OF02F7QVA.1.89.I01.1.454.CMB.1.raw
  modified_base (168)..(168): a, c, t, g, unknown or other
  misc_feature (168)..(168): n is a, c, g, or t

SEQ ID NO: 87217 - DNA, 167 bp, Homo sapiens
  misc_feature: GYAE6OF02G8YLQ.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactttgttcccgcctcctctactgctagtctgagcgggctggcaaggcgcatagn

SEQ ID NO: 87218 - DNA, 169 bp, Homo sapiens; identical to SEQ ID NO: 86265
  misc_feature: GYAE6OF02GMW7R.1.89.I01.1.454.CMB.1.raw
  modified_base (168)..(169): a, c, t, g, unknown or other
  misc_feature (168)..(169): n is a, c, g, or t

SEQ ID NO: 87219 - DNA, 168 bp, Homo sapiens; identical to SEQ ID NO: 86282
  misc_feature: GYAE6OF02GNJDZ.1.89.I01.1.454.CMB.1.raw
  modified_base (168)..(168): a, c, t, g, unknown or other
  misc_feature (168)..(168): n is a, c, g, or t

SEQ ID NO: 87220 - DNA, 169 bp, Homo sapiens
  misc_feature: GYAE6OF02HW3XB.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcacgtagcgtgctgagcgggctggcaaggcgcatagnn

SEQ ID NO: 87221 - DNA, 219 bp, Homo sapiens
  misc_feature: GYAE6OF02H0M2C.1.89.I01.1.454.CMB.1.raw
  modified_base (161)..(219): a, c, t, g, unknown or other
  misc_feature (161)..(219): n is a, c, g, or t
tcagacgagtgcgtcacgaccggtgctcgatttagtatgctagtatcgcgggtgttcggcggaggaccaactgaccgtcctaggtcagcccaaggctgcccctcggtcactctgttcccacctcctctactgctagtctgagcggctggcaaggcgcatgnnnnnnnnnnnnnnnnnnnnnnnnnnnnnnnnnnnnnnnnnnnnnnnnnnnnnnnnnnn

SEQ ID NO: 87222 - DNA, 169 bp, Homo sapiens
  misc_feature: GYAE6OF02IVVSZ.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcggcgggggtgttcggcggagggaccaaactgaccgtcctaggtcagcccaaggctgcccctcggtcactctgttcccaccctcctcatagcgtactctgagcgggctggcaaggcgcatagn

SEQ ID NO: 87223 - DNA, 170 bp, Homo sapiens
  misc_feature: GYAE6OF02JNRMQ.1.89.I01.1.454.CMB.1.raw
  modified_base (165)..(170): a, c, t, g, unknown or other
  misc_feature (165)..(170): n is a, c, g, or t
tcagacgagtgcgtcacgaccggtgctcgatttagtatgctagtatcgcgggggtgttcggcggagggaccaaactgaccgtcctaggtcagccaaggctgcccctcggtcactctgttccacctcctctactgctagtctgagcgggctggcaaggcgcatagnnnnnn

SEQ ID NO: 87224 - DNA, 190 bp, Homo sapiens
  misc_feature: GYAE6OF02IY9HH.1.89.I01.1.454.CMB.1.raw
  modified_base (168)..(190): a, c, t, g, unknown or other
  misc_feature (168)..(190): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcacgtctgttcccacctcctcatagcgtactctgagcgggctggcaaggcgcatagnnnnnnnnnnnnnnnnnnnnnnn

SEQ ID NO: 87225 - DNA, 168 bp, Homo sapiens
  misc_feature: GYAE6OF02GESZO.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccgccctcctctactgctagtctgagcgggctggcaaggcgcatagnn

SEQ ID NO: 87226 - DNA, 187 bp, Homo sapiens
  misc_feature: GYAE6OF02GFSSP.1.89.I01.1.454.CMB.1.raw
  modified_base (187)..(187): a, c, t, g, unknown or other
  misc_feature (187)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggctgccccctcggtcactctgttcccaccctcctctctctcgactctgagcgggctggcaaggcgcatagn

SEQ ID NO: 87227 - DNA, 169 bp, Homo sapiens; identical to SEQ ID NO: 86276
  misc_feature: GYAE6OF02HVVH8.1.89.I01.1.454.CMB.1.raw
  modified_base (168)..(169): a, c, t, g, unknown or other
  misc_feature (168)..(169): n is a, c, g, or t

SEQ ID NO: 87228 - DNA, 171 bp, Homo sapiens; identical to SEQ ID NO: 86632
  misc_feature: GYAE6OF02IE6S4.1.89.I01.1.454.CMB.1.raw
  modified_base (169)..(171): a, c, t, g, unknown or other
  misc_feature (169)..(171): n is a, c, g, or t

SEQ ID NO: 87229 - DNA, 165 bp, Homo sapiens
  misc_feature: GYAE6OF02JYJ85.1.89.I01.1.454.CMB.1.raw
  modified_base (163)..(165): a, c, t, g, unknown or other
  misc_feature (163)..(165): n is a, c, g, or t
tcagacgagtgcgtcacgaccggtgctcgatttagtatgctagtatcgcggggtgttcggcggaggaccaactgaccgtcctaggtcagcccaaggctgcccctcggtcactctgttcccacctcctcatagcgtactctgagcggctggcaaggcgcatagnnn

SEQ ID NO: 87230 - DNA, 188 bp, Homo sapiens
  misc_feature: GYAE6OF02JJMTF.1.89.I01.1.454.CMB.1.raw
  modified_base (185)..(188): a, c, t, g, unknown or other
  misc_feature (185)..(188): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaacccactgtcactctgttcccaccctcctctctctcgactctgagcggctggcaaggcgcatagnnnn

SEQ ID NO: 87231 - DNA, 168 bp, Homo sapiens; identical to SEQ ID NO: 86369
  misc_feature: GYAE6OF02IVG38.1.89.I01.1.454.CMB.1.raw
  modified_base (167)..(168): a, c, t, g, unknown or other
  misc_feature (167)..(168): n is a, c, g, or t

SEQ ID NO: 87232 - DNA, 185 bp, Homo sapiens
  misc_feature: GYAE6OF02JF8D0.1.89.I01.1.454.CMB.1.raw
  modified_base (173)..(185): a, c, t, g, unknown or other
  misc_feature (173)..(185): n is a, c, g, or t
tcagacgagtgcgtcacgaccggtgctcgatttagtatgctagtatcggcgggggtgttcggcggagggaccaaactgaccgtcctaggtccagcccaaggctgcccctcggtcactctgttcccgccctcctccagtacgcgtactctgagcgggctggcaaggcgcatagnnnnnnnnnnnnn

SEQ ID NO: 87233 - DNA, 188 bp, Homo sapiens; identical to SEQ ID NO: 86367
  misc_feature: GYAE6OF02IXK23.1.89.I01.1.454.CMB.1.raw
  modified_base (187)..(188): a, c, t, g, unknown or other
  misc_feature (187)..(188): n is a, c, g, or t

SEQ ID NO: 87234 - DNA, 188 bp, Homo sapiens; identical to SEQ ID NO: 86724
  misc_feature: GYAE6OF02GOMPH.1.89.I01.1.454.CMB.1.raw
  modified_base (187)..(188): a, c, t, g, unknown or other
  misc_feature (187)..(188): n is a, c, g, or t

SEQ ID NO: 87235 - DNA, 193 bp, Homo sapiens
  misc_feature: GYAE6OF02H7U9S.1.89.I01.1.454.CMB.1.raw
  modified_base (168)..(193): a, c, t, g, unknown or other
  misc_feature (168)..(193): n is a, c, g, or t
tcagacgagtgcgtcacgaccggtgctcgatttagtatgctagtatcgcggggtgttcggcggagggaccaaactgaccgtcctaggtcagcccaaggctgccccctctgtcactctgttcccaccctctctgtcgagcgtctgagcgggctggcaaggcgcattagnnnnnnnnnnnnnnnnnnnnnnnnnn

SEQ ID NO: 87236 - DNA, 233 bp, Homo sapiens
  misc_feature: GYAE6OF02H0BA5.1.89.I01.1.454.CMB.1.raw
  modified_base (174)..(233): a, c, t, g, unknown or other
  misc_feature (174)..(233): n is a, c, g, or t
tcagacgagtgcgtcacgaccggtgctcgatttagtatgctagtatcggcggggtcttacgggagctgggaccaaggtcaccgtcctaggtaaagcccaaggccaaccccactgtcacgtctgttcccaccctcctcacgtctactgctgagcgggctggccaaggcgcatagnnnnnnnnnnnnnnnnnnnnnnnnnnnnnnnnnnnnnnnnnnnnnnnnnnnnnnnnnnnn

SEQ ID NO: 87237 - DNA, 168 bp, Homo sapiens; identical to SEQ ID NO: 86287
  misc_feature: GYAE6OF02FLX6Z.1.89.I01.1.454.CMB.1.raw
  modified_base (168)..(168): a, c, t, g, unknown or other
  misc_feature (168)..(168): n is a, c, g, or t

SEQ ID NO: 87238 - DNA, 169 bp, Homo sapiens; identical to SEQ ID NO: 86276
  misc_feature: GYAE6OF02HY7UL.1.89.I01.1.454.CMB.1.raw
  modified_base (168)..(169): a, c, t, g, unknown or other
  misc_feature (168)..(169): n is a, c, g, or t

SEQ ID NO: 87239 - DNA, 216 bp, Homo sapiens
  misc_feature: GYAE6OF02GJ0LA.1.89.I01.1.454.CMB.1.raw
  modified_base (163)..(216): a, c, t, g, unknown or other
  misc_feature (163)..(216): n is a, c, g, or t
tcagacgagtgcgtcacgaccggtgctcgatttagtatgctagtatcgcgggtgttcggcgagggaccaaactgaccgtcctaggtcagcccaaggctgcccctcggtcactctgttcccacctctctactgctagtctgagcgggctggcaaggcgcatagnnnnnnnnnnnnnnnnnnnnnnnnnnnnnnnnnnnnnnnnnnnnnnnnnnnnnn

SEQ ID NO: 87240 - DNA, 169 bp, Homo sapiens; identical to SEQ ID NO: 86276
  misc_feature: GYAE6OF02FTE1M.1.89.I01.1.454.CMB.1.raw
  modified_base (168)..(169): a, c, t, g, unknown or other
  misc_feature (168)..(169): n is a, c, g, or t

SEQ ID NO: 87241 - DNA, 168 bp, Homo sapiens; identical to SEQ ID NO: 86282
  misc_feature: GYAE6OF02GXM27.1.89.I01.1.454.CMB.1.raw
  modified_base (168)..(168): a, c, t, g, unknown or other
  misc_feature (168)..(168): n is a, c, g, or t

SEQ ID NO: 87242 - DNA, 185 bp, Homo sapiens
  misc_feature: GYAE6OF02GQ7HB.1.89.I01.1.454.CMB.1.raw
  modified_base (169)..(185): a, c, t, g, unknown or other
  misc_feature (169)..(185): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcgtactgctagtctgagcgggctggcaaggcgcatagnnnnnnnnnnnnnnnnn

SEQ ID NO: 87243 - DNA, 167 bp, Homo sapiens; identical to SEQ ID NO: 87199
  misc_feature: GYAE6OF02HH6NE.1.89.I01.1.454.CMB.1.raw
  modified_base (167)..(167): a, c, t, g, unknown or other
  misc_feature (167)..(167): n is a, c, g, or t

SEQ ID NO: 87244 - DNA, 173 bp, Homo sapiens
  misc_feature: GYAE6OF02G0Y34.1.89.I01.1.454.CMB.1.raw
  modified_base (167)..(173): a, c, t, g, unknown or other
  misc_feature (167)..(173): n is a, c, g, or t
tcagacgagtgcgtcacgaccggtgctcgatttagtatgctagtatcggcgggggtgttcggcggagggaccaaactgaccgtcctaggtcagcccaaggctgcccctcggtcactctgttcccacccctctgtcgagcgtctgagcgggctggcaaggcgcatagnnnnnnn

SEQ ID NO: 87245 - DNA, 171 bp, Homo sapiens; identical to SEQ ID NO: 87205
  misc_feature: GYAE6OF02JGVT5.1.89.I01.1.454.CMB.1.raw
  modified_base (168)..(171): a, c, t, g, unknown or other
  misc_feature (168)..(171): n is a, c, g, or t

SEQ ID NO: 87246 - DNA, 168 bp, Homo sapiens; identical to SEQ ID NO: 86325
  misc_feature: GYAE6OF02GT5PM.1.89.I01.1.454.CMB.1.raw
  modified_base (168)..(168): a, c, t, g, unknown or other
  misc_feature (168)..(168): n is a, c, g, or t

SEQ ID NO: 87247 - DNA, 201 bp, Homo sapiens
  misc_feature: GYAE6OF02JNK7B.1.89.I01.1.454.CMB.1.raw
  modified_base (170)..(201): a, c, t, g, unknown or other
  misc_feature (170)..(201): n is a, c, g, or t
tcagacgagtgcgtcacgaccggtgctcgatttagtatgctagtatcgcggggggtgttcggcggagggaccaaactgaccgtcctaggtcagccaaggcctgcccctcggtcactctgttcccaccctctcatagcgtactctggagcgggctggcaaggcgcagtagnnnnnnnnnnnnnnnnnnnnnnnnnnnnnnnn

SEQ ID NO: 87248 - DNA, 218 bp, Homo sapiens
  misc_feature: GYAE6OF02FZ3NJ.1.89.I01.1.454.CMB.1.raw
  modified_base (165)..(218): a, c, t, g, unknown or other
  misc_feature (165)..(218): n is a, c, g, or t
tcagacgagtgcgtcacgaccggtgctcgatttagtatgctagtatcgcgggggtgttcggcggagggaccaaactgaccgtcctaggtcagcccaaggctgcccctggtcactctgttcccgcctctctactgctagtctgagcgggctggcaaggcgcatagnnnnnnnnnnnnnnnnnnnnnnnnnnnnnnnnnnnnnnnnnnnnnnnnnnnnnn

SEQ ID NO: 87249 - DNA, 188 bp, Homo sapiens; identical to SEQ ID NO: 86724
  misc_feature: GYAE6OF02ILMA8.1.89.I01.1.454.CMB.1.raw
  modified_base (187)..(188): a, c, t, g, unknown or other
  misc_feature (187)..(188): n is a, c, g, or t

SEQ ID NO: 87250 - DNA, 178 bp, Homo sapiens
  misc_feature: GYAE6OF02GKRP1.1.89.I01.1.454.CMB.1.raw
  modified_base (169)..(178): a, c, t, g, unknown or other
  misc_feature (169)..(178): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctccgtgtctgatctgagcgggctggcaaggcgcatagnnnnnnnnnn

SEQ ID NO: 87251 - DNA, 190 bp, Homo sapiens; identical to SEQ ID NO: 86825
  misc_feature: GYAE6OF02HCUXC.1.89.I01.1.454.CMB.1.raw
  modified_base (187)..(190): a, c, t, g, unknown or other
  misc_feature (187)..(190): n is a, c, g, or t

SEQ ID NO: 87252 - DNA, 168 bp, Homo sapiens; identical to SEQ ID NO: 86317
  misc_feature: GYAE6OF02I2CXE.1.89.I01.1.454.CMB.1.raw
  modified_base (168)..(168): a, c, t, g, unknown or other
  misc_feature (168)..(168): n is a, c, g, or t

SEQ ID NO: 87253 - DNA, 172 bp, Homo sapiens
  misc_feature: GYAE6OF02GGTTZ.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcacgtagcgtgctgagcgggctggcaaggcgcatagnnnn

SEQ ID NO: 87254 - DNA, 170 bp, Homo sapiens; identical to SEQ ID NO: 86334
  misc_feature: GYAE6OF02GKJ0H.1.89.I01.1.454.CMB.1.raw
  modified_base (169)..(170): a, c, t, g, unknown or other
  misc_feature (169)..(170): n is a, c, g, or t

SEQ ID NO: 87255 - DNA, 241 bp, Homo sapiens
  misc_feature: GYAE6OF02HT8EJ.1.89.I01.1.454.CMB.1.raw
  modified_base (240)..(241): a, c, t, g, unknown or other
  misc_feature (240)..(241): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccactgtcactctgttcccaccctcctctcgtagcactctgagcgggctggcaaggcgcatagnn

SEQ ID NO: 87256 - DNA, 170 bp, Homo sapiens
  misc_feature: GYAE6OF02G4Z76.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctagtctgagcgggctggcaaggcgcatagnnn

SEQ ID NO: 87257 - DNA, 170 bp, Homo sapiens; identical to SEQ ID NO: 87172
  misc_feature: GYAE6OF02FXTCK.1.89.I01.1.454.CMB.1.raw
  modified_base (168)..(170): a, c, t, g, unknown or other
  misc_feature (168)..(170): n is a, c, g, or t

SEQ ID NO: 87258 - DNA, 252 bp, Homo sapiens
  misc_feature: GYAE6OF02G9T2M.1.89.I01.1.454.CMB.1.raw
  modified_base (225)..(225): a, c, t, g, unknown or other
  misc_feature (225)..(225): n is a, c, g, or t
  modified_base (231)..(252): a, c, t, g, unknown or other
  misc_feature (231)..(252): n is a, c, g, or t
tcagacgagtgcgtcacgaccggtgctcgatttagtatgctagtatcggcggggcccaggcagatgatgagtctacttactattgtgtccgtttacttgcgtgatggcatttggcttggttcggcggagggaccaaagtgacccgtcctgggtcagccccaaggctgccccctggtcactctgttcccacctcctctgtcgagcgtctgagcggctggcaaggcncatagnnnnnnnnnnnnnnnnnnnnnn

SEQ ID NO: 87259 - DNA, 187 bp, Homo sapiens
  misc_feature: GYAE6OF02IJKF1.1.89.I01.1.454.CMB.1.raw
  modified_base (169)..(187): a, c, t, g, unknown or other
  misc_feature (169)..(187): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgtcatagnnnnnnnnnnnnnnnnnnn

SEQ ID NO: 87260 - DNA, 168 bp, Homo sapiens; identical to SEQ ID NO: 86351
  misc_feature: GYAE6OF02I2WHA.1.89.I01.1.454.CMB.1.raw
  modified_base (168)..(168): a, c, t, g, unknown or other
  misc_feature (168)..(168): n is a, c, g, or t

SEQ ID NO: 87261 - DNA, 177 bp, Homo sapiens
  misc_feature: GYAE6OF02HY95K.1.89.I01.1.454.CMB.1.raw
  modified_base (168)..(177): a, c, t, g, unknown or other
  misc_feature (168)..(177): n is a, c, g, or t
tcagacgagtgcgtcacgaccggtgctcgatttagtatgctagtatcgcgggggtgttacggcggagggaccaaactgaccgtcctaggtcagcccaaggctgcccctcggtcactctgttccaccctcctcacgtagcgtgctgagcgggctggcaaggcgcatagnnnnnnnnnn

SEQ ID NO: 87262 - DNA, 214 bp, Homo sapiens
  misc_feature: GYAE6OF02HKY2H.1.89.I01.1.454.CMB.1.raw
  modified_base (56)..(56): a, c, t, g, unknown or other
  misc_feature (56)..(56): n is a, c, g, or t
  modified_base (164)..(214): a, c, t, g, unknown or other
  misc_feature (164)..(214): n is a, c, g, or t
tcagacgagtgcgtcacgaccggtgctcgatttagtatgctagtatcgcgggggtnttcggcggaggaccaaactgaccgtcctaggtcagcccaaggctgcccctcggtcactctgttcccgcctctctactgctagtctgagcggctggcaaggcgcatagnnnnnnnnnnnnnnnnnnnnnnnnnnnnnnnnnnnnnnnnnnnnnnnnnnn

SEQ ID NO: 87263 - DNA, 169 bp, Homo sapiens
  misc_feature: GYAE6OF02H9WKT.1.89.I01.1.454.CMB.1.raw
  modified_base (167)..(169): a, c, t, g, unknown or other
  misc_feature (167)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctcttccgccatctgaatagcgtactctgagcgggctggcaaggcgcatagnnn

SEQ ID NO: 87264 - DNA, 176 bp, Homo sapiens
  misc_feature: GYAE6OF02F8YNK.1.89.I01.1.454.CMB.1.raw
  modified_base (170)..(176): a, c, t, g, unknown or other
  misc_feature (170)..(176): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnnnnn

SEQ ID NO: 87265 - DNA, 168 bp, Homo sapiens; identical to SEQ ID NO: 86351
  misc_feature: GYAE6OF02G9W7M.1.89.I01.1.454.CMB.1.raw
  modified_base (168)..(168): a, c, t, g, unknown or other
  misc_feature (168)..(168): n is a, c, g, or t

SEQ ID NO: 87266 - DNA, 171 bp, Homo sapiens
  misc_feature: GYAE6OF02HUCMC.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgcatagnnnn

SEQ ID NO: 87267 - DNA, 168 bp, Homo sapiens
  misc_feature: GYAE6OF02GWK8Q.1.89.I01.1.454.CMB.1.raw
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcctacagtgctctgagcgggctggcaaggcgcatag

SEQ ID NO: 87268 - DNA, 170 bp, Homo sapiens; identical to SEQ ID NO: 86465
  misc_feature: GYAE6OF02IMET1.1.89.I01.1.454.CMB.1.raw
  modified_base (167)..(170): a, c, t, g, unknown or other
  misc_feature (167)..(170): n is a, c, g, or t

SEQ ID NO: 87269 - DNA, 168 bp, Homo sapiens
  misc_feature: GYAE6OF02GNHI4.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcatagcgtactctgagcgggctggcaaggcgcatagnn

SEQ ID NO: 87270 - DNA, 169 bp, Homo sapiens
  misc_feature: GYAE6OF02ILLPL.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcggggtcttcggagctgggaccaaggtcaccgtcctaggtcagcccaaggccaaccccactgtcactctgttcccgccctcctcacgtctactgctgagcgggctggcaaggcgcatagnn

SEQ ID NO: 87271 - DNA, 171 bp, Homo sapiens
  misc_feature: GYAE6OF02IMV14.1.89.I01.1.454.CMB.1.raw
  modified_base (165)..(171): a, c, t, g, unknown or other
  misc_feature (165)..(171): n is a, c, g, or t
tcagacgagtgcgtcacgaccggtgctcgatttagtatgctagtatcgcgggggtgttcggcggagggaccgaaactgaccgtcctaggtcagccaaggctgcccctcggtcactctgttccgcctcctctactgctagtctgagcggctggcaaggcgcatagnnnnnnn

SEQ ID NO: 87272 - DNA, 178 bp, Homo sapiens
  misc_feature: GYAE6OF02HFNIG.1.89.I01.1.454.CMB.1.raw
  modified_base (169)..(178): a, c, t, g, unknown or other
  misc_feature (169)..(178): n is a, c, g, or t
tcagacgagtgcgtcacgaccggtgctcgatttagtatgctagtatcggcgggggtgttcggcggagggaccaaactgaccgtcctaggtcagcccaaggctgcccctcggtcactctgttcccgccctcctcacgtagcgtgctgagcgggctggcaaggcgcatagnnnnnnnnnn

SEQ ID NO: 87273 - DNA, 168 bp, Homo sapiens; identical to SEQ ID NO: 86427
  misc_feature: GYAE6OF02F09OT.1.89.I01.1.454.CMB.1.raw
  modified_base (168)..(168): a, c, t, g, unknown or other
  misc_feature (168)..(168): n is a, c, g, or t

SEQ ID NO: 87274 - DNA, 215 bp, Homo sapiens
  misc_feature: GYAE6OF02FORWS.1.89.I01.1.454.CMB.1.raw
  modified_base (56)..(56): a, c, t, g, unknown or other
  misc_feature (56)..(56): n is a, c, g, or t
  modified_base (165)..(215): a, c, t, g, unknown or other
  misc_feature (165)..(215): n is a, c, g, or t
tcagacgagtgcgtcacgaccggtgctcgatttagtatgctagtatcgcgggggtnttcggcggagggaccaaactgaccgtcctaggtcagcccaaggctgcccctggtcactctgttcccacctctctactgctagtctgagcgggctggcaaggcgcatagnnnnnnnnnnnnnnnnnnnnnnnnnnnnnnnnnnnnnnnnnnnnnnnnnnn

SEQ ID NO: 87275 - DNA, 255 bp, Homo sapiens
  misc_feature: GYAE6OF02H5A7C.1.89.I01.1.454.CMB.1.raw
  modified_base (254)..(255): a, c, t, g, unknown or other
  misc_feature (254)..(255): n is a, c, g, or t
tcagacgagtgcgtcacgaccggtgctcgatttagtatgctagtatcgcgggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgccccctcggtcactctgttcccgccatctgaatagcgtactctgagcgggctggcaaggcgcatagnn

SEQ ID NO: 87276 - DNA, 170 bp, Homo sapiens; identical to SEQ ID NO: 86296
  misc_feature: GYAE6OF02FS8C5.1.89.I01.1.454.CMB.1.raw
  modified_base (169)..(170): a, c, t, g, unknown or other
  misc_feature (169)..(170): n is a, c, g, or t

SEQ ID NO: 87277 - DNA, 349 bp, Homo sapiens
  misc_feature: GYAE6OF02G9TJK.1.89.I01.1.454.CMB.1.raw
  modified_base (342)..(349): a, c, t, g, unknown or other
  misc_feature (342)..(349): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctggggcacagcggccctgggctgcctggtcaaggctacttccgagtgcgtctctgagcgggctggcaaggcgcatagnnnnnnnn

SEQ ID NO: 87278 - DNA, 182 bp, Homo sapiens
  misc_feature: GYAE6OF02HW5MX.1.89.I01.1.454.CMB.1.raw
  modified_base (168)..(182): a, c, t, g, unknown or other
  misc_feature (168)..(182): n is a, c, g, or t
tcagacgagtgcgtcacgaccggtgctcgatttagtatgctagtatcgcgggggtgttcggcggagggaccaaactgaccgtcctaggtaagcccaaggctgcccctcggtcactctgttcccaccctcctcacgtagcgtgctgagcgggctggcaaggcgcatagnnnnnnnnnnnnnnn

SEQ ID NO: 87279 - DNA, 178 bp, Homo sapiens
  misc_feature: GYAE6OF02FZRKX.1.89.I01.1.454.CMB.1.raw
  modified_base (169)..(178): a, c, t, g, unknown or other
  misc_feature (169)..(178): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctctactgctagtctgagcgggctggcaaggcgcatagnnnnnnnnnn

SEQ ID NO: 87280 - DNA, 209 bp, Homo sapiens
  misc_feature: GYAE6OF02JQEBD.1.89.I01.1.454.CMB.1.raw
  modified_base (165)..(209): a, c, t, g, unknown or other
  misc_feature (165)..(209): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgcctctctactgctagtctgagcggctggcaaggcgcatagnnnnnnnnnnnnnnnnnnnnnnnnnnnnnnnnnnnnnnnnnnnnn

SEQ ID NO: 87281 - DNA, 169 bp, Homo sapiens
  misc_feature: GYAE6OF02I96RM.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctagagacacgctgagcgggctggcaaggcgcatagnn

SEQ ID NO: 87282 - DNA, 228 bp, Homo sapiens
  misc_feature: GYAE6OF02GG358.1.89.I01.1.454.CMB.1.raw
  modified_base (188)..(228): a, c, t, g, unknown or other
  misc_feature (188)..(228): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactggtcactctgttcccaccctcctcacgtagcgtgctgagcgggctggcaaggcgcatagnnnnnnnnnnnnnnnnnnnnnnnnnnnnnnnnnnnnnnnnn

SEQ ID NO: 87283 - DNA, 168 bp, Homo sapiens; identical to SEQ ID NO: 86282
  misc_feature: GYAE6OF02GPU9O.1.89.I01.1.454.CMB.1.raw
  modified_base (168)..(168): a, c, t, g, unknown or other
  misc_feature (168)..(168): n is a, c, g, or t

SEQ ID NO: 87284 - DNA, 179 bp, Homo sapiens
  misc_feature: GYAE6OF02GXQ2M.1.89.I01.1.454.CMB.1.raw
  modified_base (169)..(179): a, c, t, g, unknown or other
  misc_feature (169)..(179): n is a, c, g, or t
tcagacgagtgcgtcacgaccggtgctcgatttagtatgctagtatcgcgggggtgttacggcggagggaccaaactgaccgtcctaggtcagcccaaggctgcccctcggtcactctgttcccaccctcctctgtcgagcgtctgagcgggctggcaaggcgcatagnnnnnnnnnnn

SEQ ID NO: 87285 - DNA, 169 bp, Homo sapiens
  misc_feature: GYAE6OF02HE46C.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctactgctagtctgagcgggctggcaaggcgcatagn

SEQ ID NO: 87286 - DNA, 190 bp, Homo sapiens
  misc_feature: GYAE6OF02HKMPG.1.89.I01.1.454.CMB.1.raw
  modified_base (169)..(190): a, c, t, g, unknown or other
  misc_feature (169)..(190): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctcgtactgcgctgagcgggctggcaaggcgcatagnnnnnnnnnnnnnnnnnnnnnn

SEQ ID NO: 87287 - DNA, 170 bp, Homo sapiens
  misc_feature: GYAE6OF02HC6I0.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcggggtcttcggagctgggaccaaggtcaccgtcctaggtaagcccaaggccaaccccactgtcactctgttcccaccctcctcacgtctactgctgagcgggctggcaaggcgcatagnnn

SEQ ID NO: 87288 - DNA, 169 bp, Homo sapiens; identical to SEQ ID NO: 86667
  misc_feature: GYAE6OF02HDL7J.1.89.I01.1.454.CMB.1.raw
  modified_base (168)..(169): a, c, t, g, unknown or other
  misc_feature (168)..(169): n is a, c, g, or t

SEQ ID NO: 87289 - DNA, 356 bp, Homo sapiens
  misc_feature: GYAE6OF02HDHGC.1.89.I01.1.454.CMB.1.raw
  modified_base (351)..(356): a, c, t, g, unknown or other
  misc_feature (351)..(356): n is a, c, g, or t
tcagacgagtgcgtcacgaccggtgctcgatttagtatgctagtataggcacgaaccggacctgacggctcaggaggtcagcagagcgagggagggaggaggaggaccccgaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctggggcacagcggccctgggctgcctggtcaaggctacttccgagtgcgtctctgagcgggctggcaaggcgcatagnnnnnn

SEQ ID NO: 87290 - DNA, 168 bp, Homo sapiens; identical to SEQ ID NO: 86325
  misc_feature: GYAE6OF02HT11A.1.89.I01.1.454.CMB.1.raw
  modified_base (168)..(168): a, c, t, g, unknown or other
  misc_feature (168)..(168): n is a, c, g, or t

SEQ ID NO: 87291 - DNA, 172 bp, Homo sapiens
  misc_feature: GYAE6OF02H1YBN.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctgtcgagcgtctgagcgggctggcaaggcgcatagnnnn

SEQ ID NO: 87292 - DNA, 167 bp, Homo sapiens
  misc_feature: GYAE6OF02FLSZC.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctctactgctagtctgagcgggctggcaaggcgcatagn

SEQ ID NO: 87293 - DNA, 169 bp, Homo sapiens
  misc_feature: GYAE6OF02IZCTW.1.89.I01.1.454.CMB.1.raw
  modified_base (165)..(169): a, c, t, g, unknown or other
  misc_feature (165)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttccgcctcctcctacagtgctctgagcggctggcaaggcgcatagnnnnn

SEQ ID NO: 87294 - DNA, 170 bp, Homo sapiens
  misc_feature: GYAE6OF02FF5G9.1.89.I01.1.454.CMB.1.raw
  modified_base (166)..(170): a, c, t, g, unknown or other
  misc_feature (166)..(170): n is a, c, g, or t
tcagacgagtgcgtcacgaccggtgctcgatttagtatgctagtatcgcgggatggtttggcggaggaccaagctgaccgtcctaggtcagcccaaggctgcccctcggtcactctgttccaccctcctcctacagtgctctgagcgggctggcaaggcgcatagnnnnn

SEQ ID NO: 87295 - DNA, 240 bp, Homo sapiens
  misc_feature: GYAE6OF02GYBMA.1.89.I01.1.454.CMB.1.raw
  modified_base (180)..(180): a, c, t, g, unknown or other
  misc_feature (180)..(180): n is a, c, g, or t
  modified_base (182)..(240): a, c, t, g, unknown or other
  misc_feature (182)..(240): n is a, c, g, or t
tcagacgagtgcgtcacgaccggtgctcgatttagtatgctagtattcggcggggggtgttcggcggagggaccaaaccgtgaccgtcctaggtccacgcccaaggcctgcccccttcggtcactctgttcccgccctacctctgtcgagcgtctgagcgggctggcaaggcgcatacgntnnnnnnnnnnnnnnnnnnnnnnnnnnnnnnnnnnnnnnnnnnnnnnnnnnnnnnnnnnn

SEQ ID NO: 87296 - DNA, 189 bp, Homo sapiens
  misc_feature: GYAE6OF02H3ULB.1.89.I01.1.454.CMB.1.raw
  modified_base (170)..(189): a, c, t, g, unknown or other
  misc_feature (170)..(189): n is a, c, g, or t
tcagacgagtgcgtcacgaccggtgctcgatttagtatgctagtatcgtcgggggtgttcggcggagggaccaaactgaccgtcctaggtcagcccaaggctgccccctcggtcactctgttcccaccctcctctgtcgagcgtctgagcgggctggcaaggcgcatagnnnnnnnnnnnnnnnnnnnn

SEQ ID NO: 87297 - DNA, 211 bp, Homo sapiens
  misc_feature: GYAE6OF02IXIDL.1.89.I01.1.454.CMB.1.raw
  modified_base (166)..(211): a, c, t, g, unknown or other
  misc_feature (166)..(211): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccacctctctactgctagtctgagcgggctggcaaggcgcatagnnnnnnnnnnnnnnnnnnnnnnnnnnnnnnnnnnnnnnnnnnnnnn

SEQ ID NO: 87298 - DNA, 168 bp, Homo sapiens; identical to SEQ ID NO: 86655
  misc_feature: GYAE6OF02HLPPV.1.89.I01.1.454.CMB.1.raw
  modified_base (168)..(168): a, c, t, g, unknown or other
  misc_feature (168)..(168): n is a, c, g, or t

SEQ ID NO: 87299 - DNA, 188 bp, Homo sapiens
  misc_feature: GYAE6OF02JD8F7.1.89.I01.1.454.CMB.1.raw
  modified_base (172)..(188): a, c, t, g, unknown or other
  misc_feature (172)..(188): n is a, c, g, or t
tcagacgagtgcgtcacgaccggtgctcgatttagtatgctagtagtcgcggggggtgttcggcggagggaccaaactgaccgtcctaggtcagcccaaggctgccccctcggtcactctgttcccaccctcctctactgcctagtctgagcgggctggcaaggcgcatagnnnnnnnnnnnnnnnnn

SEQ ID NO: 87300 - DNA, 169 bp, Homo sapiens
  misc_feature: GYAE6OF02HFEES.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctgtcgagcgtctgagcgggctggcaaggcgcatagnn

SEQ ID NO: 87301 - DNA, 194 bp, Homo sapiens; identical to SEQ ID NO: 87187
  misc_feature: GYAE6OF02FIJV0.1.89.I01.1.454.CMB.1.raw
  modified_base (187)..(194): a, c, t, g, unknown or other
  misc_feature (187)..(194): n is a, c, g, or t

SEQ ID NO: 87302 - DNA, 188 bp, Homo sapiens; identical to SEQ ID NO: 86367
  misc_feature: GYAE6OF02FSJJ7.1.89.I01.1.454.CMB.1.raw
  modified_base (187)..(188): a, c, t, g, unknown or other
  misc_feature (187)..(188): n is a, c, g, or t

SEQ ID NO: 87303 - DNA, 180 bp, Homo sapiens
  misc_feature: GYAE6OF02JBUTU.1.89.I01.1.454.CMB.1.raw
  modified_base (170)..(180): a, c, t, g, unknown or other
  misc_feature (170)..(180): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagnnnnnnnnnnn

SEQ ID NO: 87304 - DNA, 169 bp, Homo sapiens; identical to SEQ ID NO: 87178
  misc_feature: GYAE6OF02GZQM7.1.89.I01.1.454.CMB.1.raw
  modified_base (168)..(169): a, c, t, g, unknown or other
  misc_feature (168)..(169): n is a, c, g, or t

SEQ ID NO: 87305 - DNA, 190 bp, Homo sapiens
  misc_feature: GYAE6OF02JJ371.1.89.I01.1.454.CMB.1.raw
  modified_base (169)..(190): a, c, t, g, unknown or other
  misc_feature (169)..(190): n is a, c, g, or t
tcagacgagtgcgtcacgaccggtgctcgatttagtatgctagtatcgcggggtcttcggagctgggaccaaggtcaccgtcctaggtaagcccaaggccaaccccactgtcactctgttcccgccctcctcacgtctactgctgagcgggctgggcaaggcgcatagnnnnnnnnnnnnnnnnnnnnnn

SEQ ID NO: 87306 - DNA, 168 bp, Homo sapiens
  misc_feature: GYAE6OF02I0AYY.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctactgctagtcgagcgggctggcaaggcgcatagnn

SEQ ID NO: 87307 - DNA, 168 bp, Homo sapiens
  misc_feature: GYAE6OF02GR0CJ.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcgagtgcgtctctgagcgggctggcaaggcgcatagn

SEQ ID NO: 87308 - DNA, 170 bp, Homo sapiens
  misc_feature: GYAE6OF02IOHAC.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctccgtgtctgatctgagcgggctggcaaggcgcatagnnn

SEQ ID NO: 87309 - DNA, 172 bp, Homo sapiens; identical to SEQ ID NO: 86397
  misc_feature: GYAE6OF02G2OOT.1.89.I01.1.454.CMB.1.raw
  modified_base (169)..(172): a, c, t, g, unknown or other
  misc_feature (169)..(172): n is a, c, g, or t

SEQ ID NO: 87310 - DNA, 215 bp, Homo sapiens
  misc_feature: GYAE6OF02ITPDK.1.89.I01.1.454.CMB.1.raw
  modified_base (172)..(215): a, c, t, g, unknown or other
  misc_feature (172)..(215): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcacgtctgttcccaccctcctcatagccgtactctgagcgggctggcaaggcgcatagnnnnnnnnnnnnnnnnnnnnnnnnnnnnnnnnnnnnnnnnnnnn

SEQ ID NO: 87311 - DNA, 167 bp, Homo sapiens
  misc_feature: GYAE6OF02G88BM.1.89.I01.1.454.CMB.1.raw
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctagagacacgctgagcgggctggcaaggcgcatag

SEQ ID NO: 87312 - DNA, 168 bp, Homo sapiens
  misc_feature: GYAE6OF02IR9FK.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcacgtagcgtgctgagcgggctggcaaggcgcatagnn

SEQ ID NO: 87313 - DNA, 198 bp, Homo sapiens
  misc_feature: GYAE6OF02GR9WM.1.89.I01.1.454.CMB.1.raw
  modified_base (173)..(198): a, c, t, g, unknown or other
  misc_feature (173)..(198): n is a, c, g, or t
tcagacgagtgcgtcacgaccggtgctcgatttagtatgctagtatcgcggggggtggttcggcggagggaccaaactgaccgtcctaggtcagcccaaggctgccccctcggtcacctctgttcccgccctcctcgtgtcgagcgtctgagcgggctggcaaggcgcatagnnnnnnnnnnnnnnnnnnnnnnnnnn

SEQ ID NO: 87314 - DNA, 168 bp, Homo sapiens; identical to SEQ ID NO: 86287
  misc_feature: GYAE6OF02GITE9.1.89.I01.1.454.CMB.1.raw
  modified_base (168)..(168): a, c, t, g, unknown or other
  misc_feature (168)..(168): n is a, c, g, or t

SEQ ID NO: 87315 - DNA, 169 bp, Homo sapiens; identical to SEQ ID NO: 87300
  misc_feature: GYAE6OF02I40FH.1.89.I01.1.454.CMB.1.raw
  modified_base (168)..(169): a, c, t, g, unknown or other
  misc_feature (168)..(169): n is a, c, g, or t

SEQ ID NO: 87316 - DNA, 348 bp, Homo sapiens
  misc_feature: GYAE6OF02GRHE0.1.89.I01.1.454.CMB.1.raw
  modified_base (343)..(348): a, c, t, g, unknown or other
  misc_feature (343)..(348): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctgggggcacagcggccctgggctgcctggtcaaggactacttcctcgtagcactctgagcggctggcaaggcgcatagnnnnnn

SEQ ID NO: 87317 - DNA, 169 bp, Homo sapiens; identical to SEQ ID NO: 86265
  misc_feature: GYAE6OF02GKPKV.1.89.I01.1.454.CMB.1.raw
  modified_base (168)..(169): a, c, t, g, unknown or other
  misc_feature (168)..(169): n is a, c, g, or t

SEQ ID NO: 87318 - DNA, 222 bp, Homo sapiens
  misc_feature: GYAE6OF02I3OMF.1.89.I01.1.454.CMB.1.raw
  modified_base (190)..(222): a, c, t, g, unknown or other
  misc_feature (190)..(222): n is a, c, g, or t
tcagacgagtgcgtcacgaccggtgctcgatttagtatgctagtatgggagtgacagcctgagtgcccttatgtcttcggaactgggaccaaggtcaccgtcctaggtcagcccaaggccaaccccgactgtcactctgttcccgccctcctctctctcgactctgagcgggctaggcaaggcgcatagnnnnnnnnnnnnnnnnnnnnnnnnnnnnnnnnn

SEQ ID NO: 87319 - DNA, 171 bp, Homo sapiens
  misc_feature: GYAE6OF02GKWMF.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttccaccctcctcacgtctactgctgagcgggctggcaaggcgcatagnnnn

SEQ ID NO: 87320 - DNA, 170 bp, Homo sapiens
  misc_feature: GYAE6OF02HKDT8.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctcatagcgtactctgagcgggctggcaaggcgcatagnn

SEQ ID NO: 87321 - DNA, 170 bp, Homo sapiens
  misc_feature: GYAE6OF02HHAGT.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctgtcgagcgtctgagcgggctggcaaggcgcatagnnn

SEQ ID NO: 87322 - DNA, 167 bp, Homo sapiens
  misc_feature: GYAE6OF02HSQML.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccacctcctcacgtagcgtgctgagcgggctggcaaggcgcatagn

SEQ ID NO: 87323 - DNA, 168 bp, Homo sapiens; identical to SEQ ID NO: 86351
  misc_feature: GYAE6OF02GI0MH.1.89.I01.1.454.CMB.1.raw
  modified_base (168)..(168): a, c, t, g, unknown or other
  misc_feature (168)..(168): n is a, c, g, or t

SEQ ID NO: 87324 - DNA, 169 bp, Homo sapiens; identical to SEQ ID NO: 86276
  misc_feature: GYAE6OF02HA231.1.89.I01.1.454.CMB.1.raw
  modified_base (168)..(169): a, c, t, g, unknown or other
  misc_feature (168)..(169): n is a, c, g, or t

SEQ ID NO: 87325 - DNA, 187 bp, Homo sapiens; identical to SEQ ID NO: 86314
  misc_feature: GYAE6OF02GG85T.1.89.I01.1.454.CMB.1.raw
  modified_base (187)..(187): a, c, t, g, unknown or other
  misc_feature (187)..(187): n is a, c, g, or t

SEQ ID NO: 87326 - DNA, 168 bp, Homo sapiens; identical to SEQ ID NO: 86351
  misc_feature: GYAE6OF02GXOQ9.1.89.I01.1.454.CMB.1.raw
  modified_base (168)..(168): a, c, t, g, unknown or other
  misc_feature (168)..(168): n is a, c, g, or t

SEQ ID NO: 87327 - DNA, 216 bp, Homo sapiens
  misc_feature: GYAE6OF02HEKE5.1.89.I01.1.454.CMB.1.raw
  modified_base (56)..(56): a, c, t, g, unknown or other
  misc_feature (56)..(56): n is a, c, g, or t
  modified_base (165)..(216): a, c, t, g, unknown or other
  misc_feature (165)..(216): n is a, c, g, or t
tcagacgagtgcgtcacgaccggtgctcgatttagtatgctagtatcgcgggggtnttcggcggaggaccaactgaccgtcctaggtcagcccaaggctgcccctggtcactctgttcccacctcctctactgctagtctgagccggctggcaaggccgcatagnnnnnnnnnnnnnnnnnnnnnnnnnnnnnnnnnnnnnnnnnnnnnnnnnnnn

SEQ ID NO: 87328 - DNA, 168 bp, Homo sapiens; identical to SEQ ID NO: 86351
  misc_feature: GYAE6OF02GMK6O.1.89.I01.1.454.CMB.1.raw
  modified_base (168)..(168): a, c, t, g, unknown or other
  misc_feature (168)..(168): n is a, c, g, or t

SEQ ID NO: 87329 - DNA, 169 bp, Homo sapiens; identical to SEQ ID NO: 86276
  misc_feature: GYAE6OF02GRQL4.1.89.I01.1.454.CMB.1.raw
  modified_base (168)..(169): a, c, t, g, unknown or other
  misc_feature (168)..(169): n is a, c, g, or t

SEQ ID NO: 87330 - DNA, 191 bp, Homo sapiens
  misc_feature: GYAE6OF02FWC4Z.1.89.I01.1.454.CMB.1.raw
  modified_base (171)..(191): a, c, t, g, unknown or other
  misc_feature (171)..(191): n is a, c, g, or t
tcagacgagtgcgtcacgaccggtgctcgatttagtatgctagtatcgcggggggtgttcggcggagggaccaaactgaccgtcctaggtaaagcccaaggctgccccctcggtcactctgttcccaccctcctcacgtagcgtgctgagcgggctggcaaggcgcatagnnnnnnnnnnnnnnnnnnnnn

SEQ ID NO: 87331 - DNA, 169 bp, Homo sapiens; identical to SEQ ID NO: 86567
  misc_feature: GYAE6OF02I4Q64.1.89.I01.1.454.CMB.1.raw
  modified_base (169)..(169): a, c, t, g, unknown or other
  misc_feature (169)..(169): n is a, c, g, or t

SEQ ID NO: 87332 - DNA, 171 bp, Homo sapiens
  misc_feature: GYAE6OF02I80CR.1.89.I01.1.454.CMB.1.raw
  modified_base (167)..(171): a, c, t, g, unknown or other
  misc_feature (167)..(171): n is a, c, g, or t
tcagacgagtgcgtcacgaccggtgctcgatttagtatgctagtatcgcgggggtgttcggcggagggaccgaaactgaccgtcctaggtaagcccaaggctgcccctcggtcactctgttccacctcctcacgtagcgtgctgagcgggctggcaaggcgcatagnnnnn

SEQ ID NO: 87333 - DNA, 171 bp, Homo sapiens
  misc_feature: GYAE6OF02IYJ67.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctactgctagtctgagcgggctggcaaggcgcatagnnn

SEQ ID NO: 87334 - DNA, 171 bp, Homo sapiens
  misc_feature: GYAE6OF02GO3H4.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcatagcgtactctgagcgggctggcaaggcgcatagnnnn

SEQ ID NO: 87335 - DNA, 179 bp, Homo sapiens
  misc_feature: GYAE6OF02FE9VZ.1.89.I01.1.454.CMB.1.raw
  modified_base (170)..(179): a, c, t, g, unknown or other
  misc_feature (170)..(179): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttccaccctcctcgagtgcgtctctgagcgggctggcaaggcgcatagnnnnnnnnnn

SEQ ID NO: 87336 - DNA, 191 bp, Homo sapiens
  misc_feature: GYAE6OF02G7DG7.1.89.I01.1.454.CMB.1.raw
tcagacgagtgcgtcacgaccggtgctcgatttagtatgctagtaaggggaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatag

SEQ ID NO: 87337 - DNA, 170 bp, Homo sapiens; identical to SEQ ID NO: 86777
  misc_feature: GYAE6OF02JXIE7.1.89.I01.1.454.CMB.1.raw
  modified_base (169)..(170): a, c, t, g, unknown or other
  misc_feature (169)..(170): n is a, c, g, or t

SEQ ID NO: 87338 - DNA, 169 bp, Homo sapiens
  misc_feature: GYAE6OF02F2BQZ.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcatagcgtactctgagcgggctggcaaggcgcatagnn

SEQ ID NO: 87339 - DNA, 168 bp, Homo sapiens; identical to SEQ ID NO: 86282
  misc_feature: GYAE6OF02F498W.1.89.I01.1.454.CMB.1.raw
  modified_base (168)..(168): a, c, t, g, unknown or other
  misc_feature (168)..(168): n is a, c, g, or t

SEQ ID NO: 87340 - DNA, 170 bp, Homo sapiens; identical to SEQ ID NO: 86296
  misc_feature: GYAE6OF02F3YDU.1.89.I01.1.454.CMB.1.raw
  modified_base (169)..(170): a, c, t, g, unknown or other
  misc_feature (169)..(170): n is a, c, g, or t

SEQ ID NO: 87341 - DNA, 168 bp, Homo sapiens; identical to SEQ ID NO: 86287
  misc_feature: GYAE6OF02GNXCH.1.89.I01.1.454.CMB.1.raw
  modified_base (168)..(168): a, c, t, g, unknown or other
  misc_feature (168)..(168): n is a, c, g, or t

SEQ ID NO: 87342 - DNA, 170 bp, Homo sapiens; identical to SEQ ID NO: 87172
  misc_feature: GYAE6OF02JD92N.1.89.I01.1.454.CMB.1.raw
  modified_base (168)..(170): a, c, t, g, unknown or other
  misc_feature (168)..(170): n is a, c, g, or t

SEQ ID NO: 87343 - DNA, 170 bp, Homo sapiens; identical to SEQ ID NO: 86327
  misc_feature: GYAE6OF02HMYVI.1.89.I01.1.454.CMB.1.raw
  modified_base (169)..(170): a, c, t, g, unknown or other
  misc_feature (169)..(170): n is a, c, g, or t

SEQ ID NO: 87344 - DNA, 168 bp, Homo sapiens; identical to SEQ ID NO: 86778
  misc_feature: GYAE6OF02G0RD9.1.89.I01.1.454.CMB.1.raw

SEQ ID NO: 87345 - DNA, 175 bp, Homo sapiens
  misc_feature: GYAE6OF02F02M1.1.89.I01.1.454.CMB.1.raw
  modified_base (167)..(175): a, c, t, g, unknown or other
  misc_feature (167)..(175): n is a, c, g, or t
tcagacgagtgcgtcacgaccggtgctcgatttagtatgctagtatcgcggggtcttcggagctgggaccaaggtcaccgtcctaggtcagcccaaggccaaccccactgtcactctgttcccacctcctcacgtctactgctgagcgggctggcaaggcgcatagnnnnnnnnn

SEQ ID NO: 87346 - DNA, 191 bp, Homo sapiens
  misc_feature: GYAE6OF02F00WE.1.89.I01.1.454.CMB.1.raw
  modified_base (169)..(191): a, c, t, g, unknown or other
  misc_feature (169)..(191): n is a, c, g, or t
tcagacgagtgcgtcacgaccggtgctcgatttagtatgctagtatcggcgggggtgttcggcggagggaccaaactgaccgtcctaggtaagcccaaggctgcccctcggtcactctgttcccgccctcctcacgtagcgtgctgagcgggctggcaaggcgcatagnnnnnnnnnnnnnnnnnnnnnnn

SEQ ID NO: 87347 - DNA, 187 bp, Homo sapiens; identical to SEQ ID NO: 86384
  misc_feature: GYAE6OF02H0QCX.1.89.I01.1.454.CMB.1.raw
  modified_base (187)..(187): a, c, t, g, unknown or other
  misc_feature (187)..(187): n is a, c, g, or t

SEQ ID NO: 87348 - DNA, 185 bp, Homo sapiens
  misc_feature: GYAE6OF02GWSTY.1.89.I01.1.454.CMB.1.raw
  modified_base (171)..(185): a, c, t, g, unknown or other
  misc_feature (171)..(185): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccgccctcctcgagtgcgtctctgagcgggctggcaaggcgcatagnnnnnnnnnnnnnnn

SEQ ID NO: 87349 - DNA, 170 bp, Homo sapiens
  misc_feature: GYAE6OF02JCJKF.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcatagcgtactctgagcgggctggcaaggcgcatagnnn

SEQ ID NO: 87350 - DNA, 187 bp, Homo sapiens; identical to SEQ ID NO: 86314
  misc_feature: GYAE6OF02HXQN0.1.89.I01.1.454.CMB.1.raw
  modified_base (187)..(187): a, c, t, g, unknown or other
  misc_feature (187)..(187): n is a, c, g, or t

SEQ ID NO: 87351 - DNA, 166 bp, Homo sapiens
  misc_feature: GYAE6OF02FUPWY.1.89.I01.1.454.CMB.1.raw
  modified_base (165)..(166): a, c, t, g, unknown or other
  misc_feature (165)..(166): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccactcctcctacagtgctctgagcgggctggcaaggcgcatagnn

SEQ ID NO: 87352 - DNA, 167 bp, Homo sapiens
  misc_feature: GYAE6OF02GJHRM.1.89.I01.1.454.CMB.1.raw
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcatagcgtactctgagcgggctggcaaggcgcatag

SEQ ID NO: 87353 - DNA, 168 bp, Homo sapiens; identical to SEQ ID NO: 86581
  misc_feature: GYAE6OF02G1E2E.1.89.I01.1.454.CMB.1.raw
  modified_base (168)..(168): a, c, t, g, unknown or other
  misc_feature (168)..(168): n is a, c, g, or t

SEQ ID NO: 87354 - DNA, 168 bp, Homo sapiens
  misc_feature: GYAE6OF02IYXUH.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcacgtctactgctgagcgggctggcaaggcgcatagn

SEQ ID NO: 87355 - DNA, 169 bp, Homo sapiens; identical to SEQ ID NO: 86276
  misc_feature: GYAE6OF02J0Q8B.1.89.I01.1.454.CMB.1.raw
  modified_base (168)..(169): a, c, t, g, unknown or other
  misc_feature (168)..(169): n is a, c, g, or t

SEQ ID NO: 87356 - DNA, 170 bp, Homo sapiens; identical to SEQ ID NO: 86334
  misc_feature: GYAE6OF02GGLDR.1.89.I01.1.454.CMB.1.raw
  modified_base (169)..(170): a, c, t, g, unknown or other
  misc_feature (169)..(170): n is a, c, g, or t

SEQ ID NO: 87357 - DNA, 169 bp, Homo sapiens
  misc_feature: GYAE6OF02G2P8Z.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctcttcccgccctcctcatagcgtactctgagcgggctggcaaggcgcatagnn

SEQ ID NO: 87358 - DNA, 175 bp, Homo sapiens
  misc_feature: GYAE6OF02HC1BO.1.89.I01.1.454.CMB.1.raw
  modified_base (168)..(175): a, c, t, g, unknown or other
  misc_feature (168)..(175): n is a, c, g, or t
tcagacgagtgcgtcacgaccggtgctcgatttagtatgctagtatcggcggggtgttcggcggagggaccaaactgaccgtcctaggtcagcccaaggctgcccctcggtcactctgttcccaccctcctctactgctagtctgagcgggctggcaaggcgcatagnnnnnnnn

SEQ ID NO: 87359 - DNA, 172 bp, Homo sapiens
  misc_feature: GYAE6OF02I98W2.1.89.I01.1.454.CMB.1.raw
  modified_base (168)..(172): a, c, t, g, unknown or other
  misc_feature (168)..(172): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcacgtagcgtgctgagcgggctggcaaggcgcatagnnnnn

SEQ ID NO: 87360 - DNA, 171 bp, Homo sapiens; identical to SEQ ID NO: 87205
  misc_feature: GYAE6OF02I5DSN.1.89.I01.1.454.CMB.1.raw
  modified_base (168)..(171): a, c, t, g, unknown or other
  misc_feature (168)..(171): n is a, c, g, or t

SEQ ID NO: 87361 - DNA, 169 bp, Homo sapiens; identical to SEQ ID NO: 86409
  misc_feature: GYAE6OF02FG7SF.1.89.I01.1.454.CMB.1.raw
  modified_base (169)..(169): a, c, t, g, unknown or other
  misc_feature (169)..(169): n is a, c, g, or t

SEQ ID NO: 87362 - DNA, 167 bp, Homo sapiens
  misc_feature: GYAE6OF02HSJDX.1.89.I01.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtatgctagtatcgaggggtgttcggcggagggaccaaactgaccgtcctaggtcagcccaaggctgcccctcggtcactctgttcccaccctcctcacgtagcgtgctgagcgggctggcaaggcgcatagn

SEQ ID NO: 87363 - DNA, 169 bp, Homo sapiens; identical to SEQ ID NO: 86383
  misc_feature: GYAE6OF02HE30H.1.89.I01.1.454.CMB.1.raw
  modified_base (169)..(169): a, c, t, g, unknown or other
  misc_feature (169)..(169): n is a, c, g, or t

SEQ ID NO: 87364 - DNA, 169 bp, Homo sapiens; identical to SEQ ID NO: 87338
  misc_feature: GYAE6OF02I6NY9.1.89.I01.1.454.CMB.1.raw
  modified_base (168)..(169): a, c, t, g, unknown or other
  misc_feature (168)..(169): n is a, c, g, or t

SEQ ID NO: 87365 - DNA, 171 bp, Homo sapiens; identical to SEQ ID NO: 86493
  misc_feature: GYAE6OF02FU3L5.1.89.I01.1.454.CMB.1.raw
  modified_base (170)..(171): a, c, t, g, unknown or other
  misc_feature (170)..(171): n is a, c, g, or t

SEQ ID NO: 87366 - DNA, 168 bp, Homo sapiens; identical to SEQ ID NO: 86365
  misc_feature: GYAE6OF02JIYS1.1.89.I01.1.454.CMB.1.raw
  modified_base (168)..(168): a, c, t, g, unknown or other
  misc_feature (168)..(168): n is a, c, g, or t

SEQ ID NO: 87367 - DNA, 171 bp, Homo sapiens
  misc_feature: GYAE6OF02JOP8R.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctcgagtgcgtctctgagcgggctggcaaggcgcatagnnnn

SEQ ID NO: 87368 - DNA, 171 bp, Homo sapiens
  misc_feature: GYAE6OF02GJ72P.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcacgtagcgtgctgagcgggctggcaaggcgcatagnnnn

SEQ ID NO: 87369 - DNA, 170 bp, Homo sapiens
  misc_feature: GYAE6OF02FQANI.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctgtcgagcgtctgagcggctggacaaggcgcatagn

SEQ ID NO: 87370 - DNA, 171 bp, Homo sapiens; identical to SEQ ID NO: 86426
  misc_feature: GYAE6OF02GPBLN.1.89.I01.1.454.CMB.1.raw
  modified_base (170)..(171): a, c, t, g, unknown or other
  misc_feature (170)..(171): n is a, c, g, or t

SEQ ID NO: 87371 - DNA, 170 bp, Homo sapiens
  misc_feature: GYAE6OF02G4VIR.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctgtcgagcgtctgagcgggctggcaaggcgcatagnn

SEQ ID NO: 87372 - DNA, 169 bp, Homo sapiens
  misc_feature: GYAE6OF02H8HYS.1.89.I01.1.454.CMB.1.raw
  modified_base (167)..(169): a, c, t, g, unknown or other
  misc_feature (167)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttccgccctcctctgtcgagcgtctgagcgggctggcaaggcgcatagnnn

SEQ ID NO: 87373 - DNA, 170 bp, Homo sapiens
  misc_feature: GYAE6OF02F3SRM.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctcgtagcactctgagcgggctggcaaggcgcatagnnn

SEQ ID NO: 87374 - DNA, 179 bp, Homo sapiens
  misc_feature: GYAE6OF02G59LG.1.89.I01.1.454.CMB.1.raw
  modified_base (170)..(179): a, c, t, g, unknown or other
  misc_feature (170)..(179): n is a, c, g, or t
tcagacgagtgcgtcacgaccggtgctcgatttagtatgctagtagtcgcgggggtcttcggagctgggaccaaggtcaccgtcctaggtcagcccaaggccaaccccactgtcactctgttcccgccctcctcacgtctactgctgagcgggctggcaaggcgcatagnnnnnnnnnn

SEQ ID NO: 87375 - DNA, 171 bp, Homo sapiens
  misc_feature: GYAE6OF02JF8KG.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcatagcgtactctgagcgggctggcaaggcgcatagnnnn

SEQ ID NO: 87376 - DNA, 187 bp, Homo sapiens; identical to SEQ ID NO: 86314
  misc_feature: GYAE6OF02HZBAI.1.89.I01.1.454.CMB.1.raw
  modified_base (187)..(187): a, c, t, g, unknown or other
  misc_feature (187)..(187): n is a, c, g, or t

SEQ ID NO: 87377 - DNA, 169 bp, Homo sapiens
  misc_feature: GYAE6OF02I5XZY.1.89.I01.1.454.CMB.1.raw
  modified_base (165)..(169): a, c, t, g, unknown or other
  misc_feature (165)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttccacctcctctactgctagtctgagcggctggcaaggcgcatagnnnnn

SEQ ID NO: 87378 - DNA, 345 bp, Homo sapiens
  misc_feature: GYAE6OF02IOFA4.1.89.I01.1.454.CMB.1.raw
  modified_base (340)..(345): a, c, t, g, unknown or other
  misc_feature (340)..(345): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctcaccaagggcccatcggtcttccccctggcaccctcctccaagagcacctctggggcacagcggccctggctgcctggtcaaggctacttccgagtgcgtctctgagcgggctggcaaggcgcatagnnnnnn

SEQ ID NO: 87379 - DNA, 326 bp, Homo sapiens
  misc_feature: GYAE6OF02IB5DA.1.89.I01.1.454.CMB.1.raw
  modified_base (324)..(326): a, c, t, g, unknown or other
  misc_feature (324)..(326): n is a, c, g, or t
tcagacgagtgcgtcacgaccggtgctcgatttagtatgctagtatcgcgggctcctcattttgacaatgataaacgaccctcaggaatttctgaccgattctctggctccaagtctggcctgtcagcctccctgggcatcaccggactccaaactggggacgaggccgattattactgcgagacatgggatagtaacttgaatgttgggcgattcggcggagggaccaagttgaccgtcctaggtcagcccaaggccaacccactgtcactctgttcccgtcctcctcctcgtctctactgagcggctggcaaggcgcatagnnn

SEQ ID NO: 87380 - DNA, 168 bp, Homo sapiens; identical to SEQ ID NO: 87188
  misc_feature: GYAE6OF02HW72D.1.89.I01.1.454.CMB.1.raw
  modified_base (168)..(168): a, c, t, g, unknown or other
  misc_feature (168)..(168): n is a, c, g, or t

SEQ ID NO: 87381 - DNA, 170 bp, Homo sapiens; identical to SEQ ID NO: 86782
  misc_feature: GYAE6OF02H7F9R.1.89.I01.1.454.CMB.1.raw
  modified_base (169)..(170): a, c, t, g, unknown or other
  misc_feature (169)..(170): n is a, c, g, or t

SEQ ID NO: 87382 - DNA, 169 bp, Homo sapiens; identical to SEQ ID NO: 86276
  misc_feature: GYAE6OF02IZWU7.1.89.I01.1.454.CMB.1.raw
  modified_base (168)..(169): a, c, t, g, unknown or other
  misc_feature (168)..(169): n is a, c, g, or t

SEQ ID NO: 87383 - DNA, 179 bp, Homo sapiens
  misc_feature: GYAE6OF02GAS9P.1.89.I01.1.454.CMB.1.raw
  modified_base (168)..(179): a, c, t, g, unknown or other
  misc_feature (168)..(179): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgcatagnnnnnnnnnnnn

SEQ ID NO: 87384 - DNA, 244 bp, Homo sapiens
  misc_feature: GYAE6OF02GIKMK.1.89.I01.1.454.CMB.1.raw
  modified_base (173)..(177): a, c, t, g, unknown or other
  misc_feature (173)..(177): n is a, c, g, or t
  modified_base (179)..(244): a, c, t, g, unknown or other
  misc_feature (179)..(244): n is a, c, g, or t
tcagacgagtgcgtcacgaccggtgctcgatttagtatgctagtatcggcgggggggtgttcggcggagggccaaactgaccgtctaggtcagcccaaggctgcccccctcggtcactctggttcccaccctcctcgatagcgtactctgagcgggctggcaaggcgcatagnnnnncnnnnnnnnnnnnnnnnnnnnnnnnnnnnnnnnnnnnnnnnnnnnnnnnnnnnnnnnnnnnnnnnnn

SEQ ID NO: 87385 - DNA, 170 bp, Homo sapiens; identical to SEQ ID NO: 87349
  misc_feature: GYAE6OF02HPGEO.1.89.I01.1.454.CMB.1.raw
  modified_base (168)..(170): a, c, t, g, unknown or other
  misc_feature (168)..(170): n is a, c, g, or t

SEQ ID NO: 87386 - DNA, 174 bp, Homo sapiens
  misc_feature: GYAE6OF02GA3HG.1.89.I01.1.454.CMB.1.raw
  modified_base (169)..(174): a, c, t, g, unknown or other
  misc_feature (169)..(174): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagnnnnnn

SEQ ID NO: 87387 - DNA, 209 bp, Homo sapiens
  misc_feature: GYAE6OF02FZLAJ.1.89.I01.1.454.CMB.1.raw
  modified_base (182)..(182): a, c, t, g, unknown or other
  misc_feature (182)..(182): n is a, c, g, or t
  modified_base (187)..(209): a, c, t, g, unknown or other
  misc_feature (187)..(209): n is a, c, g, or t
tcagacgagtgcgtcacgaccggtgctcgatttagtatgctagtagtgggatgacagcctgagtgcccttatgtcttcggaactgggaccaaggtccaccgtcctaggtcagcccaaggccaaccccactgtcactctgttcccacccgtcctctctctcgactctgagcggctggcaggcncatgnnnnnnnnnnnnnnnnnnnnnnn

SEQ ID NO: 87388 - DNA, 169 bp, Homo sapiens
  misc_feature: GYAE6OF02I8Y8V.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctcacgtctactgctgagcgggctggcaaggcgcatagn

SEQ ID NO: 87389 - DNA, 190 bp, Homo sapiens; identical to SEQ ID NO: 86903
  misc_feature: GYAE6OF02JA3LW.1.89.I01.1.454.CMB.1.raw
  modified_base (187)..(190): a, c, t, g, unknown or other
  misc_feature (187)..(190): n is a, c, g, or t

SEQ ID NO: 87390 - DNA, 173 bp, Homo sapiens
  misc_feature: GYAE6OF02IMGA5.1.89.I01.1.454.CMB.1.raw
  modified_base (164)..(173): a, c, t, g, unknown or other
  misc_feature (164)..(173): n is a, c, g, or t
tcagacgagtgcgtcacgaccggtgctcgatttagtatgctagtatcgcgggggtgttcggcggagggaccgaacgtgaccgtcctaggtcagccaaggctgcccctcggtcactctgttccgcctctctactgctagtctgagcggctggcaaggcgcatagnnnnnnnnnn

SEQ ID NO: 87391 - DNA, 170 bp, Homo sapiens
  misc_feature: GYAE6OF02GU9SW.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctactgctagtctgagcgggctggcaaggcgcatagnn

SEQ ID NO: 87392 - DNA, 170 bp, Homo sapiens; identical to SEQ ID NO: 86485
  misc_feature: GYAE6OF02HVUZ4.1.89.I01.1.454.CMB.1.raw
  modified_base (168)..(170): a, c, t, g, unknown or other
  misc_feature (168)..(170): n is a, c, g, or t

SEQ ID NO: 87393 - DNA, 204 bp, Homo sapiens
  misc_feature: GYAE6OF02JLTSI.1.89.I01.1.454.CMB.1.raw
  modified_base (191)..(204): a, c, t, g, unknown or other
  misc_feature (191)..(204): n is a, c, g, or t
tcagacgagtgcgtcacgaccggtgctcgatttagtatgctagtaagggggaagacaatggagagctctcactgtggtggacgttcggccaagggaccaaggtggaaatcaaacgaactgtggctgcaccatctgtcttcatcttcccgcatctgaacgcactcgtctgagcgggctggcaaggcgcatgnnnnnnnnnnnnnn

SEQ ID NO: 87394 - DNA, 177 bp, Homo sapiens
  misc_feature: GYAE6OF02FO070.1.89.I01.1.454.CMB.1.raw
  modified_base (170)..(177): a, c, t, g, unknown or other
  misc_feature (170)..(177): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnnnnnn

SEQ ID NO: 87395 - DNA, 185 bp, Homo sapiens
  misc_feature: GYAE6OF02FE3ZY.1.89.I01.1.454.CMB.1.raw
  modified_base (166)..(185): a, c, t, g, unknown or other
  misc_feature (166)..(185): n is a, c, g, or t
tcagacgagtgcgtcacgaccggtgctcgatttagtatgctagtatcgcggggaatgttcggcgggggaccaagctgaccgtcttaggtcagcccaaggctgcccctggtcactctgttcccacctcctctgtcgagcgtctgagcgggctggcaaggcgcatagnnnnnnnnnnnnnnnnnnnn

SEQ ID NO: 87396 - DNA, 190 bp, Homo sapiens
  misc_feature: GYAE6OF02HMZR8.1.89.I01.1.454.CMB.1.raw
  modified_base (169)..(190): a, c, t, g, unknown or other
  misc_feature (169)..(190): n is a, c, g, or t
tcagacgagtgcgtcacgaccggtgctcgatttagtatgctagtatcgcgggggtgttcggcggagggaccaaactgaccgtcctaggtcagcccaaggcctgcccctcggtcactctgttcccaccctcctcacgtagcgtgctgagcgggctggcaaggcgcatagnnnnnnnnnnnnnnnnnnnnnn

SEQ ID NO: 87397 - DNA, 183 bp, Homo sapiens
  misc_feature: GYAE6OF02FYLLY.1.89.I01.1.454.CMB.1.raw
  modified_base (172)..(183): a, c, t, g, unknown or other
  misc_feature (172)..(183): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccacccttcctctcgtactgcgctgagcgggctggcaaggcgcatagnnnnnnnnnnnn

SEQ ID NO: 87398 - DNA, 168 bp, Homo sapiens; identical to SEQ ID NO: 86282
  misc_feature: GYAE6OF02JF869.1.89.I01.1.454.CMB.1.raw
  modified_base (168)..(168): a, c, t, g, unknown or other
  misc_feature (168)..(168): n is a, c, g, or t

SEQ ID NO: 87399 - DNA, 194 bp, Homo sapiens; identical to SEQ ID NO: 87187
  misc_feature: GYAE6OF02HSPOT.1.89.I01.1.454.CMB.1.raw
  modified_base (187)..(194): a, c, t, g, unknown or other
  misc_feature (187)..(194): n is a, c, g, or t

SEQ ID NO: 87400 - DNA, 170 bp, Homo sapiens
  misc_feature: GYAE6OF02JJRL9.1.89.I01.1.454.CMB.1.raw
  modified_base (166)..(170): a, c, t, g, unknown or other
  misc_feature (166)..(170): n is a, c, g, or t
tcagacgagtgcgtcacgaccggtgctcgatttagtatgctagtatcgcgggggtggttcggcggagggaccgaactgaccgtcctaggtcagccaaggctgcccctcggtcactctgttccgcctcctcatagcgtactctgagcgggctggcaaggcgcatagnnnnn

SEQ ID NO: 87401 - DNA, 169 bp, Homo sapiens; identical to SEQ ID NO: 86285
  misc_feature: GYAE6OF02FSURW.1.89.I01.1.454.CMB.1.raw
  modified_base (169)..(169): a, c, t, g, unknown or other
  misc_feature (169)..(169): n is a, c, g, or t

SEQ ID NO: 87402 - DNA, 171 bp, Homo sapiens
  misc_feature: GYAE6OF02JDGL0.1.89.I01.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccatctgaatagcgtactctgagcgggctggcaaggcgcatagnnnn

SEQ ID NO: 87403 - DNA, 169 bp, Homo sapiens; identical to SEQ ID NO: 86409
  misc_feature: GYAE6OF02FJ3FA.1.89.I01.1.454.CMB.1.raw
  modified_base (169)..(169): a, c, t, g, unknown or other
  misc_feature (169)..(169): n is a, c, g, or t

SEQ ID NO: 87404 - DNA, 173 bp, Homo sapiens
  misc_feature: GYAE6OF02HPMEX.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagnnnn

SEQ ID NO: 87405 - DNA, 347 bp, Homo sapiens
  misc_feature: GYAE6OF02GDU5B.1.89.I01.1.454.CMB.1.raw
  modified_base (339)..(347): a, c, t, g, unknown or other
  misc_feature (339)..(347): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtcttcccctggcaccctcctccaagagcacctctgggggcacagcggcctggctgcctggtcaaggctacttccgagtgcgtctctgagcgggctggcaaggcgcatagnnnnnnnnn

SEQ ID NO: 87406 - DNA, 168 bp, Homo sapiens; identical to SEQ ID NO: 86351
  misc_feature: GYAE6OF02G9MJC.1.89.I01.1.454.CMB.1.raw
  modified_base (168)..(168): a, c, t, g, unknown or other
  misc_feature (168)..(168): n is a, c, g, or t

SEQ ID NO: 87407 - DNA, 187 bp, Homo sapiens
  misc_feature: GYAE6OF02IDPJ9.1.89.I01.1.454.CMB.1.raw
  modified_base (186)..(187): a, c, t, g, unknown or other
  misc_feature (186)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaacccactgtcactctgttcccaccctcctctctctcgactctgagcgggctggcaaggcgcatagnn

SEQ ID NO: 87408 - DNA, 169 bp, Homo sapiens
  misc_feature: GYAE6OF02JMEVZ.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctgtcgagcgtctgagcgggctggcaaggcgcatagn

SEQ ID NO: 87409 - DNA, 190 bp, Homo sapiens
  misc_feature: GYAE6OF02H6Q71.1.89.I01.1.454.CMB.1.raw
  modified_base (173)..(190): a, c, t, g, unknown or other
  misc_feature (173)..(190): n is a, c, g, or t
tcagacgagtgcgtcacgaccggtgctcgattttagtatgctagtagtcgcggggggtgttcggcggagggaccaaactgaccgtcctaggtcagcccaaggcctgccccctcggtcactctgttcccaccctcctcatagcgtactctgagcgggctggcaaggcgcatagnnnnnnnnnnnnnnnnnn

SEQ ID NO: 87410 - DNA, 225 bp, Homo sapiens
  misc_feature: GYAE6OF02HEF7K.1.89.I01.1.454.CMB.1.raw
  modified_base (57)..(57): a, c, t, g, unknown or other
  misc_feature (57)..(57): n is a, c, g, or t
  modified_base (168)..(225): a, c, t, g, unknown or other
  misc_feature (168)..(225): n is a, c, g, or t
tcagacgagtgcgtcacgaccggtgctcgatttagtatgctagtatcgcggggggtnttcggcggagggaccaaactgaccgtcctaggtcagcccaaggctgcccctggtcactctgttcccgccctcctctactgctagtctgagcgggctggcaaggcgcatagnnnnnnnnnnnnnnnnnnnnnnnnnnnnnnnnnnnnnnnnnnnnnnnnnnnnnnnnnn

SEQ ID NO: 87411 - DNA, 261 bp, Homo sapiens
  misc_feature: GYAE6OF02HY96C.1.89.I01.1.454.CMB.1.raw
  modified_base (253)..(261): a, c, t, g, unknown or other
  misc_feature (253)..(261): n is a, c, g, or t
tcagacgagtgcgtcacgaccggtgctcgatttagtatgctagtatcgcggggacaaagctgccctgaccctctcgggtgcgcagcctgacgatgaggctgactattactgcttcccctcctggcacggtgctctgccggcgttcggcggagggaccaaggtgatcgtcctaagtcagcccaaggctgcccctggtcactctgttcccgcctcctcgacgcactcgtctgagcgggctggcaaggcgcatagnnnnnnnnn

SEQ ID NO: 87412 - DNA, 234 bp, Homo sapiens
  misc_feature: GYAE6OF02I54BP.1.89.I01.1.454.CMB.1.raw
  modified_base (228)..(234): a, c, t, g, unknown or other
  misc_feature (228)..(234): n is a, c, g, or t
tcagacgagtgcgtcacgaccggtgctcgatttagtatgctagtatcgcgggggcccaggcagatgatgagtctacttactattgtgtcctttacttgcgtgatggcatttggctgttcggcggagggaccaaagtgaccgtcctgggtcagcccaaggctcgcccctcggtcactctgttcccgcctcctctgtcgagcgtctgagcgggctggcaaggcgcatagnnnnnnn

SEQ ID NO: 87413 - DNA, 179 bp, Homo sapiens
  misc_feature: GYAE6OF02HXC40.1.89.I01.1.454.CMB.1.raw
  modified_base (170)..(179): a, c, t, g, unknown or other
  misc_feature (170)..(179): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctgtcgagcgtctgagcgggctggcaaggcgcatagnnnnnnnnnn

SEQ ID NO: 87414 - DNA, 206 bp, Homo sapiens
  misc_feature: GYAE6OF02G69Z7.1.89.I01.1.454.CMB.1.raw
  modified_base (57)..(57): a, c, t, g, unknown or other
  misc_feature (57)..(57): n is a, c, g, or t
  modified_base (166)..(206): a, c, t, g, unknown or other
  misc_feature (166)..(206): n is a, c, g, or t
tcagacgagtgcgtcacgaccggtgctcgatttagtatgctagtatcgcggggggtnttcggcggagggaccaaactgaccgtcctaggtcagcccaaggctgcccctcggtcactctgttcccgcctctctactgctagtctgagcggctggcaaggcgcatagnnnnnnnnnnnnnnnnnnnnnnnnnnnnnnnnnnnnnnnnn

SEQ ID NO: 87415 - DNA, 174 bp, Homo sapiens
  misc_feature: GYAE6OF02IZTR3.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcggggggtggttcggcggagggaccaaactgaccgtcctaggtcagcccaaggctgcccctcggtcactctgttcccaccctcctctgtcgagcgtctgagcgggctggcaaggcgcatagnnnnn

SEQ ID NO: 87416 - DNA, 187 bp, Homo sapiens
  misc_feature: GYAE6OF02H9Y2L.1.89.I01.1.454.CMB.1.raw
  modified_base (168)..(187): a, c, t, g, unknown or other
  misc_feature (168)..(187): n is a, c, g, or t
tcagacgagtgcgtcacgaccggtgctcgatttagtatgctagtatcgcgggggtgttcggcggagggacaaactgaccgtcctaggtcagcccaaggctgccccctcggtcactctgttcccgccctcctctactgctagtctgagcgggctggcaaggcgcatagnnnnnnnnnnnnnnnnnnnn

SEQ ID NO: 87417 - DNA, 168 bp, Homo sapiens
  misc_feature: GYAE6OF02I548S.1.89.I01.1.454.CMB.1.raw
tcagacgagtgcgtcacgaccggtgctcgatttagtatgctagtatcgcggggggtgttcagcggagggaccaaactgaccgtcctaggtcagcccaaggctgcccctcggtcactctgttcccaccctcctctagagacacgctgagcgggctggcaaggcgcatag

SEQ ID NO: 87418 - DNA, 170 bp, Homo sapiens; identical to SEQ ID NO: 86433
  misc_feature: GYAE6OF02GABL0.1.89.I01.1.454.CMB.1.raw
  modified_base (170)..(170): a, c, t, g, unknown or other
  misc_feature (170)..(170): n is a, c, g, or t

SEQ ID NO: 87419 - DNA, 173 bp, Homo sapiens
  misc_feature: GYAE6OF02HNU8Q.1.89.I01.1.454.CMB.1.raw
  modified_base (169)..(173): a, c, t, g, unknown or other
  misc_feature (169)..(173): n is a, c, g, or t
tcagacgagtgcgtcacgaccggtgctcgatttagtatgctagtatcggcgggggtgttcggcggagggaccaaactgaccgtcctaggtcagcccaaggctgcccctcggtcactctgttcccaccctcctctactgctagtctgagcgggctggcaaggcgcatagnnnnn

SEQ ID NO: 87420 - DNA, 214 bp, Homo sapiens
  misc_feature: GYAE6OF02HLTWS.1.89.I01.1.454.CMB.1.raw
  modified_base (172)..(214): a, c, t, g, unknown or other
  misc_feature (172)..(214): n is a, c, g, or t
tcagacgagtgcgtcacgaccggtgctcgatttagtatgctagtatcgcgggggtgttcggcgggagggaccaaactgaccgtcctaggtcagcccaaggctgccccctggtcactcgtgttcccgcctcctcacgtagcgtgctgagcgggctgggcaaggcgcagtacgnnnnnnnnnnnnnnnnnnnnnnnnnnnnnnnnnnnnnnnnnnn

SEQ ID NO: 87421 - DNA, 168 bp, Homo sapiens
  misc_feature: GYAE6OF02F3YV2.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctctgtcgagcgtctgagcgggctggcaaggcgcatagn

SEQ ID NO: 87422 - DNA, 167 bp, Homo sapiens
  misc_feature: GYAE6OF02H2RAP.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctactgctagtctgagcggctggcaaggcgcatag

SEQ ID NO: 87423 - DNA, 170 bp, Homo sapiens; identical to SEQ ID NO: 86381
  misc_feature: GYAE6OF02F50KT.1.89.I01.1.454.CMB.1.raw
  modified_base (170)..(170): a, c, t, g, unknown or other
  misc_feature (170)..(170): n is a, c, g, or t

SEQ ID NO: 87424 - DNA, 169 bp, Homo sapiens; identical to SEQ ID NO: 86275
  misc_feature: GYAE6OF02JOJSK.1.89.I01.1.454.CMB.1.raw
  modified_base (168)..(169): a, c, t, g, unknown or other
  misc_feature (168)..(169): n is a, c, g, or t

SEQ ID NO: 87425 - DNA, 169 bp, Homo sapiens
  misc_feature: GYAE6OF02FU6JI.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccaccctcctctcgtactgcgctgagcgggctggcaaggcgcatagnn

SEQ ID NO: 87426 - DNA, 170 bp, Homo sapiens; identical to SEQ ID NO: 86374
  misc_feature: GYAE6OF02GFUDO.1.89.I01.1.454.CMB.1.raw
  modified_base (169)..(170): a, c, t, g, unknown or other
  misc_feature (169)..(170): n is a, c, g, or t

SEQ ID NO: 87427 - DNA, 215 bp, Homo sapiens
  misc_feature: GYAE6OF02GIAGB.1.89.I01.1.454.CMB.1.raw
  modified_base (56)..(56): a, c, t, g, unknown or other
  misc_feature (56)..(56): n is a, c, g, or t
  modified_base (166)..(215): a, c, t, g, unknown or other
  misc_feature (166)..(215): n is a, c, g, or t
tcagacgagtgcgtcacgaccggtgctcgatttagtatgctagtatcgcgggggtnttcggcggagggaccaaactgaccgtcctaggtcagcccaaggctgcccctggtcactctgttcccacctcctcacgtctactgctgagcgggctggcaaggcgcatagnnnnnnnnnnnnnnnnnnnnnnnnnnnnnnnnnnnnnnnnnnnnnnnnnn

SEQ ID NO: 87428 - DNA, 265 bp, Homo sapiens
  misc_feature: GYAE6OF02IL9ST.1.89.I01.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (246)..(247): a, c, t, g, unknown or other
  misc_feature (246)..(247): n is a, c, g, or t
  modified_base (249)..(265): a, c, t, g, unknown or other
  misc_feature (249)..(265): n is a, c, g, or t
tcagacgagtgcgtcacgaccggtgctcgatttagtatgctagtatcgtcgggaccgatctctgggctccaggctgaggacgaggctggacttatttctgcagctcatatacaaccagcagcaccaaagtcttcggaactgggaccagggtcaccgtcctaggtcagcccaaggccaacccacctcgtcactctgttcccacctctcacgcactcgtctgancgggctggacaagggcnctatagnntnnnnnnnnnnnnnnnnn

SEQ ID NO: 87429 - DNA, 169 bp, Homo sapiens; identical to SEQ ID NO: 86383
  misc_feature: GYAE6OF02IEOMX.1.89.I01.1.454.CMB.1.raw
  modified_base (169)..(169): a, c, t, g, unknown or other
  misc_feature (169)..(169): n is a, c, g, or t

SEQ ID NO: 87430 - DNA, 172 bp, Homo sapiens
  misc_feature: GYAE6OF02HLHXT.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctcacgtagcgtgctgagcgggctggcaaggcgcatagnnnn

SEQ ID NO: 87431 - DNA, 169 bp, Homo sapiens; identical to SEQ ID NO: 86276
  misc_feature: GYAE6OF02F0EQI.1.89.I01.1.454.CMB.1.raw
  modified_base (168)..(169): a, c, t, g, unknown or other
  misc_feature (168)..(169): n is a, c, g, or t

SEQ ID NO: 87432 - DNA, 173 bp, Homo sapiens
  misc_feature: GYAE6OF02I61G5.1.89.I01.1.454.CMB.1.raw
  modified_base (168)..(173): a, c, t, g, unknown or other
  misc_feature (168)..(173): n is a, c, g, or t
tcagacgagtgcgtcacgaccggtgctcgatttagtatgctagtatcgcggggtcttcggagctgggaccaaggtcaccgtcctaggtcagcccaaggccaaccccactgtcactctgttcccaccctcctcacgtctactgctgagcgggctggcaaggcgcatagnnnnnn

SEQ ID NO: 87433 - DNA, 187 bp, Homo sapiens
  misc_feature: GYAE6OF02GM9KC.1.89.I01.1.454.CMB.1.raw
  modified_base (172)..(187): a, c, t, g, unknown or other
  misc_feature (172)..(187): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctggttcccaccctcctctactgctagtctgagcgggctggcaaggcgcatagnnnnnnnnnnnnnnnn

SEQ ID NO: 87434 - DNA, 183 bp, Homo sapiens
  misc_feature: GYAE6OF02JFC1I.1.89.I01.1.454.CMB.1.raw
  modified_base (170)..(183): a, c, t, g, unknown or other
  misc_feature (170)..(183): n is a, c, g, or t
tcagacgagtgcgtcacgaccggtgctcgatttagtatgctagtatcgcgggggggtgttcggcggagggaccaaactgaccgtcctaggtaagcccaaggctgcccctcggtcactctgttcccgccctcctcacgtagcgtgctgagcgggctggcaaggcgcatagnnnnnnnnnnnnnn

SEQ ID NO: 87435 - DNA, 169 bp, Homo sapiens; identical to SEQ ID NO: 86555
  misc_feature: GYAE6OF02HW1F5.1.89.I01.1.454.CMB.1.raw
  modified_base (169)..(169): a, c, t, g, unknown or other
  misc_feature (169)..(169): n is a, c, g, or t

SEQ ID NO: 87436 - DNA, 282 bp, Homo sapiens
  misc_feature: GYAE6OF02HBYI8.1.89.I01.1.454.CMB.1.raw
  modified_base (259)..(262): a, c, t, g, unknown or other
  misc_feature (259)..(262): n is a, c, g, or t
  modified_base (264)..(282): a, c, t, g, unknown or other
  misc_feature (264)..(282): n is a, c, g, or t
tcagacgagtgcgtcacgaccggtgctcgatttagtatgctagtagtcggcgggacaaagctgccctgaccctctcgggtgcgcagcctgacgatgacggctgactattactgcttcctctcctggcacggtgctcctgccggcgttcggcggagggaccaaggtgatcgtcctaagtccagcccaaggctgccccctggtcactctgttcccgccatctgaatagcgtactctgagtcgggctggcaaggcgcatagnnnngnnnnnnnnnnnnnnnnnnn

SEQ ID NO: 87437 - DNA, 169 bp, Homo sapiens
  misc_feature: GYAE6OF02G7HSE.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcttccgtgtctgatctgagcgggctggcaaggcgcatagn

SEQ ID NO: 87438 - DNA, 193 bp, Homo sapiens
  misc_feature: GYAE6OF02I3U47.1.89.I01.1.454.CMB.1.raw
  modified_base (192)..(193): a, c, t, g, unknown or other
  misc_feature (192)..(193): n is a, c, g, or t
tcagacgagtgcgtcacgaccggtgctcgatttagtatgctagtaagggtaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagnn

SEQ ID NO: 87439 - DNA, 169 bp, Homo sapiens; identical to SEQ ID NO: 86337
  misc_feature: GYAE6OF02FRZCO.1.89.I01.1.454.CMB.1.raw
  modified_base (168)..(169): a, c, t, g, unknown or other
  misc_feature (168)..(169): n is a, c, g, or t

SEQ ID NO: 87440 - DNA, 171 bp, Homo sapiens; identical to SEQ ID NO: 86392
  misc_feature: GYAE6OF02HXU0W.1.89.I01.1.454.CMB.1.raw
  modified_base (170)..(171): a, c, t, g, unknown or other
  misc_feature (170)..(171): n is a, c, g, or t

SEQ ID NO: 87441 - DNA, 190 bp, Homo sapiens; identical to SEQ ID NO: 86952
  misc_feature: GYAE6OF02IC85C.1.89.I01.1.454.CMB.1.raw
  modified_base (187)..(190): a, c, t, g, unknown or other
  misc_feature (187)..(190): n is a, c, g, or t

SEQ ID NO: 87442 - DNA, 170 bp, Homo sapiens
  misc_feature: GYAE6OF02G0WK7.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtaagcccaaggctgcccctcggtcactctgttcccgccctcctcacgtagcgtgctgagcgggctggcaaggcgcatagnn

SEQ ID NO: 87443 - DNA, 169 bp, Homo sapiens; identical to SEQ ID NO: 86346
  misc_feature: GYAE6OF02GB9NU.1.89.I01.1.454.CMB.1.raw
  modified_base (169)..(169): a, c, t, g, unknown or other
  misc_feature (169)..(169): n is a, c, g, or t

SEQ ID NO: 87444 - DNA, 220 bp, Homo sapiens
  misc_feature: GYAE6OF02HD6O0.1.89.I01.1.454.CMB.1.raw
  modified_base (218)..(220): a, c, t, g, unknown or other
  misc_feature (218)..(220): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgcccctcggtcactctgttcccaccctcctctagagacacgctgagcgggctggcaaggcgcatagnnn

SEQ ID NO: 87445 - DNA, 169 bp, Homo sapiens; identical to SEQ ID NO: 86420
  misc_feature: GYAE6OF02H0Z2P.1.89.I01.1.454.CMB.1.raw
  modified_base (169)..(169): a, c, t, g, unknown or other
  misc_feature (169)..(169): n is a, c, g, or t

SEQ ID NO: 87446 - DNA, 348 bp, Homo sapiens
  misc_feature: GYAE6OF02F9VOX.1.89.I01.1.454.CMB.1.raw
  modified_base (338)..(348): a, c, t, g, unknown or other
  misc_feature (338)..(348): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctccaccaagggcccatcggtcttcccctggcaccctcctccaagagcacctctggggcacagcggcctggctgcctggtcaaggctacttccgagtgcgtctctgagcgggctggcaaggcgcatagnnnnnnnnnnn

SEQ ID NO: 87447 - DNA, 168 bp, Homo sapiens
  misc_feature: GYAE6OF02H563R.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcatagcttactctgagcgggctggcaaggcgcatagn

SEQ ID NO: 87448 - DNA, 195 bp, Homo sapiens
  misc_feature: GYAE6OF02F0WPD.1.89.I01.1.454.CMB.1.raw
  modified_base (175)..(195): a, c, t, g, unknown or other
  misc_feature (175)..(195): n is a, c, g, or t
tcagacgagtgcgtcacgaccggtgctcgatttagtatgctagtagtcgcgggggtcttcggagctgggacctaaggtcaccgttcctaggtaagcccaaggccaaccccactgtcactctgttcccaccctcctcacgtctactgctgagcgggcttggcaaggcgctaatagnnnnnnnnnnnnnnnnnnnnn

SEQ ID NO: 87449 - DNA, 170 bp, Homo sapiens; identical to SEQ ID NO: 86304
  misc_feature: GYAE6OF02HGULD.1.89.I01.1.454.CMB.1.raw
  modified_base (168)..(170): a, c, t, g, unknown or other
  misc_feature (168)..(170): n is a, c, g, or t

SEQ ID NO: 87450 - DNA, 188 bp, Homo sapiens; identical to SEQ ID NO: 86724
  misc_feature: GYAE6OF02GFUFO.1.89.I01.1.454.CMB.1.raw
  modified_base (187)..(188): a, c, t, g, unknown or other
  misc_feature (187)..(188): n is a, c, g, or t

SEQ ID NO: 87451 - DNA, 171 bp, Homo sapiens; identical to SEQ ID NO: 86606
  misc_feature: GYAE6OF02HL337.1.89.I01.1.454.CMB.1.raw
  modified_base (170)..(171): a, c, t, g, unknown or other
  misc_feature (170)..(171): n is a, c, g, or t

SEQ ID NO: 87452 - DNA, 183 bp, Homo sapiens
  misc_feature: GYAE6OF02IMY1C.1.89.I01.1.454.CMB.1.raw
  modified_base (163)..(183): a, c, t, g, unknown or other
  misc_feature (163)..(183): n is a, c, g, or t
tcagacgagtgcgtcacgaccggtgctcgatttagtatgctagtatcgcgggggtgttcggcggagggaccaaactgaccgtcctaggtcagccaaggctgcccctcggtcactctgttccgcctctctactgctagtctgagcggctggcaaggcgcatagnnnnnnnnnnnnnnnnnnnnn

SEQ ID NO: 87453 - DNA, 177 bp, Homo sapiens
  misc_feature: GYAE6OF02JSFDF.1.89.I01.1.454.CMB.1.raw
  modified_base (167)..(177): a, c, t, g, unknown or other
  misc_feature (167)..(177): n is a, c, g, or t
tcagacgagtgcgtcacgaccggtgctcgatttagtatgctagtatcgcgggggtgttcggcggagggaccgaaactgaccgtcctaggtcagcccaaggctgcccctcggtcactctgttcccgcctcctctactgctagtctgagcggctggcaaggcgcatagnnnnnnnnnnn

SEQ ID NO: 87454 - DNA, 168 bp, Homo sapiens; identical to SEQ ID NO: 87307
  misc_feature: GYAE6OF02G78ZL.1.89.I01.1.454.CMB.1.raw
  modified_base (168)..(168): a, c, t, g, unknown or other
  misc_feature (168)..(168): n is a, c, g, or t

SEQ ID NO: 87455 - DNA, 170 bp, Homo sapiens; identical to SEQ ID NO: 86425
  misc_feature: GYAE6OF02FP4FO.1.89.I01.1.454.CMB.1.raw
  modified_base (170)..(170): a, c, t, g, unknown or other
  misc_feature (170)..(170): n is a, c, g, or t

SEQ ID NO: 87456 - DNA, 171 bp, Homo sapiens; identical to SEQ ID NO: 86606
  misc_feature: GYAE6OF02HBU0H.1.89.I01.1.454.CMB.1.raw
  modified_base (170)..(171): a, c, t, g, unknown or other
  misc_feature (170)..(171): n is a, c, g, or t

SEQ ID NO: 87457 - DNA, 172 bp, Homo sapiens
  misc_feature: GYAE6OF02I72EY.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctcgtactgcgctgagcgggctggcaaggcgcatagnnnn

SEQ ID NO: 87458 - DNA, 173 bp, Homo sapiens
  misc_feature: GYAE6OF02GZ0UL.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnn

SEQ ID NO: 87459 - DNA, 172 bp, Homo sapiens; identical to SEQ ID NO: 86659
  misc_feature: GYAE6OF02GD8S4.1.89.I01.1.454.CMB.1.raw
  modified_base (170)..(172): a, c, t, g, unknown or other
  misc_feature (170)..(172): n is a, c, g, or t

SEQ ID NO: 87460 - DNA, 198 bp, Homo sapiens
  misc_feature: GYAE6OF02J4PN8.1.89.I01.1.454.CMB.1.raw
  modified_base (188)..(188): a, c, t, g, unknown or other
  misc_feature (188)..(188): n is a, c, g, or t
  modified_base (192)..(198): a, c, t, g, unknown or other
  misc_feature (192)..(198): n is a, c, g, or t
tcagacgagtgcgtcacgaccggtgctcgatttagtatgctagtaagggagacaatggagagctctcactgtggtggacgttcggccaagggaccaaggtgaaatcaaacgactgtgctgcaccatctgtccttcactcctaccgcatctagaaccgctacgtcgtctgacgcggctggacaaggcanatgnnnnnnn

SEQ ID NO: 87461 - DNA, 170 bp, Homo sapiens
  misc_feature: GYAE6OF02IHWY7.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcgagtgcgtctctgagcgggctggcaaggcgcatagnn

SEQ ID NO: 87462 - DNA, 170 bp, Homo sapiens; identical to SEQ ID NO: 87320
  misc_feature: GYAE6OF02HLWDQ.1.89.I01.1.454.CMB.1.raw
  modified_base (169)..(170): a, c, t, g, unknown or other
  misc_feature (169)..(170): n is a, c, g, or t

SEQ ID NO: 87463 - DNA, 218 bp, Homo sapiens
  misc_feature: GYAE6OF02GJQEH.1.89.I01.1.454.CMB.1.raw
  modified_base (174)..(218): a, c, t, g, unknown or other
  misc_feature (174)..(218): n is a, c, g, or t
tcagacgagtgcgtcacgaccggtgctcgatttagtatgctagtatcggccgggggttgttccggcgtagggaccaaactgacccgtcctaggtcagccccaaggctgccccctggtcactctgttcccgccctcctcatagcgtactctgagcggctggcaaggcgcatagannnnnnnnnnnnnnnnnnnnnnnnnnnnnnnnnnnnnnnnnnnnn

SEQ ID NO: 87464 - DNA, 170 bp, Homo sapiens; identical to SEQ ID NO: 86362
  misc_feature: GYAE6OF02F2ZW4.1.89.I01.1.454.CMB.1.raw
  modified_base (169)..(170): a, c, t, g, unknown or other
  misc_feature (169)..(170): n is a, c, g, or t

SEQ ID NO: 87465 - DNA, 170 bp, Homo sapiens; identical to SEQ ID NO: 86461
  misc_feature: GYAE6OF02FRSLV.1.89.I01.1.454.CMB.1.raw
  modified_base (170)..(170): a, c, t, g, unknown or other
  misc_feature (170)..(170): n is a, c, g, or t

SEQ ID NO: 87466 - DNA, 168 bp, Homo sapiens
  misc_feature: GYAE6OF02I1A2Y.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggtgttcggcggagggaccaaactgaccgtcctaggtcagcccaaggctgcccctcggtcactctgttcccaccctcctcgagtgcgtctctgagcgggctggcaaggcgcatagnn

SEQ ID NO: 87467 - DNA, 214 bp, Homo sapiens
  misc_feature: GYAE6OF02GCXJU.1.89.I01.1.454.CMB.1.raw
  modified_base (175)..(214): a, c, t, g, unknown or other
  misc_feature (175)..(214): n is a, c, g, or t
tcagacgagtgcgtcacgaccggtgctcgatttagtatgctagtatcgcggggggtgttacgggcggagggaccaaactgaccgtcctaggtcagcccaaggctgcccccctggtcactctgttcccacccttcctcacgtctactgctgacgcgggctggcaaggcgacatagnnnnnnnnnnnnnnnnnnnnnnnnnnnnnnnnnnnnnnnn

SEQ ID NO: 87468 - DNA, 171 bp, Homo sapiens; identical to SEQ ID NO: 86391
  misc_feature: GYAE6OF02GA9RL.1.89.I01.1.454.CMB.1.raw
  modified_base (170)..(171): a, c, t, g, unknown or other
  misc_feature (170)..(171): n is a, c, g, or t

SEQ ID NO: 87469 - DNA, 170 bp, Homo sapiens
  misc_feature: GYAE6OF02HY2DO.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtcttcggagctgggaccaaggtcaccgtcctaggtaagcccaaggccaaccccactgtcactctgttcccgccctcctcacgtctactgctgagcgggctggcaaggcgcatagnn

SEQ ID NO: 87470 - DNA, 170 bp, Homo sapiens; identical to SEQ ID NO: 86580
  misc_feature: GYAE6OF02FI21V.1.89.I01.1.454.CMB.1.raw
  modified_base (170)..(170): a, c, t, g, unknown or other
  misc_feature (170)..(170): n is a, c, g, or t

SEQ ID NO: 87471 - DNA, 175 bp, Homo sapiens
  misc_feature: GYAE6OF02H40WH.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctcattagcgtactctgagcgggctggcaaggcgcatagnnnnnn

SEQ ID NO: 87472 - DNA, 170 bp, Homo sapiens; identical to SEQ ID NO: 86452
  misc_feature: GYAE6OF02HMH5Y.1.89.I01.1.454.CMB.1.raw
  modified_base (170)..(170): a, c, t, g, unknown or other
  misc_feature (170)..(170): n is a, c, g, or t

SEQ ID NO: 87473 - DNA, 180 bp, Homo sapiens
  misc_feature: GYAE6OF02J2RZF.1.89.I01.1.454.CMB.1.raw
  modified_base (170)..(180): a, c, t, g, unknown or other
  misc_feature (170)..(180): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnnnnnnnnn

SEQ ID NO: 87474 - DNA, 168 bp, Homo sapiens
  misc_feature: GYAE6OF02IA8RP.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcgggggtgttcggcggagggaccaaactgaccgtcctaggttagcccaaggctgcccctcggtcactctgttcccaccctcctcacgtagcgtctgagcgggctggcaaggcgcatagnn

SEQ ID NO: 87475 - DNA, 219 bp, Homo sapiens
  misc_feature: GYAE6OF02HVILV.1.89.I01.1.454.CMB.1.raw
  modified_base (56)..(56): a, c, t, g, unknown or other
  misc_feature (56)..(56): n is a, c, g, or t
  modified_base (159)..(159): a, c, t, g, unknown or other
  misc_feature (159)..(159): n is a, c, g, or t
  modified_base (165)..(219): a, c, t, g, unknown or other
  misc_feature (165)..(219): n is a, c, g, or t
tcagacgagtgcgtcacgaccggtgctcgatttagtatgctagtatcgcgggggtnttcggcggagggaccaaactgaccgtcctaggtcagcccaaggctgcccctggtcactctgttcccaccctctctactgctagtctgagcggctggcaaggcncatagnnnnnnnnnnnnnnnnnnnnnnnnnnnnnnnnnnnnnnnnnnnnnnnnnnnnnnn

SEQ ID NO: 87476 - DNA, 353 bp, Homo sapiens
  misc_feature: GYAE6OF02JBTMP.1.89.I01.1.454.CMB.1.raw
  modified_base (344)..(353): a, c, t, g, unknown or other
  misc_feature (344)..(353): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagacgcacctctgggggcacagcggccctgggctgcctggtcaaggctacttcctcgtagcactctgagcgggctggcaaggcgcatagnnnnnnnnnn

SEQ ID NO: 87477 - DNA, 205 bp, Homo sapiens
  misc_feature: GYAE6OF02GVSD9.1.89.I01.1.454.CMB.1.raw
  modified_base (184)..(205): a, c, t, g, unknown or other
  misc_feature (184)..(205): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccatgtcactctgttccccaccccctctctctcgactctgagcggcgtgcgagcgcatagnnnnnnnnnnnnnnnnnnnnnn

SEQ ID NO: 87478 - DNA, 175 bp, Homo sapiens
  misc_feature: GYAE6OF02FR2NU.1.89.I01.1.454.CMB.1.raw
  modified_base (169)..(175): a, c, t, g, unknown or other
  misc_feature (169)..(175): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagnnnnnnn

SEQ ID NO: 87479 - DNA, 174 bp, Homo sapiens
  misc_feature: GYAE6OF02IMYKE.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccacccctcctctactgctagtctgagcgggctggcaaggcgcatagnnnn

SEQ ID NO: 87480 - DNA, 172 bp, Homo sapiens
  misc_feature: GYAE6OF02FWMML.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctccgtgtctgatctgagcgggctggcaaggcgcatagnnn

SEQ ID NO: 87481 - DNA, 169 bp, Homo sapiens
  misc_feature: GYAE6OF02G23HA.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttccaaccctcctctactgctagtctgagcgggctggcaaggcgcatagn

SEQ ID NO: 87482 - DNA, 170 bp, Homo sapiens; identical to SEQ ID NO: 86304
  misc_feature: GYAE6OF02HYCWW.1.89.I01.1.454.CMB.1.raw
  modified_base (168)..(170): a, c, t, g, unknown or other
  misc_feature (168)..(170): n is a, c, g, or t

SEQ ID NO: 87483 - DNA, 168 bp, Homo sapiens; identical to SEQ ID NO: 86273
  misc_feature: GYAE6OF02GOB8Z.1.89.I01.1.454.CMB.1.raw
  modified_base (168)..(168): a, c, t, g, unknown or other
  misc_feature (168)..(168): n is a, c, g, or t

SEQ ID NO: 87484 - DNA, 352 bp, Homo sapiens
  misc_feature: GYAE6OF02G28D3.1.89.I01.1.454.CMB.1.raw
  modified_base (344)..(352): a, c, t, g, unknown or other
  misc_feature (344)..(352): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttcccctggccaccctcctccaagagcaccctctgggggcacgagcggccctgggctgcctggtcaggactacttccgagtgcgtctctgagcggctggcaaggcgcatagnnnnnnnnn

SEQ ID NO: 87485 - DNA, 172 bp, Homo sapiens
  misc_feature: GYAE6OF02HM55U.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcctacagtgctctgagcgggctggcaaggcgcatagnnnn

SEQ ID NO: 87486 - DNA, 226 bp, Homo sapiens
  misc_feature: GYAE6OF02JQXL0.1.89.I01.1.454.CMB.1.raw
  modified_base (167)..(226): a, c, t, g, unknown or other
  misc_feature (167)..(226): n is a, c, g, or t
tcagacgagtgcgtcacgaccggtgctcgatttagtatgctagtatcgcggggggtgttcggcggagggaccaaactgaccgtcctaggtcagcccaaggctgcccctggtcactctgttcccacctctctactgctagtctgagcgggctggcaaggcgcagtagnnnnnnnnnnnnnnnnnnnnnnnnnnnnnnnnnnnnnnnnnnnnnnnnnnnnnnnnnnnn

SEQ ID NO: 87487 - DNA, 170 bp, Homo sapiens; identical to SEQ ID NO: 86404
  misc_feature: GYAE6OF02FIDWJ.1.89.I01.1.454.CMB.1.raw
  modified_base (170)..(170): a, c, t, g, unknown or other
  misc_feature (170)..(170): n is a, c, g, or t

SEQ ID NO: 87488 - DNA, 171 bp, Homo sapiens; identical to SEQ ID NO: 86606
  misc_feature: GYAE6OF02FMEU7.1.89.I01.1.454.CMB.1.raw
  modified_base (170)..(171): a, c, t, g, unknown or other
  misc_feature (170)..(171): n is a, c, g, or t

SEQ ID NO: 87489 - DNA, 168 bp, Homo sapiens
  misc_feature: GYAE6OF02G6566.1.89.I01.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcctacagtgctctgagcgggctggcaaggcgcatagn

SEQ ID NO: 87490 - DNA, 172 bp, Homo sapiens
  misc_feature: GYAE6OF02I971O.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctgtcgagcgtctgagcgggctggcaaggcgcatagnnnn

SEQ ID NO: 87491 - DNA, 171 bp, Homo sapiens; identical to SEQ ID NO: 87333
  misc_feature: GYAE6OF02F7X7M.1.89.I01.1.454.CMB.1.raw
  modified_base (169)..(171): a, c, t, g, unknown or other
  misc_feature (169)..(171): n is a, c, g, or t

SEQ ID NO: 87492 - DNA, 170 bp, Homo sapiens; identical to SEQ ID NO: 86569
  misc_feature: GYAE6OF02FSNOX.1.89.I01.1.454.CMB.1.raw
  modified_base (170)..(170): a, c, t, g, unknown or other
  misc_feature (170)..(170): n is a, c, g, or t

SEQ ID NO: 87493 - DNA, 147 bp, Homo sapiens; identical to SEQ ID NO: 86290
  misc_feature: GYAE6OF02GL4GD.1.89.I01.1.454.CMB.1.raw
  modified_base (146)..(147): a, c, t, g, unknown or other
  misc_feature (146)..(147): n is a, c, g, or t

SEQ ID NO: 87494 - DNA, 171 bp, Homo sapiens
  misc_feature: GYAE6OF02FX60C.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctcacgcactcgtctgagcgggctggcaaggcgcatagnnn

SEQ ID NO: 87495 - DNA, 169 bp, Homo sapiens; identical to SEQ ID NO: 87220
  misc_feature: GYAE6OF02FNITQ.1.89.I01.1.454.CMB.1.raw
  modified_base (168)..(169): a, c, t, g, unknown or other
  misc_feature (168)..(169): n is a, c, g, or t

SEQ ID NO: 87496 - DNA, 170 bp, Homo sapiens; identical to SEQ ID NO: 86381
  misc_feature: GYAE6OF02FYT3C.1.89.I01.1.454.CMB.1.raw
  modified_base (170)..(170): a, c, t, g, unknown or other
  misc_feature (170)..(170): n is a, c, g, or t

SEQ ID NO: 87497 - DNA, 170 bp, Homo sapiens; identical to SEQ ID NO: 87308
  misc_feature: GYAE6OF02H8ETN.1.89.I01.1.454.CMB.1.raw
  modified_base (168)..(170): a, c, t, g, unknown or other
  misc_feature (168)..(170): n is a, c, g, or t

SEQ ID NO: 87498 - DNA, 192 bp, Homo sapiens
  misc_feature: GYAE6OF02HO9ZP.1.89.I01.1.454.CMB.1.raw
  modified_base (188)..(192): a, c, t, g, unknown or other
  misc_feature (188)..(192): n is a, c, g, or t
tcagacgagtgcgtcacgaccggtgctcgatttagtatgctagtatgggatgacagcctgagtgcccttatgtcttcggaactgggaccaaggtcaccgtcctaggtccagcccaaggccaaccccactgtcactctgttcccaccctcctctatgtatactctgagcgggctggcaaggcgcatagnnnnn

SEQ ID NO: 87499 - DNA, 170 bp, Homo sapiens; identical to SEQ ID NO: 86296
  misc_feature: GYAE6OF02GEMSN.1.89.I01.1.454.CMB.1.raw
  modified_base (169)..(170): a, c, t, g, unknown or other
  misc_feature (169)..(170): n is a, c, g, or t

SEQ ID NO: 87500 - DNA, 170 bp, Homo sapiens; identical to SEQ ID NO: 86433
  misc_feature: GYAE6OF02FN0YN.1.89.I01.1.454.CMB.1.raw
  modified_base (170)..(170): a, c, t, g, unknown or other
  misc_feature (170)..(170): n is a, c, g, or t

SEQ ID NO: 87501 - DNA, 166 bp, Homo sapiens
  misc_feature: GYAE6OF02I11H2.1.89.I01.1.454.CMB.1.raw
  modified_base (165)..(166): a, c, t, g, unknown or other
  misc_feature (165)..(166): n is a, c, g, or t
tcagacgagtgcgtcacgaccggtgctcgatttagtatgctagtatcgcgggtgttcggcggaggaccaaactgaccgtcctaggtcagcccaaggctgcccctcggtcactctgttcccgccctcctcatagcgtactctgagcgggctggcaaggcgcatagnn

SEQ ID NO: 87502 - DNA, 209 bp, Homo sapiens
  misc_feature: GYAE6OF02I115J.1.89.I01.1.454.CMB.1.raw
  modified_base (172)..(209): a, c, t, g, unknown or other
  misc_feature (172)..(209): n is a, c, g, or t
tcagacgagtgcgtcacgaccggtgctcgatttagtatgctagtatcgcgggggtcgttcggagctgggaccaaggtcaccgtcctaggtcagcccaaggccaaccccactgtccactctgttcccgccctcctcgacgtctactgctgagcgggctggcaaggcgcatagnnnnnnnnnnnnnnnnnnnnnnnnnnnnnnnnnnnnnn

SEQ ID NO: 87503 - DNA, 194 bp, Homo sapiens
  misc_feature: GYAE6OF02H8FL1.1.89.I01.1.454.CMB.1.raw
  modified_base (172)..(194): a, c, t, g, unknown or other
  misc_feature (172)..(194): n is a, c, g, or t
tcagacgagtgcgtcacgaccggtgctcgatttagtatgctagtatcgcggggggtgttcggcggagggaccaaacgtgaccgtcctaggtcagcccaaggctgccccctcggtcactctgttcccaccctcctctactgctagtctgagcgggcctggcaaggcgcatagnnnnnnnnnnnnnnnnnnnnnnn

SEQ ID NO: 87504 - DNA, 350 bp, Homo sapiens
  misc_feature: GYAE6OF02G2M7H.1.89.I01.1.454.CMB.1.raw
  modified_base (343)..(350): a, c, t, g, unknown or other
  misc_feature (343)..(350): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctgggggcacagcggccctggctgcctggtcaaggctacttccgagtcgcgtctctgagcgggctggcaaggcgcatagnnnnnnnn

SEQ ID NO: 87505 - DNA, 227 bp, Homo sapiens
  misc_feature: GYAE6OF02FUENL.1.89.I01.1.454.CMB.1.raw
  modified_base (225)..(227): a, c, t, g, unknown or other
  misc_feature (225)..(227): n is a, c, g, or t
tcagacgagtgcgtcacgaccggtgctcgatttagtatgctagtatcgcggggcccaggcagatgatgaatctaattattactgtttgctttattttgatagtggctgggtgttcggcggcgggaccaagctgaccgtcctaggtcagcccaaggctgtcccctcggtcactctgttcccaccctcctctacacgatcgctgagcgggctggcaaggcgcatagnnn

SEQ ID NO: 87506 - DNA, 170 bp, Homo sapiens; identical to SEQ ID NO: 86404
  misc_feature: GYAE6OF02IK0GB.1.89.I01.1.454.CMB.1.raw
  modified_base (170)..(170): a, c, t, g, unknown or other
  misc_feature (170)..(170): n is a, c, g, or t

SEQ ID NO: 87507 - DNA, 170 bp, Homo sapiens
  misc_feature: GYAE6OF02GR6V0.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctgtcgagcgtctgagcgggctggcaaggcgcatagnn

SEQ ID NO: 87508 - DNA, 170 bp, Homo sapiens; identical to SEQ ID NO: 86429
  misc_feature: GYAE6OF02IZBG4.1.89.I01.1.454.CMB.1.raw
  modified_base (170)..(170): a, c, t, g, unknown or other
  misc_feature (170)..(170): n is a, c, g, or t

SEQ ID NO: 87509 - DNA, 170 bp, Homo sapiens; identical to SEQ ID NO: 86433
  misc_feature: GYAE6OF02H8QU6.1.89.I01.1.454.CMB.1.raw
  modified_base (170)..(170): a, c, t, g, unknown or other
  misc_feature (170)..(170): n is a, c, g, or t

SEQ ID NO: 87510 - DNA, 338 bp, Homo sapiens
  misc_feature: GYAE6OF02JZVI7.1.89.I01.1.454.CMB.1.raw
  modified_base (326)..(338): a, c, t, g, unknown or other
  misc_feature (326)..(338): n is a, c, g, or t
tcagacgagtgcgtcacgaccggtgctcgatttagtatgctagtatcgcgggctcctcatttttgacaatgataaacgaccctcaggaatttctgaccgattctctggctccaagtctggcctgtcagcctccctgggcatcaccggactccaaactggggacgaggccgattattactgcgagacatgggatagtaacttgaatgttggcgattcggcggagggaccaagttgaccgtcctaggtcagcccaaggccaaccccactgtcactctgttccccgcctcctcctcgtctctactgagcgggctggcaaggcgcatagnnnnnnnnnnnnn

SEQ ID NO: 87511 - DNA, 170 bp, Homo sapiens
  misc_feature: GYAE6OF02IWTW8.1.89.I01.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttcccgccctcctcacgtagcgtgctgagcgggctggcaaggcgcatagnnn

SEQ ID NO: 87512 - DNA, 172 bp, Homo sapiens
  misc_feature: GYAE6OF02F880S.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagnnnn

SEQ ID NO: 87513 - DNA, 170 bp, Homo sapiens; identical to SEQ ID NO: 86381
  misc_feature: GYAE6OF02FLUYR.1.89.I01.1.454.CMB.1.raw
  modified_base (170)..(170): a, c, t, g, unknown or other
  misc_feature (170)..(170): n is a, c, g, or t

SEQ ID NO: 87514 - DNA, 174 bp, Homo sapiens
  misc_feature: GYAE6OF02JW2KX.1.89.I01.1.454.CMB.1.raw
  modified_base (165)..(174): a, c, t, g, unknown or other
  misc_feature (165)..(174): n is a, c, g, or t
tcagacgagtgcgtcacgaccggtgctcgatttagtatgctagtatcgcggggaatgttcggcggggaccaagctgaccgtcttaggtcagccaaggctgcccctcggtcactctgttcccgcctcctctgtcgagcgtctgagcgggctggcaaggcgcatagnnnnnnnnnn

SEQ ID NO: 87515 - DNA, 181 bp, Homo sapiens
  misc_feature: GYAE6OF02H3UFF.1.89.I01.1.454.CMB.1.raw
  modified_base (167)..(181): a, c, t, g, unknown or other
  misc_feature (167)..(181): n is a, c, g, or t
tcagacgagtgcgtcacgaccggtgctcgatttagtatgctagtatcgcgggggtgttcggcggagggaccaaactgaccgtcctaggtaagcccaaggctgccccctggtcactctgttcccgcctcctcacgtagcgtgctgagcgggctggcaaggcgcatagnnnnnnnnnnnnnnn

SEQ ID NO: 87516 - DNA, 167 bp, Homo sapiens; identical to SEQ ID NO: 87292
  misc_feature: GYAE6OF02HKJ38.1.89.I01.1.454.CMB.1.raw
  modified_base (167)..(167): a, c, t, g, unknown or other
  misc_feature (167)..(167): n is a, c, g, or t

SEQ ID NO: 87517 - DNA, 245 bp, Homo sapiens
  misc_feature: GYAE6OF02JCGY5.1.89.I01.1.454.CMB.1.raw
  modified_base (164)..(245): a, c, t, g, unknown or other
  misc_feature (164)..(245): n is a, c, g, or t
tcagacgagtgcgtcacgaccggtgctcgatttagtatgctagtatcgcggggtgttcggcggagggaccaaactgaccgtcctaggtcagcccaaggctgcccctggtcactctgttcccgcctcctctactgctagtctgagcggctggcaaggcgcatagnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 87518 - DNA, 171 bp, Homo sapiens
  misc_feature: GYAE6OF02H97J2.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccatcctcctctcgtagcactctgagcgggctggcaaggcgcatagnn

SEQ ID NO: 87519 - DNA, 289 bp, Homo sapiens
  misc_feature: GYAE6OF02FHH0L.1.89.I01.1.454.CMB.1.raw
  modified_base (286)..(289): a, c, t, g, unknown or other
  misc_feature (286)..(289): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctccaccaagggcccatcggtcttcccctggcaccctcctctctctcgactctgagcgggctggcaaggcgcatagnnnn

SEQ ID NO: 87520 - DNA, 215 bp, Homo sapiens
  misc_feature: GYAE6OF02GI36D.1.89.I01.1.454.CMB.1.raw
  modified_base (169)..(215): a, c, t, g, unknown or other
  misc_feature (169)..(215): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnnnnnnnnnnnnnnnnnnnnnnnnnnn

SEQ ID NO: 87521 - DNA, 170 bp, Homo sapiens; identical to SEQ ID NO: 86417
  misc_feature: GYAE6OF02IJRDA.1.89.I01.1.454.CMB.1.raw
  modified_base (170)..(170): a, c, t, g, unknown or other
  misc_feature (170)..(170): n is a, c, g, or t

SEQ ID NO: 87522 - DNA, 170 bp, Homo sapiens
  misc_feature: GYAE6OF02GSMAU.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctcacgtctactgctgagcgggctggcaaggcgcatagnn

SEQ ID NO: 87523 - DNA, 170 bp, Homo sapiens; identical to SEQ ID NO: 86389
  misc_feature: GYAE6OF02HPNZ2.1.89.I01.1.454.CMB.1.raw
  modified_base (169)..(170): a, c, t, g, unknown or other
  misc_feature (169)..(170): n is a, c, g, or t

SEQ ID NO: 87524 - DNA, 218 bp, Homo sapiens
  misc_feature: GYAE6OF02HCLEB.1.89.I01.1.454.CMB.1.raw
  modified_base (174)..(218): a, c, t, g, unknown or other
  misc_feature (174)..(218): n is a, c, g, or t
tcagacgagtgcgtcacgaccggtgctcgatttagtatgctagtatcggcggggggggtgttcggcggagggaccaaactgaccgtcctaggtcagcccaaggcctgccccctggtcactctgttcccaccctcctcatagcgtactctgagcgggctggcaaggcgcagtagnnnnnnnnnnnnnnnnnnnnnnnnnnnnnnnnnnnnnnnnnnnnn

SEQ ID NO: 87525 - DNA, 171 bp, Homo sapiens
  misc_feature: GYAE6OF02JQQUH.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctcatagcgtactctgagcgggctggcaaggcgcatagnnn

SEQ ID NO: 87526 - DNA, 171 bp, Homo sapiens; identical to SEQ ID NO: 86606
  misc_feature: GYAE6OF02GRZ7E.1.89.I01.1.454.CMB.1.raw
  modified_base (170)..(171): a, c, t, g, unknown or other
  misc_feature (170)..(171): n is a, c, g, or t

SEQ ID NO: 87527 - DNA, 171 bp, Homo sapiens
  misc_feature: GYAE6OF02G0K6J.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcgagtgcgtctctgagcgggctggcaaggcgcatagnn

SEQ ID NO: 87528 - DNA, 170 bp, Homo sapiens; identical to SEQ ID NO: 86531
  misc_feature: GYAE6OF02GW3QQ.1.89.I01.1.454.CMB.1.raw
  modified_base (170)..(170): a, c, t, g, unknown or other
  misc_feature (170)..(170): n is a, c, g, or t

SEQ ID NO: 87529 - DNA, 169 bp, Homo sapiens
  misc_feature: GYAE6OF02IIDUK.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccgccctcctccgtgtctgatctgagcgggctggcaaggcgcatagn

SEQ ID NO: 87530 - DNA, 170 bp, Homo sapiens; identical to SEQ ID NO: 87256
  misc_feature: GYAE6OF02G407O.1.89.I01.1.454.CMB.1.raw
  modified_base (168)..(170): a, c, t, g, unknown or other
  misc_feature (168)..(170): n is a, c, g, or t

SEQ ID NO: 87531 - DNA, 509 bp, Homo sapiens
  misc_feature: GYAE6OF02IAMXH.1.89.I01.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgttagcagctacttagcctggtaccaanagaacctggccaggctcccaggctcctcatctatgatacatccaacagggccactggcatcccagccaggttcagtggcagtgggtctgggacagacttcactctcacatcagcagcctagacgcctgaagtattttgctagtttattactgtcagcagtcgtagcaacgtcggcctctcctactttccggaccctcgggaccaagtgatataccgaacgtactggtgcgtgacacctatctgtcttcattcccg

SEQ ID NO: 87532 - DNA, 186 bp, Homo sapiens
  misc_feature: GYAE6OF02IACIX.1.89.I01.1.454.CMB.1.raw
  modified_base (169)..(186): a, c, t, g, unknown or other
  misc_feature (169)..(186): n is a, c, g, or t
tcagacgagtgcgtcacgaccggtgctcgatttagtatgctagtagtcgcggggggtgttcggcggagggaccaaactgaccgtcctaggtcagcccaaggctgcccctcggtaactctgttcccgcctcctcacgcactcgtctgagcgggctggcaaggcgcatagnnnnnnnnnnnnnnnnnn

SEQ ID NO: 87533 - DNA, 169 bp, Homo sapiens; identical to SEQ ID NO: 86275
  misc_feature: GYAE6OF02GIOTM.1.89.I01.1.454.CMB.1.raw
  modified_base (168)..(169): a, c, t, g, unknown or other
  misc_feature (168)..(169): n is a, c, g, or t

SEQ ID NO: 87534 - DNA, 173 bp, Homo sapiens; identical to SEQ ID NO: 86981
  misc_feature: GYAE6OF02G5CDJ.1.89.I01.1.454.CMB.1.raw
  modified_base (171)..(173): a, c, t, g, unknown or other
  misc_feature (171)..(173): n is a, c, g, or t

SEQ ID NO: 87535 - DNA, 170 bp, Homo sapiens
  misc_feature: GYAE6OF02G6XK0.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctcacgtagcgtgctgagcgggctggcaaggcgcatagnn

SEQ ID NO: 87536 - DNA, 189 bp, Homo sapiens
  misc_feature: GYAE6OF02IQO5A.1.89.I01.1.454.CMB.1.raw
  modified_base (186)..(189): a, c, t, g, unknown or other
  misc_feature (186)..(189): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagcggctggcaaggcgcatagnnnn

SEQ ID NO: 87537 - DNA, 171 bp, Homo sapiens; identical to SEQ ID NO: 86458
  misc_feature: GYAE6OF02HED13.1.89.I01.1.454.CMB.1.raw
  modified_base (169)..(171): a, c, t, g, unknown or other
  misc_feature (169)..(171): n is a, c, g, or t

SEQ ID NO: 87538 - DNA, 170 bp, Homo sapiens; identical to SEQ ID NO: 86404
  misc_feature: GYAE6OF02G2BBO.1.89.I01.1.454.CMB.1.raw
  modified_base (170)..(170): a, c, t, g, unknown or other
  misc_feature (170)..(170): n is a, c, g, or t

SEQ ID NO: 87539 - DNA, 169 bp, Homo sapiens
  misc_feature: GYAE6OF02HREIO.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctgtgagcgtctgagcgggctggcaaggcgcatagn

SEQ ID NO: 87540 - DNA, 356 bp, Homo sapiens
  misc_feature: GYAE6OF02G66MJ.1.89.I01.1.454.CMB.1.raw
  modified_base (238)..(238): a, c, t, g, unknown or other
  misc_feature (238)..(238): n is a, c, g, or t
  modified_base (346)..(356): a, c, t, g, unknown or other
  misc_feature (346)..(356): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctccaccaaggcccatcggtcttcccccnggccaccctcctccaagacgcacctcgtcgggggcacagccggccctgggctgcctggtcaaggctacttccgagtgcgtctctgagcgggctggcaaggcgcatagnnnnnnnnnnn

SEQ ID NO: 87541 - DNA, 170 bp, Homo sapiens
  misc_feature: GYAE6OF02FLLUG.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccatctgaatagcgtactctgagcgggctggcaaggcgcatagn

SEQ ID NO: 87542 - DNA, 222 bp, Homo sapiens
  misc_feature: GYAE6OF02GSS6E.1.89.I01.1.454.CMB.1.raw
  modified_base (56)..(56): a, c, t, g, unknown or other
  misc_feature (56)..(56): n is a, c, g, or t
  modified_base (166)..(222): a, c, t, g, unknown or other
  misc_feature (166)..(222): n is a, c, g, or t
tcagacgagtgcgtcacgaccggtgctcgatttagtatgctagtatcgcgggggtnttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 87543 - DNA, 172 bp, Homo sapiens; identical to SEQ ID NO: 86723
  misc_feature: GYAE6OF02GWJH2.1.89.I01.1.454.CMB.1.raw
  modified_base (171)..(172): a, c, t, g, unknown or other
  misc_feature (171)..(172): n is a, c, g, or t

SEQ ID NO: 87544 - DNA, 170 bp, Homo sapiens; identical to SEQ ID NO: 86433
  misc_feature: GYAE6OF02GMSXP.1.89.I01.1.454.CMB.1.raw
  modified_base (170)..(170): a, c, t, g, unknown or other
  misc_feature (170)..(170): n is a, c, g, or t

SEQ ID NO: 87545 - DNA, 210 bp, Homo sapiens
  misc_feature: GYAE6OF02FV3ZD.1.89.I01.1.454.CMB.1.raw
  modified_base (170)..(210): a, c, t, g, unknown or other
  misc_feature (170)..(210): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagnnnnnnnnnnnnnnnnnnnnnnnnnnnnnnnnnnnnnnnnn

SEQ ID NO: 87546 - DNA, 195 bp, Homo sapiens
  misc_feature: GYAE6OF02JEG13.1.89.I01.1.454.CMB.1.raw
  modified_base (174)..(174): a, c, t, g, unknown or other
  misc_feature (174)..(174): n is a, c, g, or t
  modified_base (176)..(195): a, c, t, g, unknown or other
  misc_feature (176)..(195): n is a, c, g, or t
tcagacgagtgcgtcacgaccggtgctcgatttagtatgctagtatcggtcggggggtgttcggcggagggaccaaactgaaccgtcctaggtcagcccaaggctgcccctcggtcactctagttcccgccctcctcattagcgtactctgagcgggctggcaaggcgcatagntnnnnnnnnnnnnnnnnnnnn

SEQ ID NO: 87547 - DNA, 171 bp, Homo sapiens; identical to SEQ ID NO: 86391
  misc_feature: GYAE6OF02GNVLJ.1.89.I01.1.454.CMB.1.raw
  modified_base (170)..(171): a, c, t, g, unknown or other
  misc_feature (170)..(171): n is a, c, g, or t

SEQ ID NO: 87548 - DNA, 170 bp, Homo sapiens; identical to SEQ ID NO: 86404
  misc_feature: GYAE6OF02F1E4U.1.89.I01.1.454.CMB.1.raw
  modified_base (170)..(170): a, c, t, g, unknown or other
  misc_feature (170)..(170): n is a, c, g, or t

SEQ ID NO: 87549 - DNA, 542 bp, Homo sapiens
  misc_feature: GYAE6OF02FSHU6.1.89.I01.1.454.CMB.1.raw
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
tcagacgagtgcgtcacgaccggtgctcgatttagtatgctagtaagtcgcgggggggtgttcggcggacgggaccaaactgaccggtcctaggtccagtcccaaggtctgcccctcggtcactctgttacccgccctctcgtactgcctagtctgtagcgggctggcgtaacggcgtcattagtngtncntgtcngtcactgtcgatcggncgtgtcncgctggactcgctgacgctcgtcngtnccgngcctgtacggacttccacgttcaatacctagcgtccttgctcgtgggtccncaacgtcnccgngtcgacgggccaagngtggcnggtctagtcttnatgtgngtgactatacactactcgcacgtcgtcgacgacgcgtactcnctctcncgacgacgactacgacgacgcgcgtcgtctactacgtagtagacgacgtacgtgacgacgtacgacgacgcgtcgtcgtctagtagtcgtgcgtacgacgtacgtacgtcgtacgtagtcgtacgtacgtacgtagtagtcg

SEQ ID NO: 87550 - DNA, 189 bp, Homo sapiens
  misc_feature: GYAE6OF02I36SN.1.89.I01.1.454.CMB.1.raw
  modified_base (181)..(189): a, c, t, g, unknown or other
  misc_feature (181)..(189): n is a, c, g, or t
tcagacgagtgcgtcacgaccggtgctcgatttagtatgctagtatgggatgacagcctgagtgccttatgtcttcggaactgggaccaaggtcacgtcctaggtcagccaaggccaacccactgtcactctgttccgccctcctctctctcgactctgagcggctggcaaggcgcatagnnnnnnnnn

SEQ ID NO: 87551 - DNA, 191 bp, Homo sapiens
  misc_feature: GYAE6OF02G9VZ0.1.89.I01.1.454.CMB.1.raw
  modified_base (186)..(191): a, c, t, g, unknown or other
  misc_feature (186)..(191): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcacctgttccgtccctcctctctctcgactctgagcgggcgtgcgagacgcatagnnnnnn

SEQ ID NO: 87552 - DNA, 169 bp, Homo sapiens
  misc_feature: GYAE6OF02F5SSJ.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctgtcgagcgtctgagcgggctggcaaggcgcatag

SEQ ID NO: 87553 - DNA, 187 bp, Homo sapiens; identical to SEQ ID NO: 86314
  misc_feature: GYAE6OF02FWES2.1.89.I01.1.454.CMB.1.raw
  modified_base (187)..(187): a, c, t, g, unknown or other
  misc_feature (187)..(187): n is a, c, g, or t

SEQ ID NO: 87554 - DNA, 188 bp, Homo sapiens; identical to SEQ ID NO: 86724
  misc_feature: GYAE6OF02FT3ZE.1.89.I01.1.454.CMB.1.raw
  modified_base (187)..(188): a, c, t, g, unknown or other
  misc_feature (187)..(188): n is a, c, g, or t

SEQ ID NO: 87555 - DNA, 195 bp, Homo sapiens
  misc_feature: GYAE6OF02G6WLO.1.89.I01.1.454.CMB.1.raw
  modified_base (192)..(195): a, c, t, g, unknown or other
  misc_feature (192)..(195): n is a, c, g, or t
tcagacgagtgcgtcacgaccggtgctcgatttagtatgctagtaaggggaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagnnnn

SEQ ID NO: 87556 - DNA, 205 bp, Homo sapiens
  misc_feature: GYAE6OF02FVAWW.1.89.I01.1.454.CMB.1.raw
  modified_base (169)..(205): a, c, t, g, unknown or other
  misc_feature (169)..(205): n is a, c, g, or t
tcagacgagtgcgtcacgaccggtgctcgatttagtatgctagtatcgcgggggtgttcggcggaggaccaaactgaccgtcctaggtccagcccaaggctgccccctcggtcactctgttcccaccctcctctactgctagtctgagcgggctggcaaggcgcatagnnnnnnnnnnnnnnnnnnnnnnnnnnnnnnnnnnnnn

SEQ ID NO: 87557 - DNA, 171 bp, Homo sapiens
  misc_feature: GYAE6OF02HQBVE.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctccgtgtctgatctgagcgggctggcaaggcgcatagnn

SEQ ID NO: 87558 - DNA, 342 bp, Homo sapiens
  misc_feature: GYAE6OF02IVUMW.1.89.I01.1.454.CMB.1.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (324)..(324): a, c, t, g, unknown or other
  misc_feature (324)..(324): n is a, c, g, or t
  modified_base (330)..(331): a, c, t, g, unknown or other
  misc_feature (330)..(331): n is a, c, g, or t
  modified_base (333)..(342): a, c, t, g, unknown or other
  misc_feature (333)..(342): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcgttggtccaggccggcgaggcatcaccggagcccagggcagggtcagcagtgctggccgtggggccctcctctcagccaggaccaaggacagcagcctcacaggccatcggctcccctgccacctctccagncacctcngggcacagcgcctggctgcctggtcaaggctacttccgagtgcgtctctgagcggctggcaagggcncatagnngnnnnnnnnnn

SEQ ID NO: 87559 - DNA, 169 bp, Homo sapiens
  misc_feature: GYAE6OF02HFM7K.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctcgtactgcgctgagcgggctggcaaggcgcatag

SEQ ID NO: 87560 - DNA, 171 bp, Homo sapiens
  misc_feature: GYAE6OF02HWNE1.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 87561 - DNA, 170 bp, Homo sapiens; identical to SEQ ID NO: 86381
  misc_feature: GYAE6OF02GDA16.1.89.I01.1.454.CMB.1.raw
  modified_base (170)..(170): a, c, t, g, unknown or other
  misc_feature (170)..(170): n is a, c, g, or t

SEQ ID NO: 87562 - DNA, 207 bp, Homo sapiens
  misc_feature: GYAE6OF02HS76G.1.89.I01.1.454.CMB.1.raw
  modified_base (174)..(207): a, c, t, g, unknown or other
  misc_feature (174)..(207): n is a, c, g, or t
tcagacgagtgcgtcacgaccggtgctcgatttagtatgctagtatcgggcgggggggtgttcggcggagggaccaaactgaccggtcctaggtcagcccaaggctggcccctcggtcactctgttcccgcctcctctactgctacgtctgagcgggctggcaaggcgcatagnnnnnnnnnnnnnnnnnnnnnnnnnnnnnnnnnn

SEQ ID NO: 87563 - DNA, 194 bp, Homo sapiens
  misc_feature: GYAE6OF02IEO20.1.89.I01.1.454.CMB.1.raw
  modified_base (188)..(194): a, c, t, g, unknown or other
  misc_feature (188)..(194): n is a, c, g, or t
tcagacgagtgcgtcacgaccggtgctcgatttagtatgctagtatgggagtgacagcctgagtgcccttatgtcttcggaactgggaccaaggtcaccgtcctaggtcagcccaaggccaaccccactgtcactctgttcccgccctcctctctctcgactctgagcgggctggcaaggcgcatagnnnnnnn

SEQ ID NO: 87564 - DNA, 232 bp, Homo sapiens
  misc_feature: GYAE6OF02HF0DH.1.89.I01.1.454.CMB.1.raw
  modified_base (172)..(176): a, c, t, g, unknown or other
  misc_feature (172)..(176): n is a, c, g, or t
  modified_base (178)..(232): a, c, t, g, unknown or other
  misc_feature (178)..(232): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccaccctcctcatagcgtactctgagcgggctggcaaggcgcatagnnnnncnnnnnnnnnnnnnnnnnnnnnnnnnnnnnnnnnnnnnnnnnnnnnnnnnnnnnnn

SEQ ID NO: 87565 - DNA, 173 bp, Homo sapiens
  misc_feature: GYAE6OF02I83L9.1.89.I01.1.454.CMB.1.raw
  modified_base (165)..(173): a, c, t, g, unknown or other
  misc_feature (165)..(173): n is a, c, g, or t
tcagacgagtgcgtcacgaccggtgctcgatttagtatgctagtatcgcggggtcttcggagctgggaccaaggtcaccgtcctaggtaagcccaaggccaacccactcgtcactctgttccgcctcctcacgtctactgctgagcggctggcaaggcgcatagnnnnnnnnn

SEQ ID NO: 87566 - DNA, 171 bp, Homo sapiens; identical to SEQ ID NO: 86695
  misc_feature: GYAE6OF02ILO3K.1.89.I01.1.454.CMB.1.raw
  modified_base (171)..(171): a, c, t, g, unknown or other
  misc_feature (171)..(171): n is a, c, g, or t

SEQ ID NO: 87567 - DNA, 170 bp, Homo sapiens
  misc_feature: GYAE6OF02HWKTL.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctactcacgtctactgctgagcgggctggcaaggcgcatagnn

SEQ ID NO: 87568 - DNA, 170 bp, Homo sapiens; identical to SEQ ID NO: 86433
  misc_feature: GYAE6OF02GQ3U0.1.89.I01.1.454.CMB.1.raw
  modified_base (170)..(170): a, c, t, g, unknown or other
  misc_feature (170)..(170): n is a, c, g, or t

SEQ ID NO: 87569 - DNA, 175 bp, Homo sapiens
  misc_feature: GYAE6OF02F2BZH.1.89.I01.1.454.CMB.1.raw
  modified_base (168)..(175): a, c, t, g, unknown or other
  misc_feature (168)..(175): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccacctcctcatagcgtactctgagcgggctggcaaggcgcatagnnnnnnnn

SEQ ID NO: 87570 - DNA, 262 bp, Homo sapiens
  misc_feature: GYAE6OF02H2IO2.1.89.I01.1.454.CMB.1.raw
  modified_base (240)..(240): a, c, t, g, unknown or other
  misc_feature (240)..(240): n is a, c, g, or t
  modified_base (242)..(262): a, c, t, g, unknown or other
  misc_feature (242)..(262): n is a, c, g, or t
tcagacgagtgcgtcacgaccggtgctcgatttagtatgctagtatcgcggggcccaggcagatgatgagtctacttactattgtgtccgtttacgttgcgtgaatgggcatttggcgttggttcggcggagggaccaaaggtgacccgtcctgggtcagccccaaggctggccccctggtcacgtctgttcccaccctcctctgtcgagcgtctggagcgggctggcaaggcgcatagntnnnnnnnnnnnnnnnnnnnnn

SEQ ID NO: 87571 - DNA, 209 bp, Homo sapiens
  misc_feature: GYAE6OF02HGRYG.1.89.I01.1.454.CMB.1.raw
  modified_base (174)..(209): a, c, t, g, unknown or other
  misc_feature (174)..(209): n is a, c, g, or t
tcagacgagtgcgtcacgaccggtgctcgatttagtatgctagtatcgcgggggggtgttcggcggagggaccaaactgaccgtcctagggtccagcccaaggcctgccccctcggtcactctgttcccgccctcctcacgtagcgtgctgagcgggctggcaaggcgcatagnnnnnnnnnnnnnnnnnnnnnnnnnnnnnnnnnnnn

SEQ ID NO: 87572 - DNA, 169 bp, Homo sapiens
  misc_feature: GYAE6OF02FHCLH.1.89.I01.1.454.CMB.1.raw
  modified_base (162)..(162): a, c, t, g, unknown or other
  misc_feature (162)..(162): n is a, c, g, or t
  modified_base (168)..(169): a, c, t, g, unknown or other
  misc_feature (168)..(169): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgcctcctcacgtctactgctgagcgggctggcaaggcncatagnn

SEQ ID NO: 87573 - DNA, 175 bp, Homo sapiens
  misc_feature: GYAE6OF02F9UV2.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnnnn

SEQ ID NO: 87574 - DNA, 167 bp, Homo sapiens
  misc_feature: GYAE6OF02J21P6.1.89.I01.1.454.CMB.1.raw
tcagacgagtgcgtcacgaccggtgctcgatttagtatgctagtatcgcgggggtcttcggagctgggaccaaggtcaccgtcctaggtcagcccaaggccaaccccactgtcactctgttcccacctcctcacgtctactgctgagcgggctggcaaggcgcatag

SEQ ID NO: 87575 - DNA, 220 bp, Homo sapiens
  misc_feature: GYAE6OF02G3R2H.1.89.I01.1.454.CMB.1.raw
  modified_base (57)..(57): a, c, t, g, unknown or other
  misc_feature (57)..(57): n is a, c, g, or t
  modified_base (167)..(220): a, c, t, g, unknown or other
  misc_feature (167)..(220): n is a, c, g, or t
tcagacgagtgcgtcacgaccggtgctcgatttagtatgctagtatcgcggggggtnttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnn

SEQ ID NO: 87576 - DNA, 193 bp, Homo sapiens
  misc_feature: GYAE6OF02I8V2F.1.89.I01.1.454.CMB.1.raw
  modified_base (170)..(193): a, c, t, g, unknown or other
  misc_feature (170)..(193): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnnnnnnnnnnnnnnnnnnnnnnn

SEQ ID NO: 87577 - DNA, 170 bp, Homo sapiens; identical to SEQ ID NO: 86497
  misc_feature: GYAE6OF02HERKZ.1.89.I01.1.454.CMB.1.raw
  modified_base (170)..(170): a, c, t, g, unknown or other
  misc_feature (170)..(170): n is a, c, g, or t

SEQ ID NO: 87578 - DNA, 169 bp, Homo sapiens
  misc_feature: GYAE6OF02GSCM1.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcacgcactcgtctgagcgggctggcaaggcgcatag

SEQ ID NO: 87579 - DNA, 170 bp, Homo sapiens; identical to SEQ ID NO: 86497
  misc_feature: GYAE6OF02IEBGT.1.89.I01.1.454.CMB.1.raw
  modified_base (170)..(170): a, c, t, g, unknown or other
  misc_feature (170)..(170): n is a, c, g, or t

SEQ ID NO: 87580 - DNA, 170 bp, Homo sapiens; identical to SEQ ID NO: 86417
  misc_feature: GYAE6OF02IBI9P.1.89.I01.1.454.CMB.1.raw
  modified_base (170)..(170): a, c, t, g, unknown or other
  misc_feature (170)..(170): n is a, c, g, or t

SEQ ID NO: 87581 - DNA, 171 bp, Homo sapiens; identical to SEQ ID NO: 86493
  misc_feature: GYAE6OF02GGC2U.1.89.I01.1.454.CMB.1.raw
  modified_base (170)..(171): a, c, t, g, unknown or other
  misc_feature (170)..(171): n is a, c, g, or t

SEQ ID NO: 87582 - DNA, 170 bp, Homo sapiens
  misc_feature: GYAE6OF02IBE0Y.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcgggggggtgttcggcggagggaccaaactgaccgtcctaggtcagcccaaggctgcccctcggtcactctgttcccgccctcctctcgtactgcgctgagcgggctggcaaggcgcatagn

SEQ ID NO: 87583 - DNA, 171 bp, Homo sapiens; identical to SEQ ID NO: 86706
  misc_feature: GYAE6OF02I0S19.1.89.I01.1.454.CMB.1.raw
  modified_base (171)..(171): a, c, t, g, unknown or other
  misc_feature (171)..(171): n is a, c, g, or t

SEQ ID NO: 87584 - DNA, 756 bp, Homo sapiens
  misc_feature: GYAE6OF02GW3V8.1.89.I01.1.454.CMB.1.raw
  modified_base (174)..(174): a, c, t, g, unknown or other
  misc_feature (174)..(174): n is a, c, g, or t
  modified_base (177)..(178): a, c, t, g, unknown or other
  misc_feature (177)..(178): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
tcagacgagtgcgtcacgaccggtgctcgatttagtatgctagtatcggcggggggtaggttcgcggaggccaaactgaccgtcctacggtcagcccaaggctcgacccctggtcactctgttcccacctctcgagttggcgtctctgagcgggctgggcaacggcgcagtagntgnntgcngncgagncancgcgtctgactcacctgtccncgcgactctcacgtcagacgtctacagtcgtagtcgccttagtcgagtaggtcgtacgacgtaacggaacccgtaagtaagtcgttacggtacggttcggacgtaggaccgtagggtacgtccgggacggtacgaccgtaccgttaaccgaacgtaacttacgtatttaacgtaccgtaacggttaacgttaacggttaacgttacggtttaacggttaacgggtaacgtccctaaaccggttaagtaccggtaaccggtaccgtacgtacggtaccggtaccggtaccggtaccggtaacgtaacggtaccgtaacgtacgttacgtacgtacgtacgtaacgtacggtacggtacgggttacggtacggtacggtacggtaacggtacgttacggttacgtttacgtttacgttacgttacgttacgttacgtacgtacgttaacgttaccgttaccgtacggttaacggttaccggttaccgttacggttacggtaccggtacggtaccggtaccggtacggtacggtaccgtacgtacg

SEQ ID NO: 87585 - DNA, 171 bp, Homo sapiens; identical to SEQ ID NO: 86493
  misc_feature: GYAE6OF02H9BZ1.1.89.I01.1.454.CMB.1.raw
  modified_base (170)..(171): a, c, t, g, unknown or other
  misc_feature (170)..(171): n is a, c, g, or t

SEQ ID NO: 87586 - DNA, 174 bp, Homo sapiens
  misc_feature: GYAE6OF02H8LHS.1.89.I01.1.454.CMB.1.raw
  modified_base (168)..(174): a, c, t, g, unknown or other
  misc_feature (168)..(174): n is a, c, g, or t
tcagacgagtgcgtcacgaccggtgctcgatttagtatgctagtatcgcggggggtgttcggcggaggaccaaactgaccgtcctaggtcagcccaaggctgcccctcggtcactctgttcccaccctcctcatagcgtactctgagcgggctggcaaggcgcatagnnnnnnn

SEQ ID NO: 87587 - DNA, 168 bp, Homo sapiens; identical to SEQ ID NO: 86325
  misc_feature: GYAE6OF02HA7IN.1.89.I01.1.454.CMB.1.raw
  modified_base (168)..(168): a, c, t, g, unknown or other
  misc_feature (168)..(168): n is a, c, g, or t

SEQ ID NO: 87588 - DNA, 171 bp, Homo sapiens
  misc_feature: GYAE6OF02HE2EI.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtaagcccaaggctgccccctcggtcactctgttcccaccctcctcacgtagcgtgctgagcgggctggcaaggcgcatagn

SEQ ID NO: 87589 - DNA, 174 bp, Homo sapiens
  misc_feature: GYAE6OF02IHWF3.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtagtcgcgggggggtgttcggcggagggaccaaactgaccgtcctaggtcagcccaaggctgcccctcggtcactctgttccgccctcctcatagcgtactctgagcgggctggcaaggcgcatagnnnnn

SEQ ID NO: 87590 - DNA, 172 bp, Homo sapiens; identical to SEQ ID NO: 86659
  misc_feature: GYAE6OF02IZGFJ.1.89.I01.1.454.CMB.1.raw
  modified_base (170)..(172): a, c, t, g, unknown or other
  misc_feature (170)..(172): n is a, c, g, or t

SEQ ID NO: 87591 - DNA, 171 bp, Homo sapiens; identical to SEQ ID NO: 86458
  misc_feature: GYAE6OF02HA8M4.1.89.I01.1.454.CMB.1.raw
  modified_base (169)..(171): a, c, t, g, unknown or other
  misc_feature (169)..(171): n is a, c, g, or t

SEQ ID NO: 87592 - DNA, 334 bp, Homo sapiens
  misc_feature: GYAE6OF02GSCL4.1.89.I01.1.454.CMB.1.raw
  modified_base (328)..(334): a, c, t, g, unknown or other
  misc_feature (328)..(334): n is a, c, g, or t
tcagacgagtgcgtcacgaccggtgctcgatttagtatgctagtatcgcgggctcctcatttttgacaatgataaacgaccctcaggaatttctgaccgattctctggctccaagtctggcctgtcagcctccctgggcatcaccggactccaaactggggacgaggccgattattactgcgagacatgggatagtaacttgaatgttgggcgattcggcggagggaccaagttgaccgtcctaggtcagcccaaggccaaccccactgtcactctgttccccacctcctcctcgtctctactgagtcgggctggcaaggcgcatagnnnnnnn

SEQ ID NO: 87593 - DNA, 177 bp, Homo sapiens
  misc_feature: GYAE6OF02JXLVU.1.89.I01.1.454.CMB.1.raw
  modified_base (166)..(177): a, c, t, g, unknown or other
  misc_feature (166)..(177): n is a, c, g, or t
tcagacgagtgcgtcacgaccggtgctcgatttagtatgctagtatcgcgggggtgttcggcggagggaccgaactgaccgtcctaggtcagccaaggctgcccctcggtcactctgttcccgccctcctctactgctagtctgagcggctggcaaggcgcatagnnnnnnnnnnnn

SEQ ID NO: 87594 - DNA, 170 bp, Homo sapiens; identical to SEQ ID NO: 86404
  misc_feature: GYAE6OF02F0JI5.1.89.I01.1.454.CMB.1.raw
  modified_base (170)..(170): a, c, t, g, unknown or other
  misc_feature (170)..(170): n is a, c, g, or t

SEQ ID NO: 87595 - DNA, 226 bp, Homo sapiens
  misc_feature: GYAE6OF02H2DP4.1.89.I01.1.454.CMB.1.raw
  modified_base (56)..(56): a, c, t, g, unknown or other
  misc_feature (56)..(56): n is a, c, g, or t
  modified_base (165)..(226): a, c, t, g, unknown or other
  misc_feature (165)..(226): n is a, c, g, or t
tcagacgagtgcgtcacgaccggtgctcgatttagtatgctagtatcgcgggggtnttcggcgagggaccaaactgaccgtcctaggtcagcccaaggctgcccctggtcactctgttcccgccctctctactgctagtctgagcgggctggcaaggcgcatagnnnnnnnnnnnnnnnnnnnnnnnnnnnnnnnnnnnnnnnnnnnnnnnnnnnnnnnnnnnnnn

SEQ ID NO: 87596 - DNA, 198 bp, Homo sapiens
  misc_feature: GYAE6OF02IHV31.1.89.I01.1.454.CMB.1.raw
  modified_base (175)..(175): a, c, t, g, unknown or other
  misc_feature (175)..(175): n is a, c, g, or t
  modified_base (178)..(182): a, c, t, g, unknown or other
  misc_feature (178)..(182): n is a, c, g, or t
  modified_base (184)..(198): a, c, t, g, unknown or other
  misc_feature (184)..(198): n is a, c, g, or t
tcagacgagtgcgtcacgaccggtgctcgatttagtatgctagtatcgcgggggtgttcggcggtagggaccgaaacgtgaccgtcctaggtcagcccaaggctgcccctcggtcgactctgttcccaccctcctcctactcgctacgtctgagcggctcgcaaggcgcgatagncgnnnnngnnnnnnnnnnnnnnn

SEQ ID NO: 87597 - DNA, 170 bp, Homo sapiens; identical to SEQ ID NO: 86466
  misc_feature: GYAE6OF02GGYAI.1.89.I01.1.454.CMB.1.raw
  modified_base (170)..(170): a, c, t, g, unknown or other
  misc_feature (170)..(170): n is a, c, g, or t

SEQ ID NO: 87598 - DNA, 228 bp, Homo sapiens
  misc_feature: GYAE6OF02H2AVG.1.89.I01.1.454.CMB.1.raw
  modified_base (168)..(228): a, c, t, g, unknown or other
  misc_feature (168)..(228): n is a, c, g, or t
tcagacgagtgcgtcacgaccggtgctcgatttagtatgctagtatcgcgggggggtgttcggcggagggaccaaactgaccgtcctaggtcagcccaaggctgcccctggtcactctgttcccaccctctctactcgctagtctgagcgggctggcaaggcgcatgnnnnnnnnnnnnnnnnnnnnnnnnnnnnnnnnnnnnnnnnnnnnnnnnnnnnnnnnnnnnn

SEQ ID NO: 87599 - DNA, 170 bp, Homo sapiens; identical to SEQ ID NO: 86425
  misc_feature: GYAE6OF02FF6LO.1.89.I01.1.454.CMB.1.raw
  modified_base (170)..(170): a, c, t, g, unknown or other
  misc_feature (170)..(170): n is a, c, g, or t

SEQ ID NO: 87600 - DNA, 191 bp, Homo sapiens
  misc_feature: GYAE6OF02JETTZ.1.89.I01.1.454.CMB.1.raw
  modified_base (187)..(191): a, c, t, g, unknown or other
  misc_feature (187)..(191): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagcgggctggcaaggcgcatagnnnnn

SEQ ID NO: 87601 - DNA, 172 bp, Homo sapiens
  misc_feature: GYAE6OF02INEZW.1.89.I01.1.454.CMB.1.raw
  modified_base (166)..(172): a, c, t, g, unknown or other
  misc_feature (166)..(172): n is a, c, g, or t
tcagacgagtgcgtcacgaccggtgctcgatttagtatgctagtatcgcgggggtgttcggcggagggaccaaactgaccgtcctaggtcagcccaaggctgcccctcggtcactctgttccgccctcctcatagcgtactctgagcggctggcaaggcgcatagnnnnnnn

SEQ ID NO: 87602 - DNA, 171 bp, Homo sapiens; identical to SEQ ID NO: 86493
  misc_feature: GYAE6OF02F2FCS.1.89.I01.1.454.CMB.1.raw
  modified_base (170)..(171): a, c, t, g, unknown or other
  misc_feature (170)..(171): n is a, c, g, or t

SEQ ID NO: 87603 - DNA, 172 bp, Homo sapiens; identical to SEQ ID NO: 86469
  misc_feature: GYAE6OF02JBC28.1.89.I01.1.454.CMB.1.raw
  modified_base (170)..(172): a, c, t, g, unknown or other
  misc_feature (170)..(172): n is a, c, g, or t

SEQ ID NO: 87604 - DNA, 176 bp, Homo sapiens
  misc_feature: GYAE6OF02GORD3.1.89.I01.1.454.CMB.1.raw
  modified_base (171)..(176): a, c, t, g, unknown or other
  misc_feature (171)..(176): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatagnnnnnn

SEQ ID NO: 87605 - DNA, 171 bp, Homo sapiens
  misc_feature: GYAE6OF02HG427.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcctacagtgctctgagcgggctggcaaggcgcatagnn

SEQ ID NO: 87606 - DNA, 169 bp, Homo sapiens
  misc_feature: GYAE6OF02IY0N1.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggaatgttcggcgggggaccaagctgaccgtcttaggtcagcccaaggctgcccctcggtcactctgttcccaccctcctctgtcgagcgtctgagcgggctggcaaggcgcatagn

SEQ ID NO: 87607 - DNA, 174 bp, Homo sapiens; identical to SEQ ID NO: 86524
  misc_feature: GYAE6OF02JLD6E.1.89.I01.1.454.CMB.1.raw
  modified_base (170)..(174): a, c, t, g, unknown or other
  misc_feature (170)..(174): n is a, c, g, or t

SEQ ID NO: 87608 - DNA, 209 bp, Homo sapiens
  misc_feature: GYAE6OF02IHI20.1.89.I01.1.454.CMB.1.raw
  modified_base (56)..(56): a, c, t, g, unknown or other
  misc_feature (56)..(56): n is a, c, g, or t
  modified_base (164)..(209): a, c, t, g, unknown or other
  misc_feature (164)..(209): n is a, c, g, or t
tcagacgagtgcgtcacgaccggtgctcgatttagtatgctagtatcgcgggggtnttcggcggagggaccaaactgaccgtcctaggtcagcccaaggctgcccctggtcactctgttcccacctctctactgctagtctgagcggctggcaaggcgcatagnnnnnnnnnnnnnnnnnnnnnnnnnnnnnnnnnnnnnnnnnnnnnn

SEQ ID NO: 87609 - DNA, 172 bp, Homo sapiens
  misc_feature: GYAE6OF02HG3XB.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctactgctagtctgagcgggctggcaaggcgcatagnn

SEQ ID NO: 87610 - DNA, 173 bp, Homo sapiens
  misc_feature: GYAE6OF02H36TG.1.89.I01.1.454.CMB.1.raw
  modified_base (169)..(173): a, c, t, g, unknown or other
  misc_feature (169)..(173): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctactgctagtctgagcgggctggcaaggcgcatagnnnnn

SEQ ID NO: 87611 - DNA, 171 bp, Homo sapiens
  misc_feature: GYAE6OF02HEJG1.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcgggatgggttttggcggagggaccaagctgaccgtcctaggtcagcccaaggctgcccctcggtcactctgttcccgccctcctcctacagtgctctgagcgggctggcaaggcgcatagnn

SEQ ID NO: 87612 - DNA, 168 bp, Homo sapiens
  misc_feature: GYAE6OF02H2OCW.1.89.I01.1.454.CMB.1.raw
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctcatagcgtactctgagcgggctggcaaggcgcatag

SEQ ID NO: 87613 - DNA, 180 bp, Homo sapiens
  misc_feature: GYAE6OF02GZS45.1.89.I01.1.454.CMB.1.raw
  modified_base (169)..(180): a, c, t, g, unknown or other
  misc_feature (169)..(180): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcgggctggcaaggcgcatagnnnnnnnnnnnn

SEQ ID NO: 87614 - DNA, 202 bp, Homo sapiens
  misc_feature: GYAE6OF02F8HA8.1.89.I01.1.454.CMB.1.raw
  modified_base (170)..(202): a, c, t, g, unknown or other
  misc_feature (170)..(202): n is a, c, g, or t
tcagacgagtgcgtcacgaccggtgctcgatttagtatgctagtatcgcggggggtgttcgggcggagggtaccaaactgaccgtcctaggtcagcccaaggctgccccctggtcactctggttcccacctcctcatagcgtactctgagcggctggcaaggcgcatagnnnnnnnnnnnnnnnnnnnnnnnnnnnnnnnnn

SEQ ID NO: 87615 - DNA, 170 bp, Homo sapiens; identical to SEQ ID NO: 86730
  misc_feature: GYAE6OF02ILMCZ.1.89.I01.1.454.CMB.1.raw
  modified_base (169)..(170): a, c, t, g, unknown or other
  misc_feature (169)..(170): n is a, c, g, or t

SEQ ID NO: 87616 - DNA, 180 bp, Homo sapiens
  misc_feature: GYAE6OF02IN757.1.89.I01.1.454.CMB.1.raw
  modified_base (173)..(180): a, c, t, g, unknown or other
  misc_feature (173)..(180): n is a, c, g, or t
tcagacgagtgcgtcacgaccggtgctcgatttagtatgctagtatcgcgggggggtgttcgggcggagggaccaaactgaccggtcctaggtcagcccaaggctgccccctcggtcactctgttcccaccctcctctactgctagtctgagcgggctggcaaggcgcatagnnnnnnnn

SEQ ID NO: 87617 - DNA, 230 bp, Homo sapiens
  misc_feature: GYAE6OF02H5VJ4.1.89.I01.1.454.CMB.1.raw
  modified_base (57)..(57): a, c, t, g, unknown or other
  misc_feature (57)..(57): n is a, c, g, or t
  modified_base (170)..(230): a, c, t, g, unknown or other
  misc_feature (170)..(230): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttcccgccctcctctactgctagtctgagcgggctgggcaaggcgcatagnnnnnnnnnnnnnnnnnnnnnnnnnnnnnnnnnnnnnnnnnnnnnnnnnnnnnnnnnnnnn

SEQ ID NO: 87618 - DNA, 171 bp, Homo sapiens; identical to SEQ ID NO: 87557
  misc_feature: GYAE6OF02JCEI6.1.89.I01.1.454.CMB.1.raw
  modified_base (170)..(171): a, c, t, g, unknown or other
  misc_feature (170)..(171): n is a, c, g, or t

SEQ ID NO: 87619 - DNA, 169 bp, Homo sapiens
  misc_feature: GYAE6OF02HY4YN.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctcgagtgcgtctctgagcgggctggcaaggcgcatagn

SEQ ID NO: 87620 - DNA, 558 bp, Homo sapiens
  misc_feature: GYAE6OF02HAITF.1.89.I01.1.454.CMB.1.raw
  modified_base (199)..(199): a, c, t, g, unknown or other
  misc_feature (199)..(199): n is a, c, g, or t
  modified_base (548)..(548): a, c, t, g, unknown or other
  misc_feature (548)..(548): n is a, c, g, or t
tcagacgagtgcgtcacgaccggtgctcgatttagtatgctagtatggggggaggaactgctcagttaggacccagagggaaccatggaagccccagctcagcttctcttcctcctgctactctggctcccagataccaccggagaaattgtgttgacacagtctccagcccaccctgtctttgtctccgaggggaaanagccaccctctcctgcagggccagtcagagtgttagcagctacttagcctggtaccaacagaaacctggccaggctcccaggctcctcatctatgatacatccaacagggccactggcactcccagccaggttcaggtggcagtgggtctgggacaggtacttcgactctcaccatcagcagcctagacgcctagaagtatttgacttagtttattactgttacagcagcgtagcaacgtggccctcgtcctaccgtttccggcccgttgggaacctaaaggtgaattacgtaccgaaacgtaacgttggtacggtcgtacgaccaccgtagttccttcgttccttacnctttaccccg

SEQ ID NO: 87621 - DNA, 169 bp, Homo sapiens
  misc_feature: GYAE6OF02HF522.1.89.I01.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctctgtcgagcgtcgagcgggctggcaaggcgcatagnn

SEQ ID NO: 87622 - DNA, 221 bp, Homo sapiens
  misc_feature: GYAE6OF02HPKGV.1.89.I01.1.454.CMB.1.raw
  modified_base (57)..(57): a, c, t, g, unknown or other
  misc_feature (57)..(57): n is a, c, g, or t
  modified_base (167)..(221): a, c, t, g, unknown or other
  misc_feature (167)..(221): n is a, c, g, or t
tcagacgagtgcgtcacgaccggtgctcgatttagtatgctagtatcgcggggggtnttcggcggagggaccaaactgaccgtcctaggtcagcccaaggctgcccctggtcactctgttcccgcctcctctactgctagtctgagcgggctggcaaggcgcatagnnnnnnnnnnnnnnnnnnnnnnnnnnnnnnnnnnnnnnnnnnnnnnnnnnnnnnn

SEQ ID NO: 87623 - DNA, 170 bp, Homo sapiens
  misc_feature: GYAE6OF02JTM13.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggaggaccaaactgaccgtcctaggtcagcccaaggctgccccctcggtcactctgttcccgccatctgaatagcgtactctgagcgggctggcaaggcgcatagnn

SEQ ID NO: 87624 - DNA, 174 bp, Homo sapiens; identical to SEQ ID NO: 86914
  misc_feature: GYAE6OF02IEU99.1.89.I01.1.454.CMB.1.raw
  modified_base (170)..(174): a, c, t, g, unknown or other
  misc_feature (170)..(174): n is a, c, g, or t

SEQ ID NO: 87625 - DNA, 211 bp, Homo sapiens
  misc_feature: GYAE6OF02HWKTA.1.89.I01.1.454.CMB.1.raw
  modified_base (172)..(211): a, c, t, g, unknown or other
  misc_feature (172)..(211): n is a, c, g, or t
tcagacgagtgcgtcacgaccggtgctcgatttagtatgctagtatcgcgggggggtgttcggcggagggaccaaactgaccgtcctagggtaagcccaaggctgccccctcggtcactctgttcccaccctcctcacgtagcgtgctgagcgggctggcaaggcgcatagnnnnnnnnnnnnnnnnnnnnnnnnnnnnnnnnnnnnnnnn

SEQ ID NO: 87626 - DNA, 171 bp, Homo sapiens; identical to SEQ ID NO: 86493
  misc_feature: GYAE6OF02HU9EV.1.89.I01.1.454.CMB.1.raw
  modified_base (170)..(171): a, c, t, g, unknown or other
  misc_feature (170)..(171): n is a, c, g, or t

SEQ ID NO: 87627 - DNA, 170 bp, Homo sapiens; identical to SEQ ID NO: 86404
  misc_feature: GYAE6OF02JCK01.1.89.I01.1.454.CMB.1.raw
  modified_base (170)..(170): a, c, t, g, unknown or other
  misc_feature (170)..(170): n is a, c, g, or t

SEQ ID NO: 87628 - DNA, 354 bp, Homo sapiens
  misc_feature: GYAE6OF02GORJ0.1.89.I01.1.454.CMB.1.raw
  modified_base (344)..(354): a, c, t, g, unknown or other
  misc_feature (344)..(354): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtctcccctggccaccctcctccaagagcacctctgggggcacgagcggccctgggctgcctggtcaaggctacttccgagtcgcgtctctgagcgggctggcaaggcgcatagnnnnnnnnnnn

SEQ ID NO: 87629 - DNA, 221 bp, Homo sapiens
  misc_feature: GYAE6OF02G77P3.1.89.I01.1.454.CMB.1.raw
  modified_base (219)..(221): a, c, t, g, unknown or other
  misc_feature (219)..(221): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccgccctcctctagagacacgctgagcgggctggcaaggcgcatagnnn

SEQ ID NO: 87630 - DNA, 172 bp, Homo sapiens; identical to SEQ ID NO: 86924
  misc_feature: GYAE6OF02FMO2M.1.89.I01.1.454.CMB.1.raw
  modified_base (171)..(172): a, c, t, g, unknown or other
  misc_feature (171)..(172): n is a, c, g, or t

SEQ ID NO: 87631 - DNA, 172 bp, Homo sapiens; identical to SEQ ID NO: 86909
  misc_feature: GYAE6OF02F7YCL.1.89.I01.1.454.CMB.1.raw
  modified_base (170)..(172): a, c, t, g, unknown or other
  misc_feature (170)..(172): n is a, c, g, or t

SEQ ID NO: 87632 - DNA, 176 bp, Homo sapiens
  misc_feature: GYAE6OF02G4WB9.1.89.I01.1.454.CMB.1.raw
  modified_base (170)..(176): a, c, t, g, unknown or other
  misc_feature (170)..(176): n is a, c, g, or t
tcagacgagtgcgtcacgaccggtgctcgatttagtatgctagtatcgcgggggtgttcgggcggagggaccgaaacgtgaccgtcctaggtcagccaaggctgcccctcggtcactctgttcccgccctcctctactcgctagtctgagcggctggcaaggcgcatagnnnnnnn

SEQ ID NO: 87633 - DNA, 170 bp, Homo sapiens; identical to SEQ ID NO: 87541
  misc_feature: GYAE6OF02F5TX4.1.89.I01.1.454.CMB.1.raw
  modified_base (170)..(170): a, c, t, g, unknown or other
  misc_feature (170)..(170): n is a, c, g, or t

SEQ ID NO: 87634 - DNA, 181 bp, Homo sapiens
  misc_feature: GYAE6OF02FWB4Q.1.89.I01.1.454.CMB.1.raw
  modified_base (170)..(181): a, c, t, g, unknown or other
  misc_feature (170)..(181): n is a, c, g, or t
tcagacgagtgcgtcacgaccggtgctcgatttagtatgctagtatcggcgggggggtgttcggcggagggaccaaactgaccgtcctaggtcagcccaaggctgccccctggtcactctgttcccacctcctcatagcgtactctgagcgggctggcaaggcgcatagnnnnnnnnnnnn

SEQ ID NO: 87635 - DNA, 255 bp, Homo sapiens
  misc_feature: GYAE6OF02JZSZ6.1.89.I01.1.454.CMB.1.raw
  modified_base (244)..(247): a, c, t, g, unknown or other
  misc_feature (244)..(247): n is a, c, g, or t
  modified_base (249)..(255): a, c, t, g, unknown or other
  misc_feature (249)..(255): n is a, c, g, or t
tcagacgagtgcgtcacgaccggtgctcgatttagtatgctagtatcgcgggacaagctgcctgacctctcggtgcgcagcctgacgatgaggctgactattactgcttcctctcctggcacggtgctctgccggcgttcggcggaggaccaaggtgatcgtcctaagtcagccaaggctgcccctggtcactctgttcccgccatctgaatgcgtactctgagcggctggcaaggcgcatagnnnngnnnnnnn

SEQ ID NO: 87636 - DNA, 171 bp, Homo sapiens; identical to SEQ ID NO: 86928
  misc_feature: GYAE6OF02FYXWD.1.89.I01.1.454.CMB.1.raw
  modified_base (171)..(171): a, c, t, g, unknown or other
  misc_feature (171)..(171): n is a, c, g, or t

SEQ ID NO: 87637 - DNA, 172 bp, Homo sapiens; identical to SEQ ID NO: 86659
  misc_feature: GYAE6OF02G9PA0.1.89.I01.1.454.CMB.1.raw
  modified_base (170)..(172): a, c, t, g, unknown or other
  misc_feature (170)..(172): n is a, c, g, or t

SEQ ID NO: 87638 - DNA, 171 bp, Homo sapiens
  misc_feature: GYAE6OF02J3HFO.1.89.I01.1.454.CMB.1.raw
  modified_base (167)..(171): a, c, t, g, unknown or other
  misc_feature (167)..(171): n is a, c, g, or t
tcagacgagtgcgtcacgaccggtgctcgatttagtatgctagtatcgcgggggtcttcggagctgggaccaaggtcaccgtcctaggtaagcccaaggccaaccccactgtcactctgttcccaccctctcacgtctactgctgagcggctggcaaggcgcatagnnnnn

SEQ ID NO: 87639 - DNA, 169 bp, Homo sapiens; identical to SEQ ID NO: 86276
  misc_feature: GYAE6OF02F7W1E.1.89.I01.1.454.CMB.1.raw
  modified_base (168)..(169): a, c, t, g, unknown or other
  misc_feature (168)..(169): n is a, c, g, or t

SEQ ID NO: 87640 - DNA, 170 bp, Homo sapiens; identical to SEQ ID NO: 86404
  misc_feature: GYAE6OF02G3ZSB.1.89.I01.1.454.CMB.1.raw
  modified_base (170)..(170): a, c, t, g, unknown or other
  misc_feature (170)..(170): n is a, c, g, or t

SEQ ID NO: 87641 - DNA, 494 bp, Homo sapiens
  misc_feature: GYAE6OF02HQAL5.1.89.I01.1.454.CMB.1.raw
  modified_base (223)..(223): a, c, t, g, unknown or other
  misc_feature (223)..(223): n is a, c, g, or t
  modified_base (427)..(427): a, c, t, g, unknown or other
  misc_feature (427)..(427): n is a, c, g, or t
tcagacgagtgcgtcacgaccggtgctcgatttagtatgctagtatcgcgggggggtctcaggaggcagcgctctcaggacatctccaccatggcctgggctctgctgctcctcaccctcctcactcagggcacagagtcctgggcccagtctgccctgactcagcctgcctccgtgtctgggtctcctggacagtcgatcaccatctcctgcactggaaccngcagtgacgttggtggttatgactatgtctcctggtaccaacatcacccaggcaaaggccccagactcatgatttatgaggtcagtcatcggcctcaggggtttctaatcgcttctctggctcaagtctggcaacacgctccctgaccatctctggcctccaggctgaggacgaggctgattattactgcagctcatatacaancagtagactcgtaggttttcggacgaacggaccaagctacgaccgtccgtaggtcacgccctaacgg

SEQ ID NO: 87642 - DNA, 171 bp, Homo sapiens; identical to SEQ ID NO: 86606
  misc_feature: GYAE6OF02FY30F.1.89.I01.1.454.CMB.1.raw
  modified_base (170)..(171): a, c, t, g, unknown or other
  misc_feature (170)..(171): n is a, c, g, or t

SEQ ID NO: 87643 - DNA, 187 bp, Homo sapiens
  misc_feature: GYAE6OF02H5SD3.1.89.I01.1.454.CMB.1.raw
  modified_base (187)..(187): a, c, t, g, unknown or other
  misc_feature (187)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctcacgtagcgtgctgagcgggctggcaaggcgcatagn

SEQ ID NO: 87644 - DNA, 170 bp, Homo sapiens
  misc_feature: GYAE6OF02HWI2X.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctactgctagtctgagcgggctggcaaggcgcatag

SEQ ID NO: 87645 - DNA, 225 bp, Homo sapiens
  misc_feature: GYAE6OF02HW6JH.1.89.I01.1.454.CMB.1.raw
  modified_base (57)..(57): a, c, t, g, unknown or other
  misc_feature (57)..(57): n is a, c, g, or t
  modified_base (169)..(225): a, c, t, g, unknown or other
  misc_feature (169)..(225): n is a, c, g, or t
tcagacgagtgcgtcacgaccggtgctcgatttagtatgctagtatcgcggggggtnttcggcggagggaccaaactgaccgtcctaggtcagcccaaggctgccccctggtcacctctgttcccacctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 87646 - DNA, 630 bp, Homo sapiens
  misc_feature: GYAE6OF02GDKD4.1.89.I01.1.454.CMB.1.raw
  modified_base (59)..(59): a, c, t, g, unknown or other
  misc_feature (59)..(59): n is a, c, g, or t
  modified_base (168)..(168): a, c, t, g, unknown or other
  misc_feature (168)..(168): n is a, c, g, or t
  modified_base (170)..(171): a, c, t, g, unknown or other
  misc_feature (170)..(171): n is a, c, g, or t
  modified_base (173)..(173): a, c, t, g, unknown or other
  misc_feature (173)..(173): n is a, c, g, or t
  modified_base (175)..(176): a, c, t, g, unknown or other
  misc_feature (175)..(176): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
tcagacgagtgcgtcacgaccggtgctcgatttagtatgctagtatcggcgggggggtnttcggcggaggccaaactgaccgtcctaggtcagcccaaggctgcccctggtcactctgttcccgcctcctctactgctagtctgagcgggctgggcaaggcgcatagntnncncnnctncnctgcgtntcgcgcngtcngcncgctgcgacngtcgactcgcgntacgctgtacnctnangcctgtcncgctacncgtnacgtcgacgtacgcgtacngtcgtactcgcgctacggntacgtacgtacctggtacgtaccgtancggtaacgtcgtaccgttagaccgtcgacgtaccggtgttacgccgtagggtttcaccgttaggaaccgtccgttagccttaacggtctacggacctgggaaccttagaccggtacttacgacccgtttgtacccggaatttccgggaaccctcgtaagggtctttaaccgggtaccgtacggtaccgtcgtacgtaccggtcgttaccggtaccgtacgtaccggtacggtacggtaccggtaacggttcggactacggtacgtacgttaccgcggttactaccggtacgtcgtaccgtacgtcg

SEQ ID NO: 87647 - DNA, 169 bp, Homo sapiens; identical to SEQ ID NO: 86275
  misc_feature: GYAE6OF02IF44J.1.89.I01.1.454.CMB.1.raw
  modified_base (168)..(169): a, c, t, g, unknown or other
  misc_feature (168)..(169): n is a, c, g, or t

SEQ ID NO: 87648 - DNA, 181 bp, Homo sapiens
  misc_feature: GYAE6OF02JY0GU.1.89.I01.1.454.CMB.1.raw
  modified_base (168)..(181): a, c, t, g, unknown or other
  misc_feature (168)..(181): n is a, c, g, or t
tcagacgagtgcgtcacgaccggtgctcgatttagtatgctagtatcgcgggggatgttcggcggagggaccaaactgaccgtcctaggtaagcccaaggctgcccctcggtcactctgttcccgcctcctcacgtagcgtgctgagcgggctggcaaggcgcatagnnnnnnnnnnnnnn

SEQ ID NO: 87649 - DNA, 171 bp, Homo sapiens; identical to SEQ ID NO: 86606
  misc_feature: GYAE6OF02IXG36.1.89.I01.1.454.CMB.1.raw
  modified_base (170)..(171): a, c, t, g, unknown or other
  misc_feature (170)..(171): n is a, c, g, or t

SEQ ID NO: 87650 - DNA, 170 bp, Homo sapiens
  misc_feature: GYAE6OF02HGVWW.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcgggggggtgttcggcggagggaccaaactgaacgtcctaggtcagcccaaggctgcccctcggtcactctgttcccaccctcctctactgctagtctgagcgggctggcaaggcgcatagn

SEQ ID NO: 87651 - DNA, 243 bp, Homo sapiens
  misc_feature: GYAE6OF02HBXMT.1.89.I01.1.454.CMB.1.raw
  modified_base (168)..(243): a, c, t, g, unknown or other
  misc_feature (168)..(243): n is a, c, g, or t
tcagacgagtgcgtcacgaccggtgctcgatttagtatgctagtatcgcggggggtgttcggcggagggaccaaactgaccgtcctaggtcagcccaaggctgcccctggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnnnnnnnn

SEQ ID NO: 87652 - DNA, 170 bp, Homo sapiens; identical to SEQ ID NO: 87391
  misc_feature: GYAE6OF02HPY2Q.1.89.I01.1.454.CMB.1.raw
  modified_base (169)..(170): a, c, t, g, unknown or other
  misc_feature (169)..(170): n is a, c, g, or t

SEQ ID NO: 87653 - DNA, 170 bp, Homo sapiens
  misc_feature: GYAE6OF02G8SQW.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctatacgatcgctgagcgggctggcaaggcgcatagn

SEQ ID NO: 87654 - DNA, 224 bp, Homo sapiens
  misc_feature: GYAE6OF02HW1VA.1.89.I01.1.454.CMB.1.raw
  modified_base (190)..(224): a, c, t, g, unknown or other
  misc_feature (190)..(224): n is a, c, g, or t
tcagacgagtgcgtcacgaccggtgctcgatttagtatgctagtatgggatgacagcctgagtgcccttatgtcttacggaactgggaccaaggtcaccgtcctaggtcagcccaaggccaaccccactgtcactctgtttcccaccctcctctctctcgactctgagccgggctggcaaggcgcatagnnnnnnnnnnnnnnnnnnnnnnnnnnnnnnnnnnn

SEQ ID NO: 87655 - DNA, 224 bp, Homo sapiens
  misc_feature: GYAE6OF02JV28H.1.89.I01.1.454.CMB.1.raw
  modified_base (131)..(131): a, c, t, g, unknown or other
  misc_feature (131)..(131): n is a, c, g, or t
  modified_base (194)..(194): a, c, t, g, unknown or other
  misc_feature (194)..(194): n is a, c, g, or t
  modified_base (196)..(197): a, c, t, g, unknown or other
  misc_feature (196)..(197): n is a, c, g, or t
  modified_base (199)..(199): a, c, t, g, unknown or other
  misc_feature (199)..(199): n is a, c, g, or t
  modified_base (203)..(224): a, c, t, g, unknown or other
  misc_feature (203)..(224): n is a, c, g, or t
tcagacgagtgcgtcacgaccggtgctcgatttagtatgctagtatcgcggggggtgttcggcggagggaccaaactgaccgtcctaggtcagcccaaggcttccgcccgtcgcaccctgttccgtacccncccgtctccgagtcgcgtcgtctcgagggccgtcggcgacggaacggccgacaagtgccgaangnngnagcnnnnnnnnnnnnnnnnnnnnnn

SEQ ID NO: 87656 - DNA, 171 bp, Homo sapiens; identical to SEQ ID NO: 86606
  misc_feature: GYAE6OF02HZYEK.1.89.I01.1.454.CMB.1.raw
  modified_base (170)..(171): a, c, t, g, unknown or other
  misc_feature (170)..(171): n is a, c, g, or t

SEQ ID NO: 87657 - DNA, 171 bp, Homo sapiens
  misc_feature: GYAE6OF02HYFHP.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcgagtgcgtctctgagcgggctggcaaggcgcatagn

SEQ ID NO: 87658 - DNA, 170 bp, Homo sapiens
  misc_feature: GYAE6OF02G0FVH.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatag

SEQ ID NO: 87659 - DNA, 172 bp, Homo sapiens
  misc_feature: GYAE6OF02JGY7B.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctctactgctagtctgagcgggctggcaaggcgcatagnnnn

SEQ ID NO: 87660 - DNA, 174 bp, Homo sapiens
  misc_feature: GYAE6OF02JWZN0.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccaccctcctcacgtagcgtgctgaggcgggctggcaaggcgcatagnnnnn

SEQ ID NO: 87661 - DNA, 497 bp, Homo sapiens
  misc_feature: GYAE6OF02I2K7B.1.89.I01.1.454.CMB.1.raw
tcagacgagtgcgtcacgaccggtgctcgatttagtatgctagtatcgcggggggggtctcaggaggcagcgctctcaggacatctccaccatggcctgggctctgctgctcctcaccctcctcactcagggcacagagtcctgggcccagtctgccctgactcagcctgcctccgtgtctgggtctcctggacagtcgatcaccatctcctgcactggaaccagcagtgacgttggtggttatgactatgtctcctggtaccaacatcacccaggcaaaggccccagactcatgatttatgaggtcagtcatcggccctcaggggtttctaatcgcttctctggctccaagtctggcaacacggcctccctgaccatctctggcctccaggctgaggacgaggctgattattactgcagctcatatacaagcagtagactctacggtttcggacgaagggaccaagctacgaccgtcctaggtcacgcccgaacgg

SEQ ID NO: 87662 - DNA, 173 bp, Homo sapiens
  misc_feature: GYAE6OF02F5AZP.1.89.I01.1.454.CMB.1.raw
  modified_base (169)..(173): a, c, t, g, unknown or other
  misc_feature (169)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctctcgtactgcgctgagcgggctggcaaggcgcatagnnnnn

SEQ ID NO: 87663 - DNA, 173 bp, Homo sapiens
  misc_feature: GYAE6OF02HX3VW.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgcccctcggtcactctgttccccgccctcctcatagcgtactctgagcgggctggcaaggcgcatagnnn

SEQ ID NO: 87664 - DNA, 223 bp, Homo sapiens
  misc_feature: GYAE6OF02F3OX8.1.89.I01.1.454.CMB.1.raw
  modified_base (56)..(56): a, c, t, g, unknown or other
  misc_feature (56)..(56): n is a, c, g, or t
  modified_base (162)..(223): a, c, t, g, unknown or other
  misc_feature (162)..(223): n is a, c, g, or t
tcagacgagtgcgtcacgaccggtgctcgatttagtatgctagtatcgcgggggtnttcggcggaggaccaaactgaccgtctaggtcagcccaaggctgcccctggtcactctgttcccacctctctactgctagtctgagcggctggcaaggcgcatagnnnnnnnnnnnnnnnnnnnnnnnnnnnnnnnnnnnnnnnnnnnnnnnnnnnnnnnnnnnnnn

SEQ ID NO: 87665 - DNA, 171 bp, Homo sapiens; identical to SEQ ID NO: 86695
  misc_feature: GYAE6OF02I172P.1.89.I01.1.454.CMB.1.raw
  modified_base (171)..(171): a, c, t, g, unknown or other
  misc_feature (171)..(171): n is a, c, g, or t

SEQ ID NO: 87666 - DNA, 170 bp, Homo sapiens; identical to SEQ ID NO: 86404
  misc_feature: GYAE6OF02H1ZF8.1.89.I01.1.454.CMB.1.raw
  modified_base (170)..(170): a, c, t, g, unknown or other
  misc_feature (170)..(170): n is a, c, g, or t

SEQ ID NO: 87667 - DNA, 185 bp, Homo sapiens
  misc_feature: GYAE6OF02HF7T9.1.89.I01.1.454.CMB.1.raw
  modified_base (170)..(172): a, c, t, g, unknown or other
  misc_feature (170)..(172): n is a, c, g, or t
  modified_base (174)..(185): a, c, t, g, unknown or other
  misc_feature (174)..(185): n is a, c, g, or t
tcagacgagtgcgtcacgaccggtgctcgatttagtatgctagtatcgcgggggtgttcggcggagggaccgaaacgtgaccgtcctaggtcagcccaaggctgcccctggtcacctcgtgttccacctctctactcgctacgtctgacgcggctggcaaggcgcatagnnntnnnnnnnnnnnn

SEQ ID NO: 87668 - DNA, 170 bp, Homo sapiens
  misc_feature: GYAE6OF02H3130.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggggtgttcggcggagggaccaaactgaccgtcctaggtcagcccaaggctgcccctcggtcactctgttcccaccctcctctactgctagtctgagcggctggcaaggcgcatagnn

SEQ ID NO: 87669 - DNA, 173 bp, Homo sapiens
  misc_feature: GYAE6OF02JFUWE.1.89.I01.1.454.CMB.1.raw
  modified_base (167)..(173): a, c, t, g, unknown or other
  misc_feature (167)..(173): n is a, c, g, or t
tcagacgagtgcgtcacgaccggtgctcgatttagtatgctagtatcgcgggggtgttcggcggagggaccaaacgtgaccgtcctaggtcagcccaaggctgcccctcggtcactctgttccaccctcctcacgcactcgtctgagcggctggcaaggcgcatagnnnnnnn

SEQ ID NO: 87670 - DNA, 170 bp, Homo sapiens; identical to SEQ ID NO: 86466
  misc_feature: GYAE6OF02GD5QK.1.89.I01.1.454.CMB.1.raw
  modified_base (170)..(170): a, c, t, g, unknown or other
  misc_feature (170)..(170): n is a, c, g, or t

SEQ ID NO: 87671 - DNA, 194 bp, Homo sapiens
  misc_feature: GYAE6OF02GBFAS.1.89.I01.1.454.CMB.1.raw
  modified_base (172)..(194): a, c, t, g, unknown or other
  misc_feature (172)..(194): n is a, c, g, or t
tcagacgagtgcgtcacgaccggtgctcgatttagtatgctagtatcgcgggggggtgttacggcggagggaccaaactgaccgtcctaggtcagcccaaggctgccccctcggtcactctgttcccgccctcctcatagcgtactctgagcgggctggcaaggcgcatagnnnnnnnnnnnnnnnnnnnnnnn

SEQ ID NO: 87672 - DNA, 238 bp, Homo sapiens
  misc_feature: GYAE6OF02G24SJ.1.89.I01.1.454.CMB.1.raw
  modified_base (58)..(58): a, c, t, g, unknown or other
  misc_feature (58)..(58): n is a, c, g, or t
  modified_base (169)..(238): a, c, t, g, unknown or other
  misc_feature (169)..(238): n is a, c, g, or t
tcagacgagtgcgtcacgaccggtgctcgatttagtatgctagtatcgcgggggggtnttcggcggagggaccaaactgaccgtcctaggtcagcccaaggctgcccctggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnn

SEQ ID NO: 87673 - DNA, 170 bp, Homo sapiens
  misc_feature: GYAE6OF02H0B2K.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcgggggggtgttcggcggagggaccaaactgaccgtcctaggtcagcccaaggctgcccctcggtcactctgttcccgccctcctctcgtagcactctgagcgggctggcaaggcgcatagn

SEQ ID NO: 87674 - DNA, 197 bp, Homo sapiens
  misc_feature: GYAE6OF02I93WK.1.89.I01.1.454.CMB.1.raw
  modified_base (169)..(197): a, c, t, g, unknown or other
  misc_feature (169)..(197): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcactctgttcccgccctcctcatagcgtactctgagcgggctggcaaggcgcatagnnnnnnnnnnnnnnnnnnnnnnnnnnnnn

SEQ ID NO: 87675 - DNA, 205 bp, Homo sapiens
  misc_feature: GYAE6OF02JGCSM.1.89.I01.1.454.CMB.1.raw
  modified_base (171)..(205): a, c, t, g, unknown or other
  misc_feature (171)..(205): n is a, c, g, or t
tcagacgagtgcgtcacgaccggtgctcgatttagtatgctagtatcggcggggggtgttcggcggagggaccaaactgaccgtcctaggtcagcccaaggctgcccctcggtcactctgttcccaccctccgtcatagcgtactctgagcgggctggcaaggcgcatagnnnnnnnnnnnnnnnnnnnnnnnnnnnnnnnnnnn

SEQ ID NO: 87676 - DNA, 352 bp, Homo sapiens
  misc_feature: GYAE6OF02FOMVB.1.89.I01.1.454.CMB.1.raw
  modified_base (341)..(352): a, c, t, g, unknown or other
  misc_feature (341)..(352): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttcccctggcaccctcctccaagagcacctctggggacacagcggccctgggctgcctggtcaaggctactccgagtgcgtctctgagcgggctggcaaggcgcatagnnnnnnnnnnnn

SEQ ID NO: 87677 - DNA, 622 bp, Homo sapiens
  misc_feature: GYAE6OF02HGUVL.1.89.I01.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
tcagacgagtgcgtcacgaccggtgctcgatttagtatgctagtaagtacggcggggggtgttcggcggaggggaccaaaccttgaccccggtcctacggtacgacgtcccaaggtcgtgcccctcggtcactctggttcccgccctcctcagtacgcgtacctctggagtcggggctggcaggtcgcttactagtnctattnagtntcagtntgagngngcgtgtgatntggggctgcgngcgtcgggcgtgngctcgctgtgcncnctntgtgtgtagtgngctactgtgtcgtcgtcgtcgcgacgcgcgaggaggcgnggngtggtgcgngnatacgacgacgacgagagtagtagttagtgtgtcgtcgtgtagaggtacgtacgtacgtacgtactacgtacgacgacgacgacgtacgaacgtactactacgtacgttcgtacgtagtagtacgtacgtacgacggtcgacgacgacggacggacggacggtacgtacgtacgttacgttacgttacgtacgttacgtacggtaacggtacggtaacggtaacgttaacgttaacgttaaccgttacgttaacgttaacgttaacgttacggttacggttaacgg

SEQ ID NO: 87678 - DNA, 174 bp, Homo sapiens; identical to SEQ ID NO: 86914
  misc_feature: GYAE6OF02I5L4R.1.89.I01.1.454.CMB.1.raw
  modified_base (170)..(174): a, c, t, g, unknown or other
  misc_feature (170)..(174): n is a, c, g, or t

SEQ ID NO: 87679 - DNA, 171 bp, Homo sapiens; identical to SEQ ID NO: 86606
  misc_feature: GYAE6OF02IDV18.1.89.I01.1.454.CMB.1.raw
  modified_base (170)..(171): a, c, t, g, unknown or other
  misc_feature (170)..(171): n is a, c, g, or t

SEQ ID NO: 87680 - DNA, 181 bp, Homo sapiens
  misc_feature: GYAE6OF02GPDM1.1.89.I01.1.454.CMB.1.raw
  modified_base (169)..(181): a, c, t, g, unknown or other
  misc_feature (169)..(181): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccgccctcctctactgctagtctgagcgggctggcaaggcgcatagnnnnnnnnnnnnn

SEQ ID NO: 87681 - DNA, 198 bp, Homo sapiens
  misc_feature: GYAE6OF02ISTRB.1.89.I01.1.454.CMB.1.raw
  modified_base (165)..(165): a, c, t, g, unknown or other
  misc_feature (165)..(165): n is a, c, g, or t
  modified_base (171)..(198): a, c, t, g, unknown or other
  misc_feature (171)..(198): n is a, c, g, or t
tcagacgagtgcgtcacgaccggtgctcgatttagtatgctagtatcgcggggggggtgttcggcggagggaccaaactgaccgtcctaggtcagccaaggctgccccctcggtcactctgttcccgccctcctcgagtgcgtctctgagcgggctggcaaggcncatagnnnnnnnnnnnnnnnnnnnnnnnnnnnn

SEQ ID NO: 87682 - DNA, 187 bp, Homo sapiens
  misc_feature: GYAE6OF02GRQIS.1.89.I01.1.454.CMB.1.raw
  modified_base (187)..(187): a, c, t, g, unknown or other
  misc_feature (187)..(187): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctatgtatactctgagcgggctggcaaggcgcatagn

SEQ ID NO: 87683 - DNA, 185 bp, Homo sapiens
  misc_feature: GYAE6OF02HFJAW.1.89.I01.1.454.CMB.1.raw
  modified_base (170)..(185): a, c, t, g, unknown or other
  misc_feature (170)..(185): n is a, c, g, or t
tcagacgagtgcgtcacgaccggtgctcgatttagtatgctagtatcgcgggggggtgttcggcggagggaccaaactgaccgtcctaggtcagcccaaggctgcccctcggtcactctgttcccgccctcctctactgctagtctgagcgggctggcaaggcgcatagnnnnnnnnnnnnnnnn

SEQ ID NO: 87684 - DNA, 174 bp, Homo sapiens
  misc_feature: GYAE6OF02GK7K2.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctcgtactgcgctgagcgggctggcaaggcgcatagnnnn

SEQ ID NO: 87685 - DNA, 173 bp, Homo sapiens
  misc_feature: GYAE6OF02FNCKE.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcacgtagcgtgctgagcgggctggcaaggcgcatagnnn

SEQ ID NO: 87686 - DNA, 192 bp, Homo sapiens
  misc_feature: GYAE6OF02HFSX0.1.89.I01.1.454.CMB.1.raw
  modified_base (173)..(192): a, c, t, g, unknown or other
  misc_feature (173)..(192): n is a, c, g, or t
tcagacgagtgcgtcacgaccggtgctcgatttagtatgctagtatcggcgggggggtgttcggcggagggaccaaactgaccgtcctaggtcagcccaaggctgccccctcggtcactctgttcccaccctcctcacgtagcgtgctgagcgggctgggcaaggcgcatagnnnnnnnnnnnnnnnnnnnn

SEQ ID NO: 87687 - DNA, 386 bp, Homo sapiens
  misc_feature: GYAE6OF02HL5ES.1.89.I01.1.454.CMB.1.raw
  modified_base (264)..(264): a, c, t, g, unknown or other
  misc_feature (264)..(264): n is a, c, g, or t
  modified_base (354)..(356): a, c, t, g, unknown or other
  misc_feature (354)..(356): n is a, c, g, or t
  modified_base (358)..(386): a, c, t, g, unknown or other
  misc_feature (358)..(386): n is a, c, g, or t
tcagacgagtgcgtcacgaccggtgctcgatttagtatgctagtatggggtcgacgaccgacctgagctcaggaggcagcagagcgagggaggaggagaggccccaggtgaacggaggggcttgtccaggccggcagcatcaccggagccctagggcagggtcagcagtgctggcccgtggggccctccgtctcagccagggaccaaggacagcagcctccaccaagggcccatcggtcttccccctggccaccctctccaagngcacctctgggggcacgagcggccctgggctgcctggtcaaggacctacttccgtcgtagcacgtctgagcgggctggcaggcgcatagnnncnnnnnnnnnnnnnnnnnnnnnnnnnnnnn

SEQ ID NO: 87688 - DNA, 416 bp, Homo sapiens
  misc_feature: GYAE6OF02JGI94.1.89.I01.1.454.CMB.1.raw
  modified_base (376)..(376): a, c, t, g, unknown or other
  misc_feature (376)..(376): n is a, c, g, or t
  modified_base (379)..(380): a, c, t, g, unknown or other
  misc_feature (379)..(380): n is a, c, g, or t
  modified_base (384)..(387): a, c, t, g, unknown or other
  misc_feature (384)..(387): n is a, c, g, or t
  modified_base (389)..(390): a, c, t, g, unknown or other
  misc_feature (389)..(390): n is a, c, g, or t
  modified_base (392)..(416): a, c, t, g, unknown or other
  misc_feature (392)..(416): n is a, c, g, or t
tcagacgagtgcgtcacgaccggtgctcgatttagtatgctagtatgggcacgaccggacctgagctcaggaggcagcagagcgagggaggaggagaggccccaggtgaacggaggggcttgtccaggccggcagcatcaccggagcccagggcagggtcagcagtgctggaccgtggggccctcctctcagccaggaccaaggacagcagcctccaccaagggcccaatcggtacttcccccgtggccaccctcgtcaagagcaccttctggggctacgacgcggccgtgggctacgcctggtccaagggtacctacttccggacgttcgccgtacgtcctgaggccggtcctgggccaacggtcgccaagtagnacnnggcnnnncnncnnnnnnnnnnnnnnnnnnnnnnnnn

SEQ ID NO: 87689 - DNA, 170 bp, Homo sapiens; identical to SEQ ID NO: 86803
  misc_feature: GYAE6OF02HKCYX.1.89.I01.1.454.CMB.1.raw

SEQ ID NO: 87690 - DNA, 172 bp, Homo sapiens; identical to SEQ ID NO: 87490
  misc_feature: GYAE6OF02IETN5.1.89.I01.1.454.CMB.1.raw
  modified_base (169)..(172): a, c, t, g, unknown or other
  misc_feature (169)..(172): n is a, c, g, or t

SEQ ID NO: 87691 - DNA, 174 bp, Homo sapiens; identical to SEQ ID NO: 86840
  misc_feature: GYAE6OF02JFKAG.1.89.I01.1.454.CMB.1.raw
  modified_base (170)..(174): a, c, t, g, unknown or other
  misc_feature (170)..(174): n is a, c, g, or t

SEQ ID NO: 87692 - DNA, 173 bp, Homo sapiens
  misc_feature: GYAE6OF02JE4SX.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcggcggggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 87693 - DNA, 173 bp, Homo sapiens
  misc_feature: GYAE6OF02FM6CA.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctgtcgagcgtctgagcgggctggcaaggcgcatagnnn

SEQ ID NO: 87694 - DNA, 199 bp, Homo sapiens
  misc_feature: GYAE6OF02HUHTZ.1.89.I01.1.454.CMB.1.raw
  modified_base (174)..(199): a, c, t, g, unknown or other
  misc_feature (174)..(199): n is a, c, g, or t
tcagacgagtgcgtcacgaccggtgctcgatttagtatgctagtatcgcgggggggtgttcggcggagggaccaaactgaccgtcctaggtcacgcccaaggctgccccctcggtcacctctgttcccgccctcctcgtactgctagtctgagcgggctggcaaggcgcatagnnnnnnnnnnnnnnnnnnnnnnnnnn

SEQ ID NO: 87695 - DNA, 530 bp, Homo sapiens
  misc_feature: GYAE6OF02G5O6E.1.89.I01.1.454.CMB.1.raw
  modified_base (352)..(352): a, c, t, g, unknown or other
  misc_feature (352)..(352): n is a, c, g, or t
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
tcagacgagtgcgtcacgaccggtgctcgatttagtatgctagtatcgcgggggtaagaggttgtgtccaccatggcctggactcctctcctcctcctgttcctctctcactgcacaggttccctctcgcaggctgtgctgactcagccgtcttccctctctgcttttcctggagtatcagccagtctcacctgcaccttgcgcagtggcatcaattttgctacctccgagatattctggtaccagcagaagccagggagtcctccccattatctcctgaggtacaggtcggactctgagcaacagcagggctacgaggactccccagccgcttctctggactaccaaaagntgcttcggacaagtggaccgggtattttacnctatctcgtgggctccagtcngaggatggagctagactattactgtatgtagtttggactatatcgaggtagggttgggtgttcggagggagggtaccaaggctacggtccgtcgtacgtccgagacccgaaggtcctccgtccccg

SEQ ID NO: 87696 - DNA, 239 bp, Homo sapiens
  misc_feature: GYAE6OF02GIM79.1.89.I01.1.454.CMB.1.raw
  modified_base (183)..(239): a, c, t, g, unknown or other
  misc_feature (183)..(239): n is a, c, g, or t
tcagacgagtgcgtcacgaccggtgctcgatttagtatgctagtaagtacggcggggggtgttcggcggagggaccaaacgtgaccgtcctaaggtcagcccaaggctgaccccctcggtcactctgttcccgaccctccgtcacggtagccgtgctgagcgggcttggcaaggcgcataggnnnnnnnnnnnnnnnnnnnnnnnnnnnnnnnnnnnnnnnnnnnnnnnnnnnnnnnnn

SEQ ID NO: 87697 - DNA, 187 bp, Homo sapiens
  misc_feature: GYAE6OF02GBF33.1.89.I01.1.454.CMB.1.raw
  modified_base (171)..(187): a, c, t, g, unknown or other
  misc_feature (171)..(187): n is a, c, g, or t
tcagacgagtgcgtcacgaccggtgctcgatttagtatgctagtatcgcgggggggtgttcggcggagggaccaaactgaccgtcctaggtaagcccaaggctgccccctcggtcactctgttcccaccctcctcacgtagcgtgctgagcgggctggcaaggcgcatagnnnnnnnnnnnnnnnnn

SEQ ID NO: 87698 - DNA, 172 bp, Homo sapiens
  misc_feature: GYAE6OF02GL4RO.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcctacagtgctctgagcgggctggcaaggcgcatagnn

SEQ ID NO: 87699 - DNA, 237 bp, Homo sapiens
  misc_feature: GYAE6OF02GD0C4.1.89.I01.1.454.CMB.1.raw
  modified_base (180)..(183): a, c, t, g, unknown or other
  misc_feature (180)..(183): n is a, c, g, or t
  modified_base (185)..(237): a, c, t, g, unknown or other
  misc_feature (185)..(237): n is a, c, g, or t
tcagacgagtgcgtcacgaccggtgctcgatttagtatgctagtatcggtcggggggggtcttcggcggagggaccaaactgaccgtcctaggtcagcccaaggctgccccctggtcactctgttcccacccgtcctcacgtctactggcgtgaggcgggctggccaaaggcgacatagnnnnannnnnnnnnnnnnnnnnnnnnnnnnnnnnnnnnnnnnnnnnnnnnnnnnnnnn

SEQ ID NO: 87700 - DNA, 172 bp, Homo sapiens
  misc_feature: GYAE6OF02GEL5E.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatagnn

SEQ ID NO: 87701 - DNA, 174 bp, Homo sapiens; identical to SEQ ID NO: 86821
  misc_feature: GYAE6OF02F0CEL.1.89.I01.1.454.CMB.1.raw
  modified_base (169)..(174): a, c, t, g, unknown or other
  misc_feature (169)..(174): n is a, c, g, or t

SEQ ID NO: 87702 - DNA, 176 bp, Homo sapiens; identical to SEQ ID NO: 87604
  misc_feature: GYAE6OF02H0WAQ.1.89.I01.1.454.CMB.1.raw
  modified_base (171)..(176): a, c, t, g, unknown or other
  misc_feature (171)..(176): n is a, c, g, or t

SEQ ID NO: 87703 - DNA, 348 bp, Homo sapiens
  misc_feature: GYAE6OF02I2GFL.1.89.I01.1.454.CMB.1.raw
  modified_base (345)..(348): a, c, t, g, unknown or other
  misc_feature (345)..(348): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctcaccaagggcccatcggtcttccccctggccaccctcctccaagagcacctctgggggcacagcggcccctgggctgcctggtcaaggactacttcctcgtagcactctgagcgggctggcaaggcgcatagnnnn

SEQ ID NO: 87704 - DNA, 203 bp, Homo sapiens
  misc_feature: GYAE6OF02FVMWB.1.89.I01.1.454.CMB.1.raw
  modified_base (173)..(203): a, c, t, g, unknown or other
  misc_feature (173)..(203): n is a, c, g, or t
tcagacgagtgcgtcacgaccggtgctcgatttagtatgctagtatcggtcggggggggtgttcggcggagggaccaaactgaccgtcctaggtcagcccaaggctgccccctggtcactctgttcccgccatctgaatagcgtactctgagcgggctggcaaggcgcatagnnnnnnnnnnnnnnnnnnnnnnnnnnnnnnn

SEQ ID NO: 87705 - DNA, 261 bp, Homo sapiens
  misc_feature: GYAE6OF02IMVMU.1.89.I01.1.454.CMB.1.raw
  modified_base (57)..(57): a, c, t, g, unknown or other
  misc_feature (57)..(57): n is a, c, g, or t
  modified_base (170)..(261): a, c, t, g, unknown or other
  misc_feature (170)..(261): n is a, c, g, or t
tcagacgagtgcgtcacgaccggtgctcgatttagtatgctagtatcgcggggggtnttcggcggagggaccaaactgaccgtcctaggtcagcccaaggctgccccctcggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 87706 - DNA, 204 bp, Homo sapiens
  misc_feature: GYAE6OF02FNAIH.1.89.I01.1.454.CMB.1.raw
  modified_base (188)..(204): a, c, t, g, unknown or other
  misc_feature (188)..(204): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtcactctgttcccaccctcctctctctcgactctgagtcgggctggcaaggcgcatagnnnnnnnnnnnnnnnnn

SEQ ID NO: 87707 - DNA, 236 bp, Homo sapiens
  misc_feature: GYAE6OF02HM4X6.1.89.I01.1.454.CMB.1.raw
  modified_base (58)..(58): a, c, t, g, unknown or other
  misc_feature (58)..(58): n is a, c, g, or t
  modified_base (170)..(236): a, c, t, g, unknown or other
  misc_feature (170)..(236): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnn

SEQ ID NO: 87708 - DNA, 168 bp, Homo sapiens; identical to SEQ ID NO: 86356
  misc_feature: GYAE6OF02FW11C.1.89.I01.1.454.CMB.1.raw
  modified_base (168)..(168): a, c, t, g, unknown or other
  misc_feature (168)..(168): n is a, c, g, or t

SEQ ID NO: 87709 - DNA, 173 bp, Homo sapiens
  misc_feature: GYAE6OF02FVMW9.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactttgttcccaccctcctctactgctagtatgagcgggctggcaaggcgcatagnnnn

SEQ ID NO: 87710 - DNA, 174 bp, Homo sapiens
  misc_feature: GYAE6OF02H4KEQ.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctcgtagcactctgagcgggctggcaaggcgcatagnnnnn

SEQ ID NO: 87711 - DNA, 215 bp, Homo sapiens
  misc_feature: GYAE6OF02F17ZW.1.89.I01.1.454.CMB.1.raw
  modified_base (178)..(215): a, c, t, g, unknown or other
  misc_feature (178)..(215): n is a, c, g, or t
tcagacgagtgcgtcacgaccggtgctcgatttagtatgctagtagtcgcgggggggtgttcggcggacgggaccaaactgaccgtcctaggtcagcccaaggctgcccccgtcggtcactctgttcccacccgtcctcatagcgtactctggagccgggctggcaagggcgcatagnnnnnnnnnnnnnnnnnnnnnnnnnnnnnnnnnnnnnn

SEQ ID NO: 87712 - DNA, 367 bp, Homo sapiens
  misc_feature: GYAE6OF02JC72Q.1.89.I01.1.454.CMB.1.raw
  modified_base (350)..(367): a, c, t, g, unknown or other
  misc_feature (350)..(367): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctccaccaaggcccatcggtctcccctggccaccctcctccaagagccacctctgggggcacagccggcctgggctgcctggtcaagggacctacgttccgagtgccgtctcgtgaggcggctgggcaaggcacagtagcnnnnnnnnnnnnnnnnnn

SEQ ID NO: 87713 - DNA, 187 bp, Homo sapiens
  misc_feature: GYAE6OF02HXMFN.1.89.I01.1.454.CMB.1.raw
  modified_base (185)..(187): a, c, t, g, unknown or other
  misc_feature (185)..(187): n is a, c, g, or t
tcagacgagtgcgtcacgaccggtgctcgatttagtatgctagtatgggatggccacctgagtggtctttgggtgttcggcgggggaccaagctgaccgtcctaggtcagcccaaggctgccccctggtcactctgttcccgcatctgatctctcgactctgagcgggctggcaaggcgcatagnnn

SEQ ID NO: 87714 - DNA, 349 bp, Homo sapiens
  misc_feature: GYAE6OF02IJVO7.1.89.I01.1.454.CMB.1.raw
  modified_base (344)..(349): a, c, t, g, unknown or other
  misc_feature (344)..(349): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccaggggagggtcagcagtgctggccgtggggccctcctctcagccaggaccaaggacagcagcctccaccaaagggcccatcggtcttccccctggcaccctcctccaagagcacctctgggggcacagcgccctgggctgcctggtcaaggactacttccgagtgcgtctctgagcgggctggcaaggcgcatagnnnnnn

SEQ ID NO: 87715 - DNA, 170 bp, Homo sapiens; identical to SEQ ID NO: 86730
  misc_feature: GYAE6OF02GPO7N.1.89.I01.1.454.CMB.1.raw
  modified_base (169)..(170): a, c, t, g, unknown or other
  misc_feature (169)..(170): n is a, c, g, or t

SEQ ID NO: 87716 - DNA, 175 bp, Homo sapiens; identical to SEQ ID NO: 86906
  misc_feature: GYAE6OF02FVR4X.1.89.I01.1.454.CMB.1.raw
  modified_base (171)..(175): a, c, t, g, unknown or other
  misc_feature (171)..(175): n is a, c, g, or t

SEQ ID NO: 87717 - DNA, 227 bp, Homo sapiens
  misc_feature: GYAE6OF02GVDQA.1.89.I01.1.454.CMB.1.raw
  modified_base (171)..(227): a, c, t, g, unknown or other
  misc_feature (171)..(227): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 87718 - DNA, 170 bp, Homo sapiens
  misc_feature: GYAE6OF02JCJTK.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcacgtctactgctgagcgggctggcaaggcgcatagn

SEQ ID NO: 87719 - DNA, 712 bp, Homo sapiens
  misc_feature: GYAE6OF02FRHIW.1.89.I01.1.454.CMB.1.raw
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (209)..(210): a, c, t, g, unknown or other
  misc_feature (209)..(210): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
tcagacgagtgcgtcacgaccggtgctcgatttagtatgctagtaagtacggcgggggtcgttacggccggtagggaccaaacctgacccgtcctacggtcagcccaaggcctgcccccgtggtcacctctgttacccaccctacctcgatagtcgtactctggagcgggctcggccaaggcccgacgaagtagngngngtngntattnntgatgacactnagngtcgcntacacgngtcgatcactatactcgtanacacgtaccagtaacctgtcctaccgtagagctacgaactctctaccggaccgccgacgacggtacggtacgggtaacttaacgtattacggttgtcgacgtaacggactaagttagttggttacgttggacctaccgtccgtaccttaagttacggtacgtcggtaccgtcggtcgggaaccgaacgggaccacgttacgtaccgtaccgtaccgtaccgtaccgtacgtacccgtacccgaccgaaccggtacccgtaccgttaccggttcccgttccccgtaccgtcccgtacccgtccgtccgtaccgacgtacgaccgaccgaccgacgacgacgaccgaccggtccgccgtcggtccgtaccgtacgtacgtacgtacgtaccgtaccgttacccgtccgttaccgttaccgtaccgtacggtacggtacggtacggtacggacgacgg

SEQ ID NO: 87720 - DNA, 170 bp, Homo sapiens; identical to SEQ ID NO: 86921
  misc_feature: GYAE6OF02F6R1F.1.89.I01.1.454.CMB.1.raw

SEQ ID NO: 87721 - DNA, 173 bp, Homo sapiens
  misc_feature: GYAE6OF02G9DXP.1.89.I01.1.454.CMB.1.raw
  modified_base (169)..(173): a, c, t, g, unknown or other
  misc_feature (169)..(173): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccaccctcctcacgtctactgctgagcgggctggcaaggcgcatagnnnnn

SEQ ID NO: 87722 - DNA, 604 bp, Homo sapiens
  misc_feature: GYAE6OF02JRM2N.1.89.I01.1.454.CMB.1.raw
  modified_base (179)..(179): a, c, t, g, unknown or other
  misc_feature (179)..(179): n is a, c, g, or t
  modified_base (278)..(278): a, c, t, g, unknown or other
  misc_feature (278)..(278): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(563): a, c, t, g, unknown or other
  misc_feature (558)..(563): n is a, c, g, or t
  modified_base (565)..(574): a, c, t, g, unknown or other
  misc_feature (565)..(574): n is a, c, g, or t
  modified_base (576)..(604): a, c, t, g, unknown or other
  misc_feature (576)..(604): n is a, c, g, or t
tcagacgagtgcgtcacgaccggtgctcgatttagtatgctagtatgggcacgaccgacctgagctcaggaggcagcagagcgagggaggaggaggaggcccagggtgaacggaggggcgttggtccagggccggcaggcgatccgaccggagcccgagggccgagggtccagcgtagngcgtggccgtggggccctacgcctcacgccacgggaccaacgggacacgtcaggcccttactaccgaacgggcccaatccggggtacctttcccccggnggcccacccccgttccgcccaaaacgggacgtcccaacccgttccgtcgggggccgacccgaacggcccgggcccccgttaggggcccgtcgggtcccccgtacggggttccccgaaagggggaccccttaaaccggggttttcccctacccgggttaacgggccctaaaccggttcctcgggtaaccggggtccgggaccgtttcggggaacggaaccggtccggacgaacgtacgggctcgngaacncgcgnaacncgttacncgacnacgncncncnnnnnncnnnnnnnnnncnnnnnnnnnnnnnnnnnnnnnnnnnnnnn

SEQ ID NO: 87723 - DNA, 184 bp, Homo sapiens
  misc_feature: GYAE6OF02FN73L.1.89.I01.1.454.CMB.1.raw
  modified_base (170)..(184): a, c, t, g, unknown or other
  misc_feature (170)..(184): n is a, c, g, or t
tcagacgagtgcgtcacgaccggtgctcgatttagtatgctagtatcgcgggggtcttcggagctgggaccaaggtcaccgtcctaggtaagcccaaggccaaccccactgtcactctgttccccgccctcctcacgtctactgctgagcgggctggcaaggcgcatagnnnnnnnnnnnnnnn

SEQ ID NO: 87724 - DNA, 224 bp, Homo sapiens
  misc_feature: GYAE6OF02FNV4K.1.89.I01.1.454.CMB.1.raw
  modified_base (58)..(58): a, c, t, g, unknown or other
  misc_feature (58)..(58): n is a, c, g, or t
  modified_base (170)..(224): a, c, t, g, unknown or other
  misc_feature (170)..(224): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccgccctcctctactgctagtctgagcgggctggcaaggcgcatagnnnnnnnnnnnnnnnnnnnnnnnnnnnnnnnnnnnnnnnnnnnnnnnnnnnnnnn

SEQ ID NO: 87725 - DNA, 361 bp, Homo sapiens
  misc_feature: GYAE6OF02GH4DS.1.89.I01.1.454.CMB.1.raw
  modified_base (268)..(268): a, c, t, g, unknown or other
  misc_feature (268)..(268): n is a, c, g, or t
  modified_base (321)..(321): a, c, t, g, unknown or other
  misc_feature (321)..(321): n is a, c, g, or t
  modified_base (349)..(361): a, c, t, g, unknown or other
  misc_feature (349)..(361): n is a, c, g, or t
tcagacgagtgcgtcacgaccggtgctcgatttagtatgctagtatgggcacgaccgacctgagctcaggaggcagcagagcgagggaggaggagaggccccaggtgaacggggggcttgtccaggccggcagcatcaccggagcccagggcagggtcagcagtgctggccgtggggccctcctctcagccaggaccaaggacagcagcctccaccaagggcccatcggtccttccccctggccacccctcctccaagacgcacctcngggggccacagccggccctgggctgcctggtcaaggactacttcgatgcgtcnctgagcgggctggcaaggcgcagtacgnnnnnnnnnnnnn

SEQ ID NO: 87726 - DNA, 353 bp, Homo sapiens
  misc_feature: GYAE6OF02HGUM0.1.89.I01.1.454.CMB.1.raw
  modified_base (314)..(314): a, c, t, g, unknown or other
  misc_feature (314)..(314): n is a, c, g, or t
  modified_base (339)..(353): a, c, t, g, unknown or other
  misc_feature (339)..(353): n is a, c, g, or t
tcagacgagtgcgtcacgaccggtgctcgatttagtatgctagtatgggcacgaccgacctgagctcaggaggcagcagagcgagggaggaggagaggccccaggtgaacggagggcttgtccaggccggcagcatcaccggagcccagggcagggtcagcagtgctggccgtggggccctcctctcagccaggaccaaggacagcagcctcacaagggcccatcggtcttcccctggcaccctctccaagacgcacctcgtcggggcacagcggccctgggctgcctggtcaaggctacgtccgagtgcgtcnctgagcggctggcaaggcgcatagnnnnnnnnnnnnnnn

SEQ ID NO: 87727 - DNA, 220 bp, Homo sapiens
  misc_feature: GYAE6OF02G36KQ.1.89.I01.1.454.CMB.1.raw
  modified_base (58)..(58): a, c, t, g, unknown or other
  misc_feature (58)..(58): n is a, c, g, or t
  modified_base (169)..(220): a, c, t, g, unknown or other
  misc_feature (169)..(220): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccacctcctctactgctagtctgagcgggctggcaaggcgcatagnnnnnnnnnnnnnnnnnnnnnnnnnnnnnnnnnnnnnnnnnnnnnnnnnnnn

SEQ ID NO: 87728 - DNA, 246 bp, Homo sapiens
  misc_feature: GYAE6OF02HJ787.1.89.I01.1.454.CMB.1.raw
  modified_base (167)..(246): a, c, t, g, unknown or other
  misc_feature (167)..(246): n is a, c, g, or t
tcagacgagtgcgtcacgaccggtgctcgatttagtatgctagtatcgcgggggtcttcggagctgggaccaaggtcaccgtcctaggtaagcccaaggccaaccccactgtcactctgttcccacctcctcacgtctactgctgagcggctggcaaggcgcatagnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 87729 - DNA, 168 bp, Homo sapiens
  misc_feature: GYAE6OF02FGTIH.1.89.I01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccacctctctactgctagtctgagcgggctggcaaggcgcatagnn

SEQ ID NO: 87730 - DNA, 174 bp, Homo sapiens
  misc_feature: GYAE6OF02IPDGA.1.89.I01.1.454.CMB.1.raw
  modified_base (172)..(174): a, c, t, g, unknown or other
  misc_feature (172)..(174): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccgccctcctctactgctagtctgagcgggctggcaaggcgcatagnnn

SEQ ID NO: 87731 - DNA, 170 bp, Homo sapiens
  misc_feature: GYAE6OF02GJDG8.1.89.I01.1.454.CMB.1.raw
tcagacgagtgcgtcacgaccggtgctcgatttagtatgctagtatcgcgggggggtgttcggcggagggaccaaactgaccgtcctaggtaagcccaaggctgccccctcggtcactctgttcccgccctcctcacgtagcgtgctgagcgggctggcaaggcgcatag

SEQ ID NO: 87732 - DNA, 262 bp, Homo sapiens
  misc_feature: GYAE6OF02I63SR.1.89.I01.1.454.CMB.1.raw
  modified_base (252)..(254): a, c, t, g, unknown or other
  misc_feature (252)..(254): n is a, c, g, or t
  modified_base (256)..(262): a, c, t, g, unknown or other
  misc_feature (256)..(262): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgccccctggtcactctgttcccgcatctgaatgcgtactctgagcgggctggcaaggcgcatagnnnannnnnnn

SEQ ID NO: 87733 - DNA, 171 bp, Homo sapiens; identical to SEQ ID NO: 86418
  misc_feature: GYAE6OF02IGR6L.1.89.I01.1.454.CMB.1.raw
  modified_base (170)..(171): a, c, t, g, unknown or other
  misc_feature (170)..(171): n is a, c, g, or t

SEQ ID NO: 87734 - DNA, 170 bp, Homo sapiens; identical to SEQ ID NO: 86921
  misc_feature: GYAE6OF02H77BY.1.89.I01.1.454.CMB.1.raw

SEQ ID NO: 87735 - DNA, 170 bp, Homo sapiens
  misc_feature: GYAE6OF02JMD12.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcgggggtcttcggagctgggaccaaggtcaccgtcctaggtcagcccaaggtcaaccccactgtcactctgttcccaccctcctcacgtctactgctgagcgggctggcaaggcgcatagnn

SEQ ID NO: 87736 - DNA, 172 bp, Homo sapiens; identical to SEQ ID NO: 86615
  misc_feature: GYAE6OF02IQ39F.1.89.I01.1.454.CMB.1.raw
  modified_base (171)..(172): a, c, t, g, unknown or other
  misc_feature (171)..(172): n is a, c, g, or t

SEQ ID NO: 87737 - DNA, 552 bp, Homo sapiens
  misc_feature: GYAE6OF02JHKJ0.1.89.I01.1.454.CMB.1.raw
  modified_base (60)..(60): a, c, t, g, unknown or other
  misc_feature (60)..(60): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagacgagtgcgtcacgaccggtgctcgatttagtatgctagtatcggcggggggggtnttcggcggagggaccaaactgaccgtcctaggtcagcccaaggctgcccctggtcactctcgttcccgcctcctctactgctagtctgagcgggctggccaaggcgtcatacgncgcncncncngcgtctcgngcgntcgacncgcncgtcgcgacgcgtncgcncgctgacnctcacncgctacgctcgcncgtcanacgtcgacgcncngtacncgtcntcncgactcgcgactgcncgtcgactcggctacgcgacgtcgatcggacgtancggcacgcgtanccgatcggtactcggacncgttacagctacncggctacgctnacgtntancgntccggatctnctncacgngtcacggtnacgtcgctaacgtcgcgtaacgttcaccgggaacgttcgtaaccggcgtaaacggggcctttacgggtaaccgtaccgtttcgaaaccgggtttcccgtaccgtaccggtccgtccgtacggtccg

SEQ ID NO: 87738 - DNA, 171 bp, Homo sapiens; identical to SEQ ID NO: 86710
  misc_feature: GYAE6OF02FN0E3.1.89.I01.1.454.CMB.1.raw
  modified_base (171)..(171): a, c, t, g, unknown or other
  misc_feature (171)..(171): n is a, c, g, or t

SEQ ID NO: 87739 - DNA, 242 bp, Homo sapiens
  misc_feature: GYAE6OF02IJHNL.1.89.I01.1.454.CMB.1.raw
  modified_base (61)..(61): a, c, t, g, unknown or other
  misc_feature (61)..(61): n is a, c, g, or t
  modified_base (153)..(153): a, c, t, g, unknown or other
  misc_feature (153)..(153): n is a, c, g, or t
  modified_base (178)..(242): a, c, t, g, unknown or other
  misc_feature (178)..(242): n is a, c, g, or t
tcagacgagtgcgtcacgaccggtgctcgattttagtatgctagtatcggcggggggggtnttcggcggagggaccaaactgaccgtcctaggtcagcccaagggctcgccccctcggtcactcctggttcccgccatctgaatagcgtactntgagcgggctggcaaggcgcatagnnnnnnnnnnnnnnnnnnnnnnnnnnnnnnnnnnnnnnnnnnnnnnnnnnnnnnnnnnnnnnnnn

SEQ ID NO: 87740 - DNA, 175 bp, Homo sapiens
  misc_feature: GYAE6OF02FHBEJ.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctccgtgtctgatctgagcgggctggcaaggcgcatagnnnnnn

SEQ ID NO: 87741 - DNA, 572 bp, Homo sapiens
  misc_feature: GYAE6OF02HC6EW.1.89.I01.1.454.CMB.1.raw
  modified_base (196)..(196): a, c, t, g, unknown or other
  misc_feature (196)..(196): n is a, c, g, or t
  modified_base (470)..(470): a, c, t, g, unknown or other
  misc_feature (470)..(470): n is a, c, g, or t
  modified_base (484)..(484): a, c, t, g, unknown or other
  misc_feature (484)..(484): n is a, c, g, or t
  modified_base (566)..(566): a, c, t, g, unknown or other
  misc_feature (566)..(566): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggcctccgaggctcctcatctatgatacatacccaacgacgggccacgtcggcctactcccacggcctaggttccaggtcggactaggttcggggtcgtggggcacggtacttcgacctctaccactatcgacgcacgccgtagacgtcctaggtaagttcgtttgacttaagttttacttacgtgttcagtctaggtcgtanacgacgtgcccttntcctaccgttccggccgtacggaactaagtcgaatactaacaaacgtctgtcggctacgacctactcttccgtcgttccttncttccc

SEQ ID NO: 87742 - DNA, 182 bp, Homo sapiens
  misc_feature: GYAE6OF02IB6FT.1.89.I01.1.454.CMB.1.raw
  modified_base (169)..(170): a, c, t, g, unknown or other
  misc_feature (169)..(170): n is a, c, g, or t
  modified_base (172)..(182): a, c, t, g, unknown or other
  misc_feature (172)..(182): n is a, c, g, or t
tcagacgagtgcgtcacgaccggtgctcgatttagtatgctagtatcgcgggggtgttcggcggagggaccgaaactgaccgtcctaggtcagcccaaggctgcccctcggtcactctgttcccgctctcctctgtcgagcgtctgagcggctggcaaggcgcagtagnngnnnnnnnnnnn

SEQ ID NO: 87743 - DNA, 170 bp, Homo sapiens; identical to SEQ ID NO: 87644
  misc_feature: GYAE6OF02F70EZ.1.89.I01.1.454.CMB.1.raw

SEQ ID NO: 87744 - DNA, 171 bp, Homo sapiens; identical to SEQ ID NO: 87525
  misc_feature: GYAE6OF02IWEQ6.1.89.I01.1.454.CMB.1.raw
  modified_base (169)..(171): a, c, t, g, unknown or other
  misc_feature (169)..(171): n is a, c, g, or t

SEQ ID NO: 87745 - DNA, 353 bp, Homo sapiens
  misc_feature: GYAE6OF02HL5JZ.1.89.I01.1.454.CMB.1.raw
  modified_base (345)..(353): a, c, t, g, unknown or other
  misc_feature (345)..(353): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctcaccaagggcccatcggtcttccccctggccaccctcctccaagagcacctctgggggcacagcggcccctgggctgcctggtcaaggactacttccgagtgcgtctctgagcgggctggcaaggcgcatagnnnnnnnnn

SEQ ID NO: 87746 - DNA, 174 bp, Homo sapiens
  misc_feature: GYAE6OF02GPBTJ.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctctactgctagtctgagcgggctggcaaggcgcatagnnnnn

SEQ ID NO: 87747 - DNA, 174 bp, Homo sapiens
  misc_feature: GYAE6OF02J1545.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcggggggtgttcggcggagggaccaaactgaccgtcctaggtaagcccaaggctgccccctcggtcactctgttcccgccctcctcacgtagcgtgctgagcgggctggcaaggcgcatagnnnnn

SEQ ID NO: 87748 - DNA, 258 bp, Homo sapiens
  misc_feature: GYAE6OF02I6AD5.1.89.I01.1.454.CMB.1.raw
  modified_base (253)..(258): a, c, t, g, unknown or other
  misc_feature (253)..(258): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgcccctggtcactctgttcccgcatctgaatgcgtactctgacgcgggctggacaaggcgcaatgnnnnnn

SEQ ID NO: 87749 - DNA, 177 bp, Homo sapiens
  misc_feature: GYAE6OF02FTOW6.1.89.I01.1.454.CMB.1.raw
  modified_base (170)..(177): a, c, t, g, unknown or other
  misc_feature (170)..(177): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagnnnnnnnn

SEQ ID NO: 87750 - DNA, 193 bp, Homo sapiens
  misc_feature: GYAE6OF02HMANQ.1.89.I01.1.454.CMB.1.raw
  modified_base (174)..(193): a, c, t, g, unknown or other
  misc_feature (174)..(193): n is a, c, g, or t
tcagacgagtgcgtcacgaccggtgctcgatttagtatgctagtatcggtcggggggggtgttcggcggagggaccaaactgaccgtcctaggtcagcccaaggctgccccctcggtcactctgttcccaccctcctcacgtagcgtgctgagcgggctggcaaggcgcatagnnnnnnnnnnnnnnnnnnnn

SEQ ID NO: 87751 - DNA, 172 bp, Homo sapiens; identical to SEQ ID NO: 87291
  misc_feature: GYAE6OF02G36ZM.1.89.I01.1.454.CMB.1.raw
  modified_base (169)..(172): a, c, t, g, unknown or other
  misc_feature (169)..(172): n is a, c, g, or t

SEQ ID NO: 87752 - DNA, 247 bp, Homo sapiens
  misc_feature: GYAE6OF02H777G.1.89.I01.1.454.CMB.1.raw
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
  modified_base (239)..(247): a, c, t, g, unknown or other
  misc_feature (239)..(247): n is a, c, g, or t
tcagacgagtgcgtcacgaccggtgctcgatttagtatgctagtatcgcgggaccatctctgggctccaggctgaggacgaggctgattatttctgcagctcatatacaatcaataacaattgggtgttcggcggagggaccaaactgaccgtctaggtcagcccaaggctgccccctaggtcactctgttcccacctcctctcgtancactctgagcgggctggacaggcnctatagnnnnnnnnn

SEQ ID NO: 87753 - DNA, 260 bp, Homo sapiens
  misc_feature: GYAE6OF02IIAOQ.1.89.I01.1.454.CMB.1.raw
  modified_base (255)..(260): a, c, t, g, unknown or other
  misc_feature (255)..(260): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgccccctcggtcactctgttcccgccatctgaatagcgtactctgagcgggctggcaaggcgcatagnnnnnn

SEQ ID NO: 87754 - DNA, 176 bp, Homo sapiens
  misc_feature: GYAE6OF02GG8BV.1.89.I01.1.454.CMB.1.raw
  modified_base (172)..(176): a, c, t, g, unknown or other
  misc_feature (172)..(176): n is a, c, g, or t
tcagacgagtgcgtcacgaccggtgctcgatttagtatgctagtatcgcggggggggtgttcggcggagggaccaaactgaccgtcctaggtcagcccaaggctgccccctcggtcactctgttcccaccctcctctgtcgagcgtctgagcgggctggcaaggcgcatagnnnnn

SEQ ID NO: 87755 - DNA, 178 bp, Homo sapiens
  misc_feature: GYAE6OF02HTLDW.1.89.I01.1.454.CMB.1.raw
  modified_base (163)..(163): a, c, t, g, unknown or other
  misc_feature (163)..(163): n is a, c, g, or t
  modified_base (169)..(178): a, c, t, g, unknown or other
  misc_feature (169)..(178): n is a, c, g, or t
tcagacgagtgcgtcacgaccggtgctcgatttagtatgctagtagtcgcggggtcttcggagctgggaccaaggtcaccgtcctaggtcagcccaaggccaaccccatgtcactctgttccccgccctcctcacgtctactgctgagcgggctggcaaggcncatagnnnnnnnnnn

SEQ ID NO: 87756 - DNA, 204 bp, Homo sapiens
  misc_feature: GYAE6OF02F8WJK.1.89.I01.1.454.CMB.1.raw
  modified_base (174)..(204): a, c, t, g, unknown or other
  misc_feature (174)..(204): n is a, c, g, or t
tcagacgagtgcgtcacgaccggtgctcgatttagtatgctagtatcgcggggggtgttcggcggaagggaccaaactgaccgtcctaggtccagcccaaggctgccccctcggtcactctgttcccgccctcctctactgcttagtctgagcgggctggcaaggcgcatagcnnnnnnnnnnnnnnnnnnnnnnnnnnnnnnn

SEQ ID NO: 87757 - DNA, 173 bp, Homo sapiens; identical to SEQ ID NO: 86981
  misc_feature: GYAE6OF02IJC37.1.89.I01.1.454.CMB.1.raw
  modified_base (171)..(173): a, c, t, g, unknown or other
  misc_feature (171)..(173): n is a, c, g, or t

SEQ ID NO: 87758 - DNA, 170 bp, Homo sapiens
  misc_feature: GYAE6OF02HIGC1.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcacgtagcgtgctgagcgggctggcaaggcgcatag

SEQ ID NO: 87759 - DNA, 564 bp, Homo sapiens
  misc_feature: GYAE6OF02FVVPO.1.89.I01.1.454.CMB.1.raw
  modified_base (196)..(196): a, c, t, g, unknown or other
  misc_feature (196)..(196): n is a, c, g, or t
  modified_base (373)..(373): a, c, t, g, unknown or other
  misc_feature (373)..(373): n is a, c, g, or t
  modified_base (417)..(417): a, c, t, g, unknown or other
  misc_feature (417)..(417): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatacatccaacagggccacgtggcactcccagccaggttccagtggcaggtgggtctgggacagacttcactctcaccatcancagcctagacgcctagaagtatttgctagtttactacttgtacngctagcgttagtactcggcctctctcgtttccggcccgttagggaacctaaaggtggaacttaacgtaccaaacggtacgttaggtcggtacgtacgccctaaccgtattccgttacggttcctttacgtaccttcccgttaccccg

SEQ ID NO: 87760 - DNA, 170 bp, Homo sapiens; identical to SEQ ID NO: 86381
  misc_feature: GYAE6OF02GOMKX.1.89.I01.1.454.CMB.1.raw
  modified_base (170)..(170): a, c, t, g, unknown or other
  misc_feature (170)..(170): n is a, c, g, or t

SEQ ID NO: 87761 - DNA, 174 bp, Homo sapiens
  misc_feature: GYAE6OF02FI85B.1.89.I01.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcgggctggcaaggcgcatagnnnnn

SEQ ID NO: 87762 - DNA, 173 bp, Homo sapiens
  misc_feature: GYAE6OF02GLXPM.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtaagcccaaggctgccccctcggtcactctgttcccgccctcctcacgtagcgtgctgagcgggctggcaaggcgcatagnnn

SEQ ID NO: 87763 - DNA, 172 bp, Homo sapiens; identical to SEQ ID NO: 86723
  misc_feature: GYAE6OF02FWH7X.1.89.I01.1.454.CMB.1.raw
  modified_base (171)..(172): a, c, t, g, unknown or other
  misc_feature (171)..(172): n is a, c, g, or t

SEQ ID NO: 87764 - DNA, 170 bp, Homo sapiens; identical to SEQ ID NO: 86558
  misc_feature: GYAE6OF02HLD8X.1.89.I01.1.454.CMB.1.raw
  modified_base (170)..(170): a, c, t, g, unknown or other
  misc_feature (170)..(170): n is a, c, g, or t

SEQ ID NO: 87765 - DNA, 171 bp, Homo sapiens
  misc_feature: GYAE6OF02H1VFJ.1.89.I01.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctcgtactgcgctgagcgggctggcaaggcgcatagn

SEQ ID NO: 87766 - DNA, 170 bp, Homo sapiens
  misc_feature: GYAE6OF02G8A4K.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctcgtactgcgctgagcgggctggcaaggcgcatag

SEQ ID NO: 87767 - DNA, 198 bp, Homo sapiens
  misc_feature: GYAE6OF02H209T.1.89.I01.1.454.CMB.1.raw
  modified_base (192)..(198): a, c, t, g, unknown or other
  misc_feature (192)..(198): n is a, c, g, or t
tcagacgagtgcgtcacgaccggtgctcgatttagtatgctagtaaggggaagacaatggagagctctcactgtggtggacgttcggccaagggaccaaggtggaaatcaaacgaactgtggctgcaccatctgtcttcatcttcccgccctcctcacgcactcgtctgagcgggctggcaaggcgcatagnnnnnnn

SEQ ID NO: 87768 - DNA, 204 bp, Homo sapiens
  misc_feature: GYAE6OF02IB6X9.1.89.I01.1.454.CMB.1.raw
  modified_base (57)..(57): a, c, t, g, unknown or other
  misc_feature (57)..(57): n is a, c, g, or t
  modified_base (167)..(204): a, c, t, g, unknown or other
  misc_feature (167)..(204): n is a, c, g, or t
tcagacgagtgcgtcacgaccggtgctcgatttagtatgctagtatcgcggggggtnttcggcggagggaccaaactgaccgtcctaggtcagcccaaggctgcccctggtcactctgttcccaccctctcatagcgtactctgagcgggctggcaaggcgcatagnnnnnnnnnnnnnnnnnnnnnnnnnnnnnnnnnnnnnn

SEQ ID NO: 87769 - DNA, 242 bp, Homo sapiens
  misc_feature: GYAE6OF02H4352.1.89.I01.1.454.CMB.1.raw
  modified_base (58)..(58): a, c, t, g, unknown or other
  misc_feature (58)..(58): n is a, c, g, or t
  modified_base (132)..(132): a, c, t, g, unknown or other
  misc_feature (132)..(132): n is a, c, g, or t
  modified_base (147)..(147): a, c, t, g, unknown or other
  misc_feature (147)..(147): n is a, c, g, or t
  modified_base (168)..(242): a, c, t, g, unknown or other
  misc_feature (168)..(242): n is a, c, g, or t
tcagacgagtgcgtcacgaccggtgctcgatttagtatgctagtatcgcgggggggtnttcggcggagggaccaaactgaccgtcctaggtcagcccaaggctgcccctggtcactctgttcccgcctcctntactgctagtctgancgggctggcaaggcgcatagnnnnnnnnnnnnnnnnnnnnnnnnnnnnnnnnnnnnnnnnnnnnnnnnnnnnnnnnnnnnnnnnnnnnnnnnnnn

SEQ ID NO: 87770 - DNA, 188 bp, Homo sapiens
  misc_feature: GYAE6OF02I2JR0.1.89.I01.1.454.CMB.1.raw
  modified_base (188)..(188): a, c, t, g, unknown or other
  misc_feature (188)..(188): n is a, c, g, or t
tcagacgagtgcgtcacgaccggtgctcgatttagtatgctagtatgggatggccacctgagtggtctttgggtgttcggcggggggaccaagctgaccgtcctaggtcagcccaaggctgccccctcggtcactctgttcccgccatctgatctctcgactctgagcgggctggcaaggcgcatagn

SEQ ID NO: 87771 - DNA, 212 bp, Homo sapiens
  misc_feature: GYAE6OF02ISZIF.1.89.I01.1.454.CMB.1.raw
  modified_base (173)..(212): a, c, t, g, unknown or other
  misc_feature (173)..(212): n is a, c, g, or t
tcagacgagtgcgtcacgaccggtgctcgatttagtatgctagtatcggcgggggggtgttcggcggagggaccaaactgaccggtcctaggtcagcccaaggctgccccctcggtcactctgttcccaccctcctcatagcgtactctgagcgggctggcaaggcgcatagnnnnnnnnnnnnnnnnnnnnnnnnnnnnnnnnnnnnnnnn

SEQ ID NO: 87772 - DNA, 170 bp, Homo sapiens; identical to SEQ ID NO: 86381
  misc_feature: GYAE6OF02GAXRU.1.89.I01.1.454.CMB.1.raw
  modified_base (170)..(170): a, c, t, g, unknown or other
  misc_feature (170)..(170): n is a, c, g, or t

SEQ ID NO: 87773 - DNA, 195 bp, Homo sapiens
  misc_feature: GYAE6OF02I7P5V.1.89.I01.1.454.CMB.1.raw
  modified_base (170)..(195): a, c, t, g, unknown or other
  misc_feature (170)..(195): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagctactctgagcgggctggcaaggcgcatagnnnnnnnnnnnnnnnnnnnnnnnnnn

SEQ ID NO: 87774 - DNA, 543 bp, Homo sapiens
  misc_feature: GYAE6OF02GB7X9.1.89.I01.1.454.CMB.1.raw
  modified_base (196)..(196): a, c, t, g, unknown or other
  misc_feature (196)..(196): n is a, c, g, or t
  modified_base (431)..(431): a, c, t, g, unknown or other
  misc_feature (431)..(431): n is a, c, g, or t
  modified_base (536)..(536): a, c, t, g, unknown or other
  misc_feature (536)..(536): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatacatccaacagggccactggcatcccagccaggttcagtggcaggtgggtctgggacaggcttcactctcaccatcagcagcctagacgcctagaagtattttgacttagttttattacgttgttacagtcagtcgtanacaactggcctctctacgtttccggcccgttgggaacctaaggtcgaattactaccgaaacgtaacgtggtcggactcgacctacacgttcctcgttccttaccncttcccg

SEQ ID NO: 87775 - DNA, 184 bp, Homo sapiens
  misc_feature: GYAE6OF02HQM1Q.1.89.I01.1.454.CMB.1.raw
  modified_base (59)..(59): a, c, t, g, unknown or other
  misc_feature (59)..(59): n is a, c, g, or t
  modified_base (172)..(184): a, c, t, g, unknown or other
  misc_feature (172)..(184): n is a, c, g, or t
tcagacgagtgcgtcacgaccggtgctcgatttagtatgctagtatcggcgggggggtnttcggcggagggaccaaactgaccgtcctaggtcagcccaaggctgccccctcggtcactctgttcccaccctcctctactgctagtctgagcggctggcaaggcgtcatagnnnnnnnnnnnnn

SEQ ID NO: 87776 - DNA, 183 bp, Homo sapiens
  misc_feature: GYAE6OF02IQVFI.1.89.I01.1.454.CMB.1.raw
  modified_base (170)..(183): a, c, t, g, unknown or other
  misc_feature (170)..(183): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctctactgctagtctgagcgggctggcaaggcgcatagnnnnnnnnnnnnnn

SEQ ID NO: 87777 - DNA, 258 bp, Homo sapiens
  misc_feature: GYAE6OF02G65S5.1.89.I01.1.454.CMB.1.raw
  modified_base (254)..(258): a, c, t, g, unknown or other
  misc_feature (254)..(258): n is a, c, g, or t
tcagacgagtgcgtcacgaccggtgctcgatttagtatgctagtatcgcggggacaaagctgccctgaccctctcgggtgcgcagcctgacgatgaggctgactattactgcttcctctcctggcacggtgctctgccggcgttcggcggagggaccaaggtgatcgtcctaagtcagcccaaggctgcccctcggtcactctgttcccgccatctgaatagcgtactctgagcgggctggcaaggcgcatagnnnnn

SEQ ID NO: 87778 - DNA, 167 bp, Homo sapiens
  misc_feature: GYAE6OF02F9KJV.1.89.I01.1.454.CMB.1.raw
  modified_base (166)..(167): a, c, t, g, unknown or other
  misc_feature (166)..(167): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctactgctagtctgagcgggctggcaaggcgcatagnn

SEQ ID NO: 87779 - DNA, 171 bp, Homo sapiens; identical to SEQ ID NO: 86935
  misc_feature: GYAE6OF02FPROI.1.89.I01.1.454.CMB.1.raw
  modified_base (171)..(171): a, c, t, g, unknown or other
  misc_feature (171)..(171): n is a, c, g, or t

SEQ ID NO: 87780 - DNA, 350 bp, Homo sapiens
  misc_feature: GYAE6OF02HIWWR.1.89.I01.1.454.CMB.1.raw
  modified_base (344)..(350): a, c, t, g, unknown or other
  misc_feature (344)..(350): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggccaccctcctccaagacgcacctctgggggcacacgcggccctgggctgcctggtcaaggactactccgagtgcgtctctgagcgggctggcaggcgcatgnnnnnnn

SEQ ID NO: 87781 - DNA, 244 bp, Homo sapiens
  misc_feature: GYAE6OF02F54DB.1.89.I01.1.454.CMB.1.raw
  modified_base (241)..(244): a, c, t, g, unknown or other
  misc_feature (241)..(244): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggccaaccccactgtcactctgttcccgccctcctctcgtagccactctgagcgggctggcaaggcgcatagnnnn

SEQ ID NO: 87782 - DNA, 171 bp, Homo sapiens
  misc_feature: GYAE6OF02FHMUQ.1.89.I01.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccgccctcctcgagtgcgtctctgagcgggctggcaaggcgcatagnnn

SEQ ID NO: 87783 - DNA, 175 bp, Homo sapiens
  misc_feature: GYAE6OF02H3Z5Q.1.89.I01.1.454.CMB.1.raw
  modified_base (171)..(175): a, c, t, g, unknown or other
  misc_feature (171)..(175): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctgtcgagcgtctgagcgggctggcaaggcgcatagnnnnn

SEQ ID NO: 87784 - DNA, 224 bp, Homo sapiens
  misc_feature: GYAE6OF02HWN21.1.89.I01.1.454.CMB.1.raw
  modified_base (169)..(224): a, c, t, g, unknown or other
  misc_feature (169)..(224): n is a, c, g, or t
tcagacgagtgcgtcacgaccggtgctcgatttagtatgctagtatcgcgggggggtgttcggcggagggaccaaactgaccgtcctaggtcagcccaaggctgcccctggtcactctgttcccgccctcctctactgctagtctgagcgggctggcaaggcgcatagnnnnnnnnnnnnnnnnnnnnnnnnnnnnnnnnnnnnnnnnnnnnnnnnnnnnnnnn

SEQ ID NO: 87785 - DNA, 173 bp, Homo sapiens; identical to SEQ ID NO: 86614
  misc_feature: GYAE6OF02G564G.1.89.I01.1.454.CMB.1.raw
  modified_base (170)..(173): a, c, t, g, unknown or other
  misc_feature (170)..(173): n is a, c, g, or t

SEQ ID NO: 87786 - DNA, 170 bp, Homo sapiens
  misc_feature: GYAE6OF02I4YCC.1.89.I01.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcacgtagcgtgctgagcgggctggcaaggcgcatagn

SEQ ID NO: 87787 - DNA, 220 bp, Homo sapiens
  misc_feature: GYAE6OF02H9ARQ.1.89.I01.1.454.CMB.1.raw
  modified_base (57)..(57): a, c, t, g, unknown or other
  misc_feature (57)..(57): n is a, c, g, or t
  modified_base (167)..(220): a, c, t, g, unknown or other
  misc_feature (167)..(220): n is a, c, g, or t
tcagacgagtgcgtcacgaccggtgctcgatttagtatgctagtatcgcggggggtnttcggcggagggaccaaactgaccgtcctaggtcagcccaaggctgcccctcggtcactctgttcccgcctcctctactgctagtctgagcggctggcaaggcgcatagnnnnnnnnnnnnnnnnnnnnnnnnnnnnnnnnnnnnnnnnnnnnnnnnnnnnnn

SEQ ID NO: 87788 - DNA, 171 bp, Homo sapiens; identical to SEQ ID NO: 86783
  misc_feature: GYAE6OF02FLCQC.1.89.I01.1.454.CMB.1.raw
  modified_base (171)..(171): a, c, t, g, unknown or other
  misc_feature (171)..(171): n is a, c, g, or t

SEQ ID NO: 87789 - DNA, 204 bp, Homo sapiens
  misc_feature: GYAE6OF02GTWDK.1.89.I01.1.454.CMB.1.raw
  modified_base (174)..(204): a, c, t, g, unknown or other
  misc_feature (174)..(204): n is a, c, g, or t
tcagacgagtgcgtcacgaccggtgctcgatttagtatgctagtatcggcgggggggtgttcggcggagggacctaaactgaccgtcctaggtcagcccaaggctgccccctcggtcactctgttcccaccctcctcgacgtagcgtgctgagcgggctggcaaggcgcatagnnnnnnnnnnnnnnnnnnnnnnnnnnnnnnn

SEQ ID NO: 87790 - DNA, 182 bp, Homo sapiens
  misc_feature: GYAE6OF02JCK7S.1.89.I01.1.454.CMB.1.raw
  modified_base (169)..(182): a, c, t, g, unknown or other
  misc_feature (169)..(182): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctcatagctactctgagcgggctggcaaggcgcatagnnnnnnnnnnnnnn

SEQ ID NO: 87791 - DNA, 381 bp, Homo sapiens
  misc_feature: GYAE6OF02H679Z.1.89.I01.1.454.CMB.1.raw
  modified_base (371)..(381): a, c, t, g, unknown or other
  misc_feature (371)..(381): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaagggacagcagcctccaccaacgggcccatcggtccttcccccgtggccaccctcctccaagacgccacctcgtcgggggcacgacggccggccccgtggggcctcggccgtcggtacaacggtacttacgttccgagtcgcgtctcgtgagcggctggcaaggcgcatagnnnnnnnnnnn

SEQ ID NO: 87792 - DNA, 173 bp, Homo sapiens
  misc_feature: GYAE6OF02F73UK.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcgggctggcaaggcgcatagnnnn

SEQ ID NO: 87793 - DNA, 662 bp, Homo sapiens
  misc_feature: GYAE6OF02JIOQE.1.89.I01.1.454.CMB.1.raw
  modified_base (384)..(384): a, c, t, g, unknown or other
  misc_feature (384)..(384): n is a, c, g, or t
  modified_base (489)..(489): a, c, t, g, unknown or other
  misc_feature (489)..(489): n is a, c, g, or t
tcagacgagtgcgtcacgaccggtgctcgatttagtatgctagtatcgcgggggggtcgtcgaggaggcgagcgctctcaggacatctccaccatcggcctgggctctgctgctcctcaccctcctcacctcgacgggcacaggtgaccgcctccgaggggaaggggcttcgagggacctcgtgggctggatccgttggtcctcctgctacctcgaggcctcgaccggggcccagccactgacctcactggcagtgtcgttttcccccttctttccagcgtccgtgggccctagtctcgccctgactcagcctcgccttcgtcgtccgtgggtcctccgtggactggtcactccactctcctccgtgacctagtaccggaaccncgcgagttgtacggttgggttacggttatcggaacctttgtacgttccgtaccgtacgtaaccaactacgtcccgaaccgtggaacctaacgcccgtagtacccncgtatgttaactacgtacgtacggtctaggtcctacgtccggtcccttacgggtacggttttaaccacgttcccgttacgtttaccgtcggttccggtacctacccggtacggttacgttacggaccccgttaaccggacccgtttccccgtaccgttaccgaccccgttacg

SEQ ID NO: 87794 - DNA, 169 bp, Homo sapiens
  misc_feature: GYAE6OF02HVPJL.1.89.I01.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtatgctagtatcgcgggggggtgttcggcggagggaccaaactgaccgtcctaggtcagcccaaggctgcccctcggtcactctgttcccaccctccctgtcgagcgtctgagcgggctggcaaggcgcatagn

SEQ ID NO: 87795 - DNA, 172 bp, Homo sapiens
  misc_feature: GYAE6OF02HRFTT.1.89.I01.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 87796 - DNA, 175 bp, Homo sapiens
  misc_feature: GYAE6OF02G5ITQ.1.89.I01.1.454.CMB.1.raw
  modified_base (172)..(175): a, c, t, g, unknown or other
  misc_feature (172)..(175): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccatctgaatagcgtactctgagcgggctgggcaaggcgcatagnnnn

SEQ ID NO: 87797 - DNA, 523 bp, Homo sapiens
  misc_feature: GYAE6OF02GQJUX.1.89.I01.1.454.CMB.1.raw
  modified_base (441)..(441): a, c, t, g, unknown or other
  misc_feature (441)..(441): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacagagtcctgggcccagtctgccctgactcagcctgcctccgtgtctgggtctcctggacagtcgatcaccatctcctgcactggaaccagcagtgacgttggtggttatgactatgtctcctggtaccaacatcacccaggcaaaggccccagactcatgatttatgaggtcagtcatcggccctcaggggttctaatcgcttctctgctccaagtctggccaacgaccgcctccctcgaccatctctcgccctccgaggctggacggacggaggtctgactttattactgcagctcatatacaancagtagactagtacggttttcggacgtaacgggaaccaaggcgtacggtaccgtaccgttacggacgtacgcccgtaaccgg

SEQ ID NO: 87798 - DNA, 350 bp, Homo sapiens
  misc_feature: GYAE6OF02FNFT7.1.89.I01.1.454.CMB.1.raw
  modified_base (223)..(223): a, c, t, g, unknown or other
  misc_feature (223)..(223): n is a, c, g, or t
  modified_base (325)..(325): a, c, t, g, unknown or other
  misc_feature (325)..(325): n is a, c, g, or t
  modified_base (332)..(350): a, c, t, g, unknown or other
  misc_feature (332)..(350): n is a, c, g, or t
tcagacgagtgcgtcacgaccggtgctcgatttagtatgctagtatcgcgggctcctcatttttgacaatgataaacgaccctcaggaatttctgaccgattctctggctccaaagtctggcctgtcagcctccctgggcatcaccggactccaaactggggacgtaggccgattattactgcgagacatgggatagtaacttgaatgttgggcgattcgggnggagggaccaagttgaccgtctaggtcagcccaaggcccaaacccactgtcactctgttcccaccctccttcctcgtctctactgagcggctggcaagggcncagtagnnnnnnnnnnnnnnnnnnn

SEQ ID NO: 87799 - DNA, 677 bp, Homo sapiens
  misc_feature: GYAE6OF02HX36F.1.89.I01.1.454.CMB.1.raw
  modified_base (58)..(58): a, c, t, g, unknown or other
  misc_feature (58)..(58): n is a, c, g, or t
  modified_base (180)..(180): a, c, t, g, unknown or other
  misc_feature (180)..(180): n is a, c, g, or t
  modified_base (182)..(183): a, c, t, g, unknown or other
  misc_feature (182)..(183): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagacgagtgcgtcacgaccggtgctcgatttagtatgctagtatcggcggggggtnttcggcggaggaccaaactgaccgtcctaggtcagcccaaggcctgccccctggtcactctcgttcccgcctcctcgtactgctacgtctcgagccgggctggtacaaggcgtcagtacgcncnncnctntcgcgtctacgngcgtcgcncgtacnctcgcgtcgacgtcagcgtacgcgttacgcgtactccggtagtcgtaccgacgtacgtcgtacgacgtacgccgtagtacgtacgtacgccgtacgtacgtaccgtcgtacgtacgtcgtaccgcgtaaccgtacggtacgtccgtcgtaccgcgtaccgtacgtacgcgttaacgtgtaccggtcgtacgtcggtacgtcgtacgtacggtaccacggtntaaccgcggtacttccgngtacggtctaccacggtctaccgtacgtcgtacgtacgtcgtagttacggtacgtacgttacgtacgtacgtcgttacgtacgtcgtacgtaccgtacgttaacgtacgtacgtacgtaccgtacgtaccgtacgtacgtaccgtaggaccgtacgggacccgtacggacgtaccggtccgtacgtaccgacgtcggacctccgtaacgtaccgtcgtcgaacg

SEQ ID NO: 87800 - DNA, 212 bp, Homo sapiens
  misc_feature: GYAE6OF02G33A4.1.89.I01.1.454.CMB.1.raw
  modified_base (59)..(59): a, c, t, g, unknown or other
  misc_feature (59)..(59): n is a, c, g, or t
  modified_base (173)..(212): a, c, t, g, unknown or other
  misc_feature (173)..(212): n is a, c, g, or t
tcagacgagtgcgtcacgaccggtgctcgatttagtatgctagtatcgcggggggggtnttcggcggagggaccaaactgaccgtcctaggtcagcccaaggctgccccctggtcacgtctgttcccaccctcctcatagccgtactctgagcgggctggcaaggcgcatagnnnnnnnnnnnnnnnnnnnnnnnnnnnnnnnnnnnnnnnn

SEQ ID NO: 87801 - DNA, 173 bp, Homo sapiens
  misc_feature: GYAE6OF02GGDIU.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctgtcgagcgtctgagcgggctggcaaggcgcatagnnn

SEQ ID NO: 87802 - DNA, 197 bp, Homo sapiens
  misc_feature: GYAE6OF02G6YCN.1.89.I01.1.454.CMB.1.raw
  modified_base (171)..(197): a, c, t, g, unknown or other
  misc_feature (171)..(197): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttccccaccctcctcacgtctactgctgagccgggctggcaaggcgcatagnnnnnnnnnnnnnnnnnnnnnnnnnnn

SEQ ID NO: 87803 - DNA, 174 bp, Homo sapiens; identical to SEQ ID NO: 86688
  misc_feature: GYAE6OF02HHXOX.1.89.I01.1.454.CMB.1.raw
  modified_base (171)..(174): a, c, t, g, unknown or other
  misc_feature (171)..(174): n is a, c, g, or t

SEQ ID NO: 87804 - DNA, 172 bp, Homo sapiens
  misc_feature: GYAE6OF02FT0RM.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcacgtagcgtgctgagcgggctggcaaggcgcatagnn

SEQ ID NO: 87805 - DNA, 208 bp, Homo sapiens
  misc_feature: GYAE6OF02IVVI4.1.89.I01.1.454.CMB.1.raw
  modified_base (56)..(56): a, c, t, g, unknown or other
  misc_feature (56)..(56): n is a, c, g, or t
  modified_base (166)..(208): a, c, t, g, unknown or other
  misc_feature (166)..(208): n is a, c, g, or t
tcagacgagtgcgtcacgaccggtgctcgatttagtatgctagtatcgcgggggtnttcggcggagggaccaaactgaccgtcctaggtcagcccaaggctgcccctggtcactctgttcccgcctcctcgtactgctagtctgagcggctggcaaggcgcatagnnnnnnnnnnnnnnnnnnnnnnnnnnnnnnnnnnnnnnnnnnn

SEQ ID NO: 87806 - DNA, 237 bp, Homo sapiens
  misc_feature: GYAE6OF02G5C8B.1.89.I01.1.454.CMB.1.raw
  modified_base (57)..(57): a, c, t, g, unknown or other
  misc_feature (57)..(57): n is a, c, g, or t
  modified_base (167)..(237): a, c, t, g, unknown or other
  misc_feature (167)..(237): n is a, c, g, or t
tcagacgagtgcgtcacgaccggtgctcgatttagtatgctagtatcgcggggggtnttcggcggagggaccaaactgaccgtcctaggtcagcccaaggctgcccctggtcactctgttcccaccctcctctactgctagtctgagcgggctggcaaggcgcatgnnnnnnnnnnnnnnnnnnnnnnnnnnnnnnnnnnnnnnnnnnnnnnnnnnnnnnnnnnnnnnnnnnnnnnn

SEQ ID NO: 87807 - DNA, 177 bp, Homo sapiens
  misc_feature: GYAE6OF02F3DAT.1.89.I01.1.454.CMB.1.raw
  modified_base (170)..(177): a, c, t, g, unknown or other
  misc_feature (170)..(177): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagnnnnnnnn

SEQ ID NO: 87808 - DNA, 619 bp, Homo sapiens
  misc_feature: GYAE6OF02FQZ7G.1.89.I01.1.454.CMB.1.raw
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (209)..(210): a, c, t, g, unknown or other
  misc_feature (209)..(210): n is a, c, g, or t
  modified_base (212)..(216): a, c, t, g, unknown or other
  misc_feature (212)..(216): n is a, c, g, or t
  modified_base (219)..(222): a, c, t, g, unknown or other
  misc_feature (219)..(222): n is a, c, g, or t
  modified_base (226)..(228): a, c, t, g, unknown or other
  misc_feature (226)..(228): n is a, c, g, or t
  modified_base (236)..(236): a, c, t, g, unknown or other
  misc_feature (236)..(236): n is a, c, g, or t
  modified_base (238)..(238): a, c, t, g, unknown or other
  misc_feature (238)..(238): n is a, c, g, or t
  modified_base (261)..(262): a, c, t, g, unknown or other
  misc_feature (261)..(262): n is a, c, g, or t
  modified_base (357)..(357): a, c, t, g, unknown or other
  misc_feature (357)..(357): n is a, c, g, or t
tcagacgagtgcgtcacgaccggtgctcgatttagtatgctagtaatcggcgggggggtgggttcggcggagggacccaaactgaccgtcctaggtcagcccaagggctgccccctgggtccactctgttcccacccttcgtcactagcgtactctgaggccgggcctagggcaacggacgtcatagntcngncgcngtctctcactgnngnnnnngannnncacnnnctcgcgcngngtagtatatagtgtgtcgtgtannagacacgaacgagaacgtacctaacctctatatactacgtacgtcgttactacttagaggtaggtcggttccgtacgtacgtagtacgtagacgngtgtagtcgtacgtacgtacgtacgtacctaccgtacacgtcgtacgaccgtacgtcgtcgacgtacgtacgtacgtagtactacgtacgtaacgtacttacttacgtacgtactaactaactaactacttacttacgtacgtacggtacgtacgtacgtaccgaacggtaacggtaacggtaagtaacgtaacgtacgtcgtacgtacgtacgtactacgtacgttacgttacgttacttacgtaccttaccgtaccgtcc

SEQ ID NO: 87809 - DNA, 173 bp, Homo sapiens; identical to SEQ ID NO: 87801
  misc_feature: GYAE6OF02G8P3T.1.89.I01.1.454.CMB.1.raw
  modified_base (171)..(173): a, c, t, g, unknown or other
  misc_feature (171)..(173): n is a, c, g, or t

SEQ ID NO: 87810 - DNA, 173 bp, Homo sapiens; identical to SEQ ID NO: 86733
  misc_feature: GYAE6OF02HIKEL.1.89.I01.1.454.CMB.1.raw
  modified_base (171)..(173): a, c, t, g, unknown or other
  misc_feature (171)..(173): n is a, c, g, or t

SEQ ID NO: 87811 - DNA, 172 bp, Homo sapiens
  misc_feature: GYAE6OF02HU6Q5.1.89.I01.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctcgtactgcgctgagcgggctggcaaggcgcatagnn

SEQ ID NO: 87812 - DNA, 174 bp, Homo sapiens
  misc_feature: GYAE6OF02IZS4M.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctactgctagtctgagcgggctggcaaggcgcatagnnnn

SEQ ID NO: 87813 - DNA, 165 bp, Homo sapiens
  misc_feature: GYAE6OF02GG0B0.1.89.I01.1.454.CMB.1.raw
  modified_base (165)..(165): a, c, t, g, unknown or other
  misc_feature (165)..(165): n is a, c, g, or t
tcagacgagtgcgtcacgaccggtgctcgatttagtatgctagtaagggggtgttcggcggagggaccaagctgaccgtcctaggtcagcccaaggctgcccctcggtcactctgttcccaccctcctcacgcactcgtctgagcgggctggcaaggcgcatagn

SEQ ID NO: 87814 - DNA, 353 bp, Homo sapiens
  misc_feature: GYAE6OF02IR4ZZ.1.89.I01.1.454.CMB.1.raw
  modified_base (346)..(353): a, c, t, g, unknown or other
  misc_feature (346)..(353): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctcaccaaggcccatcggtcttccccctggccaccctcctccaagacgcacctctgggggcacagcggccctgggctgcctggtcaaggacctacttcctcgtagcactctgacgcgggctggcaaggcgcatagnnnnnnnn

SEQ ID NO: 87815 - DNA, 547 bp, Homo sapiens
  misc_feature: GYAE6OF02F89ZU.1.89.I01.1.454.CMB.1.raw
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccaggggaaggggcttcagggacctctgggctgatccttggtctcctgctcctcaggctcgaccggggcccagcactgactcactggcatgtgtttcctcccttctttccagtacgtccgtgggccccagtcctcgccctgacctcacgcctgcctcgtgtcgtgggtctccgtggacagtcgatcaccntcctctgcacgtcggaaccngcagtgacgttggtgttatgactatgtctccgtgtaccaacactccaccgaggaccaacggcccagactcatgtatttagtgtagtctagtcagtccggtccttcgtacgggtttactacgtcgtcttcgtcgtcgtcctaccgtaacgttcgtacggaccaccgtaccggtccctcccgtcgtacctacg

SEQ ID NO: 87816 - DNA, 316 bp, Homo sapiens
  misc_feature: GYAE6OF02F4P7D.1.89.I01.1.454.CMB.1.raw
  modified_base (262)..(264): a, c, t, g, unknown or other
  misc_feature (262)..(264): n is a, c, g, or t
  modified_base (266)..(266): a, c, t, g, unknown or other
  misc_feature (266)..(266): n is a, c, g, or t
  modified_base (268)..(316): a, c, t, g, unknown or other
  misc_feature (268)..(316): n is a, c, g, or t
tcagacgagtgcgtcacgaccggtgctcgattttagtatgctagtatcggtcggggaccatctctgggactccaggctgaggacgaggcttgattattttctgcaggctcatactacaaccaggccagcctaccgaaagtcttcggaactgggaccagggtcacccgtcctaggtcagcccaaggccaaccccactgtccactctgttcccaccctctcacgcactcgtctagacgcgggctcggctaagggcgcagtacgnnncngnnnnnnnnnnnnnnnnnnnnnnnnnnnnnnnnnnnnnnnnnnnnnnnnn

SEQ ID NO: 87817 - DNA, 174 bp, Homo sapiens; identical to SEQ ID NO: 87097
  misc_feature: GYAE6OF02G2B0D.1.89.I01.1.454.CMB.1.raw
  modified_base (172)..(174): a, c, t, g, unknown or other
  misc_feature (172)..(174): n is a, c, g, or t

SEQ ID NO: 87818 - DNA, 171 bp, Homo sapiens
  misc_feature: GYAE6OF02HQZNJ.1.89.I01.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccgccctcctctcgtactgcgctgagcgggctggcaaggcgcatagnn

SEQ ID NO: 87819 - DNA, 653 bp, Homo sapiens
  misc_feature: GYAE6OF02IDEQ1.1.89.I01.1.454.CMB.1.raw
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
tcagacgagtgcgtcacgaccggtgctcgatttagtatgctagtatcgcgggggggggtctcaggaggcagcgctctcaggacatctccaccatggcctgggctctgctgctcctcacctcctcactcagggcacaggtgacgcctcgaggggaaggggcttcgagggcctcgtgggctgatcctggtctcctgcctctcaggtcctcgaccggggccagccactgactcacgtggcnttgtgtttcnccttcttaccagcgtcctgggccctggtctcggccctgactcacgcctcgccttccggtgtcgtcgggtcctccgtcggactcgtacgactaccacctcttcctccgtgactaccgtaggaccctagtcgagtcggacggtttcggttaggtatcggaacttgtcgttccgtaccgttacggtaacccaacttaccaccgaacccgtaaggaacccgaaaacggccccgtaaacggcctaactaacgttacgtagtttaacggttacgaacgggttacgtacgtaccgtacgtacccggtacccgttcgggttaacggtttacgaaccgtttcgtccgttacgtccgttcggtaccttaccgtacgtactcggaccaacggtccgttccacccgtgaaccttccg

SEQ ID NO: 87820 - DNA, 189 bp, Homo sapiens
  misc_feature: GYAE6OF02HSYZZ.1.89.I01.1.454.CMB.1.raw
  modified_base (145)..(145): a, c, t, g, unknown or other
  misc_feature (145)..(145): n is a, c, g, or t
  modified_base (170)..(189): a, c, t, g, unknown or other
  misc_feature (170)..(189): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactntgagcgggctggcaaggcgcatagnnnnnnnnnnnnnnnnnnnn

SEQ ID NO: 87821 - DNA, 177 bp, Homo sapiens
  misc_feature: GYAE6OF02FN5P1.1.89.I01.1.454.CMB.1.raw
  modified_base (170)..(177): a, c, t, g, unknown or other
  misc_feature (170)..(177): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctcacgtagcgtgctgagcgggctggcaaggcgcatagnnnnnnnn

SEQ ID NO: 87822 - DNA, 620 bp, Homo sapiens
  misc_feature: GYAE6OF02HM7GR.1.89.I01.1.454.CMB.1.raw
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccgaggggaaggggcttcgagggacctcgtgggctgactccgttggtcctcctgcctcctcgaggcctccgacccggggccagcactgactcactggcattgtcgtttcctcccttcttccgagtacgtcccgtcgggcccagtcctcgcccctgacctcacgtccctcgtcccttcggtgtccgtcgggtcctcgtggacngtcgatccactntcctcngacctacgtcgaacngcgtagtggtacgtttggtagttangtacttntcgtcctcgtacgtaaccactactaccaccgacgaaccgaaaccggcccaagtacctacgtagtacgttaagtttagtacggtacgttacacgtccgtacggtcccggtcccgttagggttacggttactacgtcgtcttcgttcggtcgtcctacgtaacgttccggtacgaccgaaccggtcccgtccgtcccgtacgacctacg

SEQ ID NO: 87823 - DNA, 661 bp, Homo sapiens
  misc_feature: GYAE6OF02F2WWQ.1.89.I01.1.454.CMB.1.raw
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccgaggggaaggggcttcgagggacctcgtgggctgatccttggtctctgcctcctcaggctcgacccgggcccagcactgacctcacgtggctatgttgttttcctcccttctttccgagtacgtccgtcgggccctagtcctcgccctgactcacgcctcgcctcgtcgtcgtcgggtctcgtggacngtcgatcacctntcctccngcaccgtcggaaaccncggacgtaggtcggtacggtttggtaggttagtcgtacttagttcgttcctccggtacgtaaccaactactaccgaacccgacggtaacccgaaaccggtcccctaagcccttacgacgttagttaagtttagacggtaacggtcgtagtccgtacggttccccggaccgttaacggttacggttttactacgttccgtctttacgttcggttccggtacccttaccggtaacggttccgtaacggaccctaaacccggtcccgtaccccgtccgtaccggaccttaccg

SEQ ID NO: 87824 - DNA, 171 bp, Homo sapiens; identical to SEQ ID NO: 86695
  misc_feature: GYAE6OF02GD3LH.1.89.I01.1.454.CMB.1.raw
  modified_base (171)..(171): a, c, t, g, unknown or other
  misc_feature (171)..(171): n is a, c, g, or t

SEQ ID NO: 87825 - DNA, 189 bp, Homo sapiens
  misc_feature: GYAE6OF02GNGD8.1.89.I01.1.454.CMB.1.raw
  modified_base (59)..(59): a, c, t, g, unknown or other
  misc_feature (59)..(59): n is a, c, g, or t
  modified_base (175)..(189): a, c, t, g, unknown or other
  misc_feature (175)..(189): n is a, c, g, or t
tcagacgagtgcgtcacgaccggtgctcgatttagtatgctagtatcgcggggggggtnttcggcggagggaccaaactgaccgtcctaggtcagcccaaggctgcccccctcggtcactctgttcccaccctcctccgtgtctgactctgagccgggctggcaaggcgcatagnnnnnnnnnnnnnnn

SEQ ID NO: 87826 - DNA, 173 bp, Homo sapiens
  misc_feature: GYAE6OF02HFKK7.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcgagtgcgtctctgagcgggctggcaaggcgcatagnnn

SEQ ID NO: 87827 - DNA, 188 bp, Homo sapiens; identical to SEQ ID NO: 86724
  misc_feature: GYAE6OF02HCLN5.1.89.I01.1.454.CMB.1.raw
  modified_base (187)..(188): a, c, t, g, unknown or other
  misc_feature (187)..(188): n is a, c, g, or t

SEQ ID NO: 87828 - DNA, 199 bp, Homo sapiens
  misc_feature: GYAE6OF02GQ8RW.1.89.I01.1.454.CMB.1.raw
  modified_base (172)..(199): a, c, t, g, unknown or other
  misc_feature (172)..(199): n is a, c, g, or t
tcagacgagtgcgtcacgaccggtgctcgatttagtatgctagtatcgcgggggggtgttcggcggagggacctaaactgaccgtcctaggttcagcccaaggctgccccctcggtcactctgttcccaccctcctccgtgtctgatctgagcgggctggcaaggcgcatgnnnnnnnnnnnnnnnnnnnnnnnnnnnn

SEQ ID NO: 87829 - DNA, 174 bp, Homo sapiens
  misc_feature: GYAE6OF02JZ55A.1.89.I01.1.454.CMB.1.raw
  modified_base (168)..(174): a, c, t, g, unknown or other
  misc_feature (168)..(174): n is a, c, g, or t
tcagacgagtgcgtcacgaccggtgctcgatttagtatgctagtatcgcggggggtgttcggcggagggaccaaactgaccgtcctaggtcagccaaggctgccccctggtcactctgttcccgccctcctctactgctagtctgagcgggctggcaaggcgcatagnnnnnnn

SEQ ID NO: 87830 - DNA, 173 bp, Homo sapiens; identical to SEQ ID NO: 86554
  misc_feature: GYAE6OF02GXZ24.1.89.I01.1.454.CMB.1.raw
  modified_base (171)..(173): a, c, t, g, unknown or other
  misc_feature (171)..(173): n is a, c, g, or t

SEQ ID NO: 87831 - DNA, 759 bp, Homo sapiens
  misc_feature: GYAE6OF02JI2U9.1.89.I01.1.454.CMB.1.raw
tcagacgagtgcgtcacgaccggtgctcgatttagtatgctagtatcgcggggggggtctcaggaggcagcgctctcaggacatctccaccatggcctggctctgctgctcctcaccctcctcactcgagggcacgaggtgaccgcctccgaggggaaggggcttacgacgggacctcgtgggctgacttccgttggtcctccgtgcctcctcgacggcctaccggacccgggccagccacgtcgacctcacgtggcagttcggttcgtttcctcccttctttccaggtcgttccgtcgggaccctaggttcctcgccctagacctccacgtccctcgtcccttccggttcgtccggttcgggttcctccgtggaactaggtccgactaccacctattccctctcggacctaacgtaccggaaccaggtacgtaggttacggttacggtttggggttagttaacgtcgtaacttgttccgttccgttaccgttacgggtaaacccctaactaccgttacccgaacccggtaacggaacccgaaacccggtcccctaaggtacccttacgtaacgttacgttaacttttacggacgggtaacggttacctaccggttaccttaccggttccccgggttaccgtttaacgggttacgggttttacctaacgttcccgttacgttccgtacgttcggtacccttaacgtaacggttccgtacggaccctaccggtcccgtacccgtccgtacgtacctaccg

SEQ ID NO: 87832 - DNA, 174 bp, Homo sapiens; identical to SEQ ID NO: 86914
  misc_feature: GYAE6OF02GX7DA.1.89.I01.1.454.CMB.1.raw
  modified_base (170)..(174): a, c, t, g, unknown or other
  misc_feature (170)..(174): n is a, c, g, or t

SEQ ID NO: 87833 - DNA, 174 bp, Homo sapiens
  misc_feature: GYAE6OF02I4ZSH.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctccgtgtctgatctgaggcgggctggcaaggcgcatagnnnn

SEQ ID NO: 87834 - DNA, 174 bp, Homo sapiens
  misc_feature: GYAE6OF02G6ZI1.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctgtcgagcgtctgagcgggctggcaaggcgcatagnnnn

SEQ ID NO: 87835 - DNA, 204 bp, Homo sapiens
  misc_feature: GYAE6OF02I2TTC.1.89.I01.1.454.CMB.1.raw
  modified_base (190)..(204): a, c, t, g, unknown or other
  misc_feature (190)..(204): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggcccaaccccactgtcactctgttccccgcccctcctctatgtatactctgaggcgggctggcaggcgcatagnnnnnnnnnnnnnnn

SEQ ID NO: 87836 - DNA, 177 bp, Homo sapiens
  misc_feature: GYAE6OF02JJX4S.1.89.I01.1.454.CMB.1.raw
  modified_base (171)..(177): a, c, t, g, unknown or other
  misc_feature (171)..(177): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcacgtctactgctgagcgggctggcaaggcgcatagnnnnnnn

SEQ ID NO: 87837 - DNA, 172 bp, Homo sapiens
  misc_feature: GYAE6OF02FPW13.1.89.I01.1.454.CMB.1.raw
  modified_base (169)..(172): a, c, t, g, unknown or other
  misc_feature (169)..(172): n is a, c, g, or t
tcagacgagtgcgtcacgaccggtgctcgatttagtatgctagtatcgcgggggtcttcggagctgggaccaaggtcaccgtcctaggtcagcccaaggccaaccccactgtcactctgttcccgccctcctcacgtctactgctgagcgggctggcaaggcgcatagnnnn

SEQ ID NO: 87838 - DNA, 172 bp, Homo sapiens; identical to SEQ ID NO: 86593
  misc_feature: GYAE6OF02JSONP.1.89.I01.1.454.CMB.1.raw
  modified_base (171)..(172): a, c, t, g, unknown or other
  misc_feature (171)..(172): n is a, c, g, or t

SEQ ID NO: 87839 - DNA, 180 bp, Homo sapiens
  misc_feature: GYAE6OF02GPEDW.1.89.I01.1.454.CMB.1.raw
  modified_base (170)..(180): a, c, t, g, unknown or other
  misc_feature (170)..(180): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcacgtagcgtgctgagcgggctggcaaggcgcatagnnnnnnnnnnn

SEQ ID NO: 87840 - DNA, 224 bp, Homo sapiens
  misc_feature: GYAE6OF02JJIG2.1.89.I01.1.454.CMB.1.raw
  modified_base (219)..(224): a, c, t, g, unknown or other
  misc_feature (219)..(224): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccaccctcctctagagacacgctgagcgggctggcaaggcgcatagnnnnnn

SEQ ID NO: 87841 - DNA, 185 bp, Homo sapiens
  misc_feature: GYAE6OF02JJ8JI.1.89.I01.1.454.CMB.1.raw
  modified_base (177)..(185): a, c, t, g, unknown or other
  misc_feature (177)..(185): n is a, c, g, or t
tcagacgagtgcgtcacgaccggtgctcgatttagtatgctagtatcgcggggggtgttcggcggagggaccaaactgaccgtcctaggtcagcccaaggctgcccctcggtcacctctcgttcccgccctcctcacgtacgcgtcgcgtagacggcggctggcaaggcgtacatgnnnnnnnnn

SEQ ID NO: 87842 - DNA, 173 bp, Homo sapiens; identical to SEQ ID NO: 87693
  misc_feature: GYAE6OF02IX3CH.1.89.I01.1.454.CMB.1.raw
  modified_base (171)..(173): a, c, t, g, unknown or other
  misc_feature (171)..(173): n is a, c, g, or t

SEQ ID NO: 87843 - DNA, 172 bp, Homo sapiens; identical to SEQ ID NO: 86723
  misc_feature: GYAE6OF02GIG2E.1.89.I01.1.454.CMB.1.raw
  modified_base (171)..(172): a, c, t, g, unknown or other
  misc_feature (171)..(172): n is a, c, g, or t

SEQ ID NO: 87844 - DNA, 188 bp, Homo sapiens
  misc_feature: GYAE6OF02FSNTT.1.89.I01.1.454.CMB.1.raw
  modified_base (174)..(188): a, c, t, g, unknown or other
  misc_feature (174)..(188): n is a, c, g, or t
tcagacgagtgcgtcacgaccggtgctcgatttagtatgctagtatcggcgggggggtgttcggcggagggaccaaacgtgaccgtcctaggtcagcccaaggctgcccccctcggtcactctgttcccgccctcctctactgctagtctgagcgggctggcaaggcgcatagnnnnnnnnnnnnnnn

SEQ ID NO: 87845 - DNA, 687 bp, Homo sapiens
  misc_feature: GYAE6OF02HNKLL.1.89.I01.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagacgagtgcgtcacgaccggtgctcgatttagtatgctagtatcggcgggggggtattcggcggagggacctaaacgtcgaccgtccgtaacggtcaggacccaacggctcgccccctggtcacttctcgttcccaccctcctctacgtgctacgtctgacggcgggactggcaaggcgacagtagcngcncntncngcncgngacgngacgctacgactcgcgcgacgacgcacgtacgactacgtacgtacacgacttacggcctacgtaccgacgacgtacgaaccgttacggccgaaccgtcggtaccacggtacgtccacgtacgtcgtaacgtccggtagtccaagttaaccgcgttaacggccgaacgtcgaaccgtcgacgccgtagaccgtggacgcgcggtacgtcgacgngtacganccgtttacncgtaacgacgtacgacgtagccgactcggtacgtacgtacgtcggtacgtagttactcgttcgttacttcgtagttacgtacgacgtacgtactacgtacgttacgcgtccgtacgtacggtcggtacggtaccggacggtacgtcggtaacgacgtacggttaaccggtagtcggtacggtacggtaccgtaaccgtaccgtacgtaccggttaccgttacggttaccgttaccgttaccgtaccg

SEQ ID NO: 87846 - DNA, 170 bp, Homo sapiens; identical to SEQ ID NO: 86730
  misc_feature: GYAE6OF02FNO1V.1.89.I01.1.454.CMB.1.raw
  modified_base (169)..(170): a, c, t, g, unknown or other
  misc_feature (169)..(170): n is a, c, g, or t

SEQ ID NO: 87847 - DNA, 229 bp, Homo sapiens
  misc_feature: GYAE6OF02HN2E8.1.89.I01.1.454.CMB.1.raw
  modified_base (57)..(57): a, c, t, g, unknown or other
  misc_feature (57)..(57): n is a, c, g, or t
  modified_base (162)..(162): a, c, t, g, unknown or other
  misc_feature (162)..(162): n is a, c, g, or t
  modified_base (168)..(229): a, c, t, g, unknown or other
  misc_feature (168)..(229): n is a, c, g, or t
tcagacgagtgcgtcacgaccggtgctcgatttagtatgctagtatcgcggggggtnttcggcggaggaccaaactgaccgtcctaggtcagcccaaggctgccccctggtcactctgttcccacctcctctactgctagtctgagccgggctggcaaggcnctatgnnnnnnnnnnnnnnnnnnnnnnnnnnnnnnnnnnnnnnnnnnnnnnnnnnnnnnnnnnnnnn

SEQ ID NO: 87848 - DNA, 175 bp, Homo sapiens
  misc_feature: GYAE6OF02JJ3XX.1.89.I01.1.454.CMB.1.raw
  modified_base (168)..(175): a, c, t, g, unknown or other
  misc_feature (168)..(175): n is a, c, g, or t
tcagacgagtgcgtcacgaccggtgctcgatttagtatgctagtatcgcggggggtgttcggcggagggaccaaactgaccgtcctaggtcagcccaaggctgcccctggtcactctgttcccgccctcctcacgtctactgctgagcgggctggcaaggcgcatagnnnnnnnn

SEQ ID NO: 87849 - DNA, 175 bp, Homo sapiens
  misc_feature: GYAE6OF02GSR91.1.89.I01.1.454.CMB.1.raw
  modified_base (170)..(175): a, c, t, g, unknown or other
  misc_feature (170)..(175): n is a, c, g, or t
tcagacgagtgcgtcacgaccggtgctcgatttagtatgctagtatcgcgggggggtgttcggcggagggaccaaactgaccgtcctaggtaagcccaaggctgccccctcggtcactctgttcccgcctcctcacgtagcgtgctgagcgggctggcaaggcgcatagnnnnnn

SEQ ID NO: 87850 - DNA, 380 bp, Homo sapiens
  misc_feature: GYAE6OF02GWR39.1.89.I01.1.454.CMB.1.raw
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (358)..(362): a, c, t, g, unknown or other
  misc_feature (358)..(362): n is a, c, g, or t
  modified_base (364)..(364): a, c, t, g, unknown or other
  misc_feature (364)..(364): n is a, c, g, or t
  modified_base (366)..(380): a, c, t, g, unknown or other
  misc_feature (366)..(380): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcgtccttccccctggccaccctcctccaagacgccacctcgtcgggggccacgacggccggccctggggctgccgtggtcaagggactacgttccgagtcgcgtctctgngcgggntggcaggcgnatagnnnnncngnnnnnnnnnnnnnnn

SEQ ID NO: 87851 - DNA, 170 bp, Homo sapiens
  misc_feature: GYAE6OF02F3UZB.1.89.I01.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccaccctcctctcgtactgcgctgagcgggctggcaaggcgcatagnn

SEQ ID NO: 87852 - DNA, 178 bp, Homo sapiens
  misc_feature: GYAE6OF02G1YBA.1.89.I01.1.454.CMB.1.raw
  modified_base (171)..(178): a, c, t, g, unknown or other
  misc_feature (171)..(178): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctgtcgagcgtctgagcgggctggcaaggcgcatagnnnnnnnn

SEQ ID NO: 87853 - DNA, 225 bp, Homo sapiens
  misc_feature: GYAE6OF02FX7ZH.1.89.I01.1.454.CMB.1.raw
  modified_base (171)..(225): a, c, t, g, unknown or other
  misc_feature (171)..(225): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnnnnnnnnnnnnnnnnnnnnnnnnnnnnnnnnnnnnnnnnnnnnnnnnnnnnnnn

SEQ ID NO: 87854 - DNA, 173 bp, Homo sapiens
  misc_feature: GYAE6OF02ITVDB.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcgagtgcgtctctgagcgggctggcaaggcgcatagnnnn

SEQ ID NO: 87855 - DNA, 176 bp, Homo sapiens
  misc_feature: GYAE6OF02F5O10.1.89.I01.1.454.CMB.1.raw
  modified_base (170)..(176): a, c, t, g, unknown or other
  misc_feature (170)..(176): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcgggctggcaaggcgcatagnnnnnnn

SEQ ID NO: 87856 - DNA, 169 bp, Homo sapiens
  misc_feature: GYAE6OF02GAZJJ.1.89.I01.1.454.CMB.1.raw
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcgggctggcaaggcgcatag

SEQ ID NO: 87857 - DNA, 233 bp, Homo sapiens
  misc_feature: GYAE6OF02IGXXJ.1.89.I01.1.454.CMB.1.raw
  modified_base (226)..(233): a, c, t, g, unknown or other
  misc_feature (226)..(233): n is a, c, g, or t
tcagacgagtgcgtcacgaccggtgctcgatttagtatgctagtatcgcgggggcccaggcagatgatgaatctaattattactgtttgctttattttgatagtggctgggtgttcggcggcgggaccaagctgaccgtcctaggtcagcccaaggctgtcccctcggtcactctgttcccaccctcctctatacgatcgctgagcgggctggcaaggcgcatagnnnnnnnn

SEQ ID NO: 87858 - DNA, 224 bp, Homo sapiens
  misc_feature: GYAE6OF02FN3WW.1.89.I01.1.454.CMB.1.raw
  modified_base (219)..(224): a, c, t, g, unknown or other
  misc_feature (219)..(224): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccgccctcctctagagacacgctgagcgggctggcaaggcgcatagnnnnnn

SEQ ID NO: 87859 - DNA, 193 bp, Homo sapiens
  misc_feature: GYAE6OF02FI5C9.1.89.I01.1.454.CMB.1.raw
  modified_base (181)..(181): a, c, t, g, unknown or other
  misc_feature (181)..(181): n is a, c, g, or t
  modified_base (187)..(193): a, c, t, g, unknown or other
  misc_feature (187)..(193): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggccaaccccactgtccactctgttcccaccctcctctctctcgactctgagcggctggcaaggcncatagnnnnnnn

SEQ ID NO: 87860 - DNA, 218 bp, Homo sapiens
  misc_feature: GYAE6OF02H0YJI.1.89.I01.1.454.CMB.1.raw
  modified_base (58)..(58): a, c, t, g, unknown or other
  misc_feature (58)..(58): n is a, c, g, or t
  modified_base (167)..(168): a, c, t, g, unknown or other
  misc_feature (167)..(168): n is a, c, g, or t
  modified_base (170)..(218): a, c, t, g, unknown or other
  misc_feature (170)..(218): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactcgtgttccgcctctctactgctagtctgagcggctggcaaggcgcatagnngnnnnnnnnnnnnnnnnnnnnnnnnnnnnnnnnnnnnnnnnnnnnnnnnn

SEQ ID NO: 87861 - DNA, 184 bp, Homo sapiens
  misc_feature: GYAE6OF02JSA75.1.89.I01.1.454.CMB.1.raw
  modified_base (174)..(184): a, c, t, g, unknown or other
  misc_feature (174)..(184): n is a, c, g, or t
tcagacgagtgcgtcacgaccggtgctcgatttagtatgctagtatcgcgggggtcttcggagctgggaccaaggtcaccgtcctaggtaagcccaaggccaaccccactcgtcactctgttcccaccctcctccacgtcctactgctgagcgggctggacaaggcgtcatagnnnnnnnnnnn

SEQ ID NO: 87862 - DNA, 631 bp, Homo sapiens
  misc_feature: GYAE6OF02F80E3.1.89.I01.1.454.CMB.1.raw
  modified_base (196)..(196): a, c, t, g, unknown or other
  misc_feature (196)..(196): n is a, c, g, or t
  modified_base (376)..(376): a, c, t, g, unknown or other
  misc_feature (376)..(376): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggcctcccgaggctcctcatctatgactacataccaacgacgggccactcggacactcccagcctaggttcaggtgacagtggtctggactagacttcactctcaccntcagtcacgtacctagacgtccgtagtaacgttagttttcgtactaaggttttaacttacgttcgttacgtacgtacgtaacgtaccggtacgtacgtaacgtcggtacccttcgttacccgtacgtttcccgggtacccgtacgggtaaaccctaaaggttagggtaactacgttaaccgaaaccgtaaagtcggtacgggtaccttacggacctaaccgtacttcgttcgtttaccttctaaccgtttccccg

SEQ ID NO: 87863 - DNA, 238 bp, Homo sapiens
  misc_feature: GYAE6OF02GQPFS.1.89.I01.1.454.CMB.1.raw
  modified_base (58)..(58): a, c, t, g, unknown or other
  misc_feature (58)..(58): n is a, c, g, or t
  modified_base (169)..(238): a, c, t, g, unknown or other
  misc_feature (169)..(238): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccaccctctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnn

SEQ ID NO: 87864 - DNA, 172 bp, Homo sapiens; identical to SEQ ID NO: 86892
  misc_feature: GYAE6OF02FOCGJ.1.89.I01.1.454.CMB.1.raw
  modified_base (171)..(172): a, c, t, g, unknown or other
  misc_feature (171)..(172): n is a, c, g, or t

SEQ ID NO: 87865 - DNA, 547 bp, Homo sapiens
  misc_feature: GYAE6OF02GHU7F.1.89.I01.1.454.CMB.1.raw
  modified_base (57)..(57): a, c, t, g, unknown or other
  misc_feature (57)..(57): n is a, c, g, or t
  modified_base (168)..(173): a, c, t, g, unknown or other
  misc_feature (168)..(173): n is a, c, g, or t
  modified_base (177)..(177): a, c, t, g, unknown or other
  misc_feature (177)..(177): n is a, c, g, or t
  modified_base (183)..(183): a, c, t, g, unknown or other
  misc_feature (183)..(183): n is a, c, g, or t
  modified_base (186)..(187): a, c, t, g, unknown or other
  misc_feature (186)..(187): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (200)..(201): a, c, t, g, unknown or other
  misc_feature (200)..(201): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (239)..(240): a, c, t, g, unknown or other
  misc_feature (239)..(240): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagacgagtgcgtcacgaccggtgctcgatttagtatgctagtatcgcggggggtnttcggcggagggaccaaactgaccgtctaggtcagcccaaggctgccccctggtcactctgttcccacctctctactgctagtctgagcgggctggctaaggcgcagtagnnnnnncgcncgagcngtnncgntancnangcnncgntcatgcncgctngcgncgactgngtcagtcgtacnnctagcgngtacgtnccgngaccgntccaggtccagcgtacgcgatcgctgaacngtctnacgtagcgtagtcgagtacnctacggacgtacgtcgacgacgcgtaccgtacgtttacacgtacgtacgacgttacgtaccgcgtacgtacgtacgtacgtacgacgtacgtcgtacgtacgtacgtagtacgacgtacgtacgtacggtacgtacgtacgacgtacgtacgtacgtacgtacgtacgtacgtacgtacgtacgtcgttacgtacgtacgtacgtaccgtacgtacgtacgtagtacg

SEQ ID NO: 87866 - DNA, 186 bp, Homo sapiens
  misc_feature: GYAE6OF02IS4FV.1.89.I01.1.454.CMB.1.raw
  modified_base (176)..(186): a, c, t, g, unknown or other
  misc_feature (176)..(186): n is a, c, g, or t
tcagacgagtgcgtcacgaccggtgctcgatttagtatgctagtatcgcggggggtgttcggcggagggaccaaactgaccgtcctaggtcagcccaaggctcgccccctcggtcacctctcgttcccgccctcctcatacgccgtactctgagccgggctggcaaggcgcatagnnnnnnnnnnn

SEQ ID NO: 87867 - DNA, 534 bp, Homo sapiens
  misc_feature: GYAE6OF02IFMZ2.1.89.I01.1.454.CMB.1.raw
  modified_base (143)..(143): a, c, t, g, unknown or other
  misc_feature (143)..(143): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (481)..(481): a, c, t, g, unknown or other
  misc_feature (481)..(481): n is a, c, g, or t
  modified_base (530)..(530): a, c, t, g, unknown or other
  misc_feature (530)..(530): n is a, c, g, or t
tcagacgagtgcgtcacgaccggtgctcgattttagtatgctagtatagggacgaccgaaccgacctcgagtcgtcaggacggcagcagagccgaggaggaggagaggcccctaggtgaacggagggcttgttccaggccggnagcatcaccggagcccaggcagggtcagcagtgctggccgtgggcccttccgtntgagccgaggaccaaggacngcagcctcaccgaggcccagtcgtcttccccgtgcgaccctcgaccaagcgacacctcgtggggacaccgagccggaccccgtggcctaggcctggtacgaaggctacgttccgagtgctctcgtgagcggtctaggacgtaaggccgacgtacgagcngancagnactgaccnactnacgntacgagcgagtgacacgatagcgtnagngagagngngtagtcgngtcgagagacgcgtacgagtgtactgtgtacgacgagngacgtacgacgtacgacgtacgacgacgtacgcgtacgtacgtacgtcnctcg

SEQ ID NO: 87868 - DNA, 125 bp, Homo sapiens
  misc_feature: GYAE6OF02HYYLU.1.89.I01.1.454.CMB.1.raw
  modified_base (125)..(125): a, c, t, g, unknown or other
  misc_feature (125)..(125): n is a, c, g, or t
tcagacgagtgcgtcacgaccggtgctcgatttagtatgctagtatcgcggggacgaggccgattattactgcgggacctgggataccagtctgagttctgtggtgttcggcggagggaccaagn

SEQ ID NO: 87869 - DNA, 254 bp, Homo sapiens
  misc_feature: GYAE6OF02G9PQF.1.89.I01.1.454.CMB.1.raw
  modified_base (245)..(254): a, c, t, g, unknown or other
  misc_feature (245)..(254): n is a, c, g, or t
tcagacgagtgcgtcacgaccggtgctcgatttagtatgctagtatcgcgggaccatctctgggctccaggctgaggacgaggctgattatttctgcagctcatatacaaccagcagcaccaaagtcttcggaactgggaccagggtcaccgtcctaggtcagcccaaggcccaaccccactgtcactctcgttccccaccctcctctcgtagcactctggacgcgggctggcaaggcgcatagnnnnnnnnnn

SEQ ID NO: 87870 - DNA, 211 bp, Homo sapiens
  misc_feature: GYAE6OF02HJ3BX.1.89.I01.1.454.CMB.1.raw
  modified_base (171)..(211): a, c, t, g, unknown or other
  misc_feature (171)..(211): n is a, c, g, or t
tcagacgagtgcgtcacgaccggtgctcgattttagtatgctagtatcggcgggggggtgttcggcggagggaccaaactgaccgtcctaggtcagcccaaggctgccccctggtcactctgttcccacctctctactgctagtctgagcgggctggctaaggcgcatagnnnnnnnnnnnnnnnnnnnnnnnnnnnnnnnnnnnnnnnnn

SEQ ID NO: 87871 - DNA, 472 bp, Homo sapiens
  misc_feature: GYAE6OF02F9FL3.1.89.I01.1.454.CMB.1.raw
  modified_base (427)..(472): a, c, t, g, unknown or other
  misc_feature (427)..(472): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcacgcctccaccgaagggcccatccggtccttccccctggccctacccctcctaccaagacgccacctcgtcgggggaccaccgacggccggccccgtggggcctcggcccgttggtacccgaaacgggtaccttacccgttccggacggtcggtccgttaccttcgtacgggacgggccggggtccgttagggaccgaaacggggccgactagtacgcgnnnnnnnnnnnnnnnnnnnnnnnnnnnnnnnnnnnnnnnnnnnnnn

SEQ ID NO: 87872 - DNA, 181 bp, Homo sapiens
  misc_feature: GYAE6OF02ITQK2.1.89.I01.1.454.CMB.1.raw
  modified_base (172)..(181): a, c, t, g, unknown or other
  misc_feature (172)..(181): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcacctctcgttcccgccctcctctgtcgagcgtctgagcgggctggcaaggcgcatagnnnnnnnnnn

SEQ ID NO: 87873 - DNA, 847 bp, Homo sapiens
  misc_feature: GYAE6OF02JP18Y.1.89.I01.1.454.CMB.1.raw
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (798)..(798): a, c, t, g, unknown or other
  misc_feature (798)..(798): n is a, c, g, or t
tcagacgagtgcgtcacgaccggtgctcgatttagtatgctagtatggggaggaacgtgctcagttaggacccagagggaaccatggaagccccagctcagcttctcttcctcctgctactcgtgcctccagactaccgacggaataacttgttgtagacacgtgtcctaccagcccctaccgttgtttcgtttgccctaccgggaaagggaaagccgtaccctccccttccttcgtacgccgggacggtacccaggtccgaaaggttcgtttaagtccgacgtaaccgttggttaaccgttacgaccggtttacgaaaacctacgaaaccgtaaccgtcgaccgtacgtaccnccgtacgccgttctcacttntagctatacgactaccaaggccgaccgntacggacctacgtaccgccgtacgtacggtcgtaacggtggtaccgtggtacgggttacggtacggtacgtacgtttacgtccggtaccttaccggaccgttaaccagtaccgacgggtttaacccaacgggtaccgttaacgtacccgggtaaccctaaaggggtttacgttttaaccgtttagaaaccggttttacgtttaacgttttaccggacggttaccgtaaggtaaccccggttgggaaccctttacggaaccgttacgtacccgttaaccgttcgttttacccggtacccgtttaccgggtaccgggtttaaaccgtaacggtaacgggttagaaccgtttaaccgtacggttaaccggtaaggttaccgttgggacccttaaccggntttaacccgggctttaaccgtcccggttacttccgtacccgttaacccg

SEQ ID NO: 87874 - DNA, 611 bp, Homo sapiens
  misc_feature: GYAE6OF02G80FI.1.89.I01.1.454.CMB.1.raw
  modified_base (200)..(200): a, c, t, g, unknown or other
  misc_feature (200)..(200): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
tcagacgagtgcgtcacgaccggtgctcgatttagtatgctagtatcgcggggggggtctcaggaggcagcgctctcaggacatctccaccatggcctgggctctgctgctcctcaccctcctcactcagggcacaggtgacgcctccgagggaaggggcttcagggacctctgggctgatccttggtctcctgctcctnaggctcgaccggggccagcactgactcactggcatgtgtttcctcccttctttccagtacgtccgtcgggcccaggtctcgccctgactcagcctgcctcgtgtcgtggtctcgtgacngtcatcacntcctctgcacgtcggaaccngctagtcgtacggttggtagttagtgtaacttgtcgttcgtaccgtacggtaacctaactactacccaacccggtacggaaccgaaaccggcccctaagtacctacgtaattagtactttagacggtacggtactacgtacgtaacgttccggacccgttaggttacgggtttactacgttcgtacctttcgtccggtcgtacccttacgtacgttccgtacgaccgtaccggtccgtacccgtacccgtacgacccttaccg

SEQ ID NO: 87875 - DNA, 417 bp, Homo sapiens
  misc_feature: GYAE6OF02GPBET.1.89.I01.1.454.CMB.1.raw
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (378)..(417): a, c, t, g, unknown or other
  misc_feature (378)..(417): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcaggggtcagcagtgctggccgtggggccctcctctcagccaggaccaaggacagcagcctccaccaagggcccatccggtccttccccctggccaccctcctccaagcgccacctcgtcgggggcacgagccggccctgggctgcctggtcaaggctacttccgagtcgcgtctcgtgacggccgggctcgggactaacgggccgacgtagttaggctngacngnnnnnnnnnnnnnnnnnnnnnnnnnnnnnnnnnnnnnnnn

SEQ ID NO: 87876 - DNA, 188 bp, Homo sapiens; identical to SEQ ID NO: 86367
  misc_feature: GYAE6OF02FKADU.1.89.I01.1.454.CMB.1.raw
  modified_base (187)..(188): a, c, t, g, unknown or other
  misc_feature (187)..(188): n is a, c, g, or t

SEQ ID NO: 87877 - DNA, 173 bp, Homo sapiens
  misc_feature: GYAE6OF02I6ZCR.1.89.I01.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtatgctagtatcgcggggggtgttcggcggagggaccaaactgaccgtcctaggtcagcccaaggctgccccctcggtcactctgttcccaccctcctcacgtagcgtgctgagcgggctggcaaggcgcatagnnnn

SEQ ID NO: 87878 - DNA, 180 bp, Homo sapiens
  misc_feature: GYAE6OF02JKWGH.1.89.I01.1.454.CMB.1.raw
  modified_base (166)..(166): a, c, t, g, unknown or other
  misc_feature (166)..(166): n is a, c, g, or t
  modified_base (171)..(180): a, c, t, g, unknown or other
  misc_feature (171)..(180): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctgtcgagcgtctgagcgggctggcaaggcgnatagnnnnnnnnnn

SEQ ID NO: 87879 - DNA, 378 bp, Homo sapiens
  misc_feature: GYAE6OF02IYMFT.1.89.I01.1.454.CMB.1.raw
  modified_base (336)..(336): a, c, t, g, unknown or other
  misc_feature (336)..(336): n is a, c, g, or t
  modified_base (364)..(378): a, c, t, g, unknown or other
  misc_feature (364)..(378): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccgaaggcccatccggtccttccccctggcccacccctccctaccaacgacgccaacctccgtggggggccaccgagccggccctgggctcgccgtggtcaagggcttacttccgtcgtancactcgtgagcggctggcaaggcgcatnnnnnnnnnnnnnnn

SEQ ID NO: 87880 - DNA, 199 bp, Homo sapiens
  misc_feature: GYAE6OF02IGM3K.1.89.I01.1.454.CMB.1.raw
  modified_base (170)..(199): a, c, t, g, unknown or other
  misc_feature (170)..(199): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccgccctcctcatagcgtactctgagcgggctggcaaggcgcatagnnnnnnnnnnnnnnnnnnnnnnnnnnnnnn

SEQ ID NO: 87881 - DNA, 716 bp, Homo sapiens
  misc_feature: GYAE6OF02IC0PA.1.89.I01.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
tcagacgagtgcgtcacgaccggtgctcgatttagtatgctagtatcgcgggggggggtctcaggaggcagcgctctcaggacatctccaccatggcctgggctctgctgctcctcaccctcctcactcagggcacaggtgacgcctccgagggaaggggcttcgagggacctcgtgggctgatccgttggtctctgctcctnaggctcgaccgggccagcacgtgactcacgtggcagttgtcgtttcctcccgtttctttccgagtcgtccgtcggggcccagttctcgcccgtgactcagcccgtcgtccgttccggtgtcgttcgggtcctcgtggactacggtcgactccaccctagttcctaccgtgcctaacgtcgggaaaccnggtctaggtacgtacggtttgggttacggtttatacggttacttagtttcgttaccttccgtacggttaacccaactactcccgacccgaaggacccgaaaccggaccctaacgacctacgattagtacttttagtggtacggtaccgtacgttaccgcggttacccggtacccgtttacggttaccggggttttaacctaacgtttccgttcccgtttaccgttccggtaccggtacccggttaccgtaaccggttcccgtacgggtacccgtaacccggtaaccccgggttccccttaccccggtaccgttacccgttacccg

SEQ ID NO: 87882 - DNA, 179 bp, Homo sapiens; identical to SEQ ID NO: 87096
  misc_feature: GYAE6OF02GTDLO.1.89.I01.1.454.CMB.1.raw
  modified_base (171)..(179): a, c, t, g, unknown or other
  misc_feature (171)..(179): n is a, c, g, or t

SEQ ID NO: 87883 - DNA, 173 bp, Homo sapiens
  misc_feature: GYAE6OF02FHAMO.1.89.I01.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctcgtactgcgctgagcgggctggcaaggcgcatagnnn

SEQ ID NO: 87884 - DNA, 180 bp, Homo sapiens
  misc_feature: GYAE6OF02GK4AU.1.89.I01.1.454.CMB.1.raw
  modified_base (171)..(180): a, c, t, g, unknown or other
  misc_feature (171)..(180): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctctactgctagtctgagcgggctggcaaggcgcatagnnnnnnnnnn

SEQ ID NO: 87885 - DNA, 230 bp, Homo sapiens
  misc_feature: GYAE6OF02FL2QA.1.89.I01.1.454.CMB.1.raw
  modified_base (58)..(58): a, c, t, g, unknown or other
  misc_feature (58)..(58): n is a, c, g, or t
  modified_base (170)..(230): a, c, t, g, unknown or other
  misc_feature (170)..(230): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnnnnnn

SEQ ID NO: 87886 - DNA, 219 bp, Homo sapiens
  misc_feature: GYAE6OF02G49EA.1.89.I01.1.454.CMB.1.raw
  modified_base (58)..(58): a, c, t, g, unknown or other
  misc_feature (58)..(58): n is a, c, g, or t
  modified_base (164)..(164): a, c, t, g, unknown or other
  misc_feature (164)..(164): n is a, c, g, or t
  modified_base (170)..(219): a, c, t, g, unknown or other
  misc_feature (170)..(219): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccgccctcctctactgctagtctgagcgggctggcaaggcncatagnnnnnnnnnnnnnnnnnnnnnnnnnnnnnnnnnnnnnnnnnnnnnnnnnn

SEQ ID NO: 87887 - DNA, 131 bp, Homo sapiens
  misc_feature: GYAE6OF02G805N.1.89.I01.1.454.CMB.1.raw
  modified_base (124)..(131): a, c, t, g, unknown or other
  misc_feature (124)..(131): n is a, c, g, or t
tcagacgagtgcgtcacgaccggtgctcgatttagtatgctagtatcgcgggggtcttcggagctgggaccaaggtcaccgtcctatgtcagcccaaggccaaccccactgtcactctgttccnnnnnnnn

SEQ ID NO: 87888 - DNA, 956 bp, Homo sapiens
  misc_feature: GYAE6OF02IKASY.1.89.I01.1.454.CMB.1.raw
  modified_base (200)..(200): a, c, t, g, unknown or other
  misc_feature (200)..(200): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagcccacccttgttctttgtctccgaggggaaancgcccaccctctcctgcgacgggccagtcgagtagttgttagcagtcttacttacgccgtacggtaaccaacgaacgaaccgtcggaccgacggaccctcccgacggccttcctctattcttatacgtaactaccacgtaacccgtaaacggaccggggtaccctaaccggtcggaccgtaaccttaccccgacggtacccgttagggtttaccgtacggggttcggaccggtagggtttccgggggtacggtacggggtaaccgtacggttaccctttaccgtaaccgttacccttacccgtaaaccctacgttaccgaaccgtaccgtaacgtacccgtttaacggaccggtaacccggtttaaggttaaacggttttacgttttttaccggtaaccgtttaaacggtttttttaaccgttttaaccggttacggttaacccttaaagggtcccggttaaacgggtttacccgggtaaaccgtaacccgtttaaaccgggtttcccggttacccccgtttacccgtttttaacccggtttacccccgggtttttcccggggtaaacccccggtttaaaccggggtaaaacccgttaaaagggggtttcccggtaaaacgtttaacccggtaaacccggttaaaaccgggtaccggttttccggggtacggttaacccgtaccggttaaacccttaccgggttaacctttccgggtttaccggtttaccctttcccgttaacccctttcccccgg

SEQ ID NO: 87889 - DNA, 173 bp, Homo sapiens; identical to SEQ ID NO: 86981
  misc_feature: GYAE6OF02GGYPQ.1.89.I01.1.454.CMB.1.raw
  modified_base (171)..(173): a, c, t, g, unknown or other
  misc_feature (171)..(173): n is a, c, g, or t

SEQ ID NO: 87890 - DNA, 176 bp, Homo sapiens
  misc_feature: GYAE6OF02H6JGX.1.89.I01.1.454.CMB.1.raw
  modified_base (171)..(176): a, c, t, g, unknown or other
  misc_feature (171)..(176): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnnnnnn

SEQ ID NO: 87891 - DNA, 177 bp, Homo sapiens
  misc_feature: GYAE6OF02I8B4L.1.89.I01.1.454.CMB.1.raw
  modified_base (170)..(177): a, c, t, g, unknown or other
  misc_feature (170)..(177): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctgttcccaccctcctctgtcgagcgtctgagcgggctggcaaggcgcatagnnnnnnnn

SEQ ID NO: 87892 - DNA, 184 bp, Homo sapiens
  misc_feature: GYAE6OF02IQTKV.1.89.I01.1.454.CMB.1.raw
  modified_base (169)..(184): a, c, t, g, unknown or other
  misc_feature (169)..(184): n is a, c, g, or t
tcagacgagtgcgtcacgaccggtgctcgatttagtatgctagtatcgcgggggggtgttcggcggagggaccaaactgaccgtctaggtcagcccaaggctgccccctggtcactctgttcccgccctcctctactgctagtctgagcgggctggcaaggcgcatagnnnnnnnnnnnnnnnn

SEQ ID NO: 87893 - DNA, 327 bp, Homo sapiens
  misc_feature: GYAE6OF02I25OJ.1.89.I01.1.454.CMB.1.raw
  modified_base (318)..(318): a, c, t, g, unknown or other
  misc_feature (318)..(318): n is a, c, g, or t
  modified_base (321)..(327): a, c, t, g, unknown or other
  misc_feature (321)..(327): n is a, c, g, or t
tcagacgagtgcgtcacgaccggtgctcgatttagtatgctagtatcgcgggctcctcatttttgacaatgataaacgaccctcaggaatttctgaccgattctctggctccaagtctggcctgtcagcctccctgggcatcaccggactccaaaactggggacgaggccgattattactgcgagacatgggatagtaacttgaatgttgggcgattcggcggaggacaagttgaccgtctggtacagccaagctcgcccctcggtcactctcgttccgccctcctcctcgtctctactgagcggctggcaggcgcanagnnnnnnn

SEQ ID NO: 87894 - DNA, 259 bp, Homo sapiens
  misc_feature: GYAE6OF02IYQJ0.1.89.I01.1.454.CMB.1.raw
  modified_base (252)..(259): a, c, t, g, unknown or other
  misc_feature (252)..(259): n is a, c, g, or t
tcagacgagtgcgtcacgaccggtgctcgatttagtatgctagtatgggggggcctctgcgccctgggcccagctctgtcccacaccgcggtcacatggcaccacctctcttgcagcctccaccaagggcccatcggtcttcccctggccgccctgctccgaggagcacctccgagagcacgagccggccctgggctgccgtggtcaaggctacttccacgcactcgtctgagcggctggacaggcgcatgnnnnnnnn

SEQ ID NO: 87895 - DNA, 177 bp, Homo sapiens
  misc_feature: GYAE6OF02I0FMI.1.89.I01.1.454.CMB.1.raw
  modified_base (171)..(177): a, c, t, g, unknown or other
  misc_feature (171)..(177): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcacgtctactgctgagcgggctggcaaggcgcatagnnnnnnn

SEQ ID NO: 87896 - DNA, 192 bp, Homo sapiens
  misc_feature: GYAE6OF02JUR7I.1.89.I01.1.454.CMB.1.raw
  modified_base (58)..(58): a, c, t, g, unknown or other
  misc_feature (58)..(58): n is a, c, g, or t
  modified_base (168)..(192): a, c, t, g, unknown or other
  misc_feature (168)..(192): n is a, c, g, or t
tcagacgagtgcgtcacgaccggtgctcgatttagtatgctagtatcgcgggggggtnttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnn

SEQ ID NO: 87897 - DNA, 356 bp, Homo sapiens
  misc_feature: GYAE6OF02FN5O8.1.89.I01.1.454.CMB.1.raw
  modified_base (343)..(356): a, c, t, g, unknown or other
  misc_feature (343)..(356): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccacaaggcccatcggtcttcccctggccaccctcctccagagcacctctgggggcacgacgcggcccgtggctgcctggtcaaggctacttccgagtcgcgtctcgtgagcgggctggcgaggcgcatgnnnnnnnnnnnnnn

SEQ ID NO: 87898 - DNA, 446 bp, Homo sapiens
  misc_feature: GYAE6OF02GYOV0.1.89.I01.1.454.CMB.1.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (337)..(337): a, c, t, g, unknown or other
  misc_feature (337)..(337): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (416)..(446): a, c, t, g, unknown or other
  misc_feature (416)..(446): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtccttcccccnggccaccctcctccaagcncacctcgtgggggccacgacgccggcccgtgggctcgcccgtggtaccgaagggtaccttacgttccctacggtacncctaacgttccgtcggaacggtccggggccttcggggaccgaaacgggcccgtacgtaagtaacggcacgntnacgntnnnnnnnnnnnnnnnnnnnnnnnnnnnnnnn

SEQ ID NO: 87899 - DNA, 173 bp, Homo sapiens; identical to SEQ ID NO: 86733
  misc_feature: GYAE6OF02GXTDD.1.89.I01.1.454.CMB.1.raw
  modified_base (171)..(173): a, c, t, g, unknown or other
  misc_feature (171)..(173): n is a, c, g, or t

SEQ ID NO: 87900 - DNA, 450 bp, Homo sapiens
  misc_feature: GYAE6OF02FW0EJ.1.89.I01.1.454.CMB.1.raw
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (407)..(450): a, c, t, g, unknown or other
  misc_feature (407)..(450): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctgggccgtggggccctcctctcacgccaggaccaaggacagcacgcctcccaaccgaacgggcccagtccggttccttcccccgtggccacccctcctccaacgacgccaccgtcgtgggggccacgacgccggcccgtcgggcctcgccgttggtacaacgggtaccttacgttccggagtcgccgtctcgtcggacggtccggtcgtcgggacgtaacggcgacgtagtacgncgngnnnnnnnnnnnnnnnnnnnnnnnnnnnnnnnnnnnnnnnnnnnn

SEQ ID NO: 87901 - DNA, 445 bp, Homo sapiens
  misc_feature: GYAE6OF02HWLTD.1.89.I01.1.454.CMB.1.raw
  modified_base (250)..(250): a, c, t, g, unknown or other
  misc_feature (250)..(250): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (400)..(445): a, c, t, g, unknown or other
  misc_feature (400)..(445): n is a, c, g, or t
tcagacgagtgcgtcacgaccggtgctcgatttagtatgctagtatgggcacgaccgacctgagctcaggaggcagcagagcgagggaggaggagaggcccccaggtgaaacggagggggcttgtccagggcccggcagcatcaccggagcccagggcagggtcagcagtgctggccgtggggccctcctctcacgccaggaccaaggacagcagcctccaccaacggggcccatccggtcttcccccgnggccacccctcctccaagcgccacctcggtgggggccacgaggccggtcccctggggcctggccctcgggtacaacggtactaccttccggagtcgccgtcgtccgtaggacggcggggtcgtcgggacgaagggccgntaagacgngcnnnnnnnnnnnnnnnnnnnnnnnnnnnnnnnnnnnnnnnnnnnnnn

SEQ ID NO: 87902 - DNA, 172 bp, Homo sapiens; identical to SEQ ID NO: 86723
  misc_feature: GYAE6OF02HIIFV.1.89.I01.1.454.CMB.1.raw
  modified_base (171)..(172): a, c, t, g, unknown or other
  misc_feature (171)..(172): n is a, c, g, or t

SEQ ID NO: 87903 - DNA, 174 bp, Homo sapiens
  misc_feature: GYAE6OF02IQXIE.1.89.I01.1.454.CMB.1.raw
  modified_base (169)..(174): a, c, t, g, unknown or other
  misc_feature (169)..(174): n is a, c, g, or t
tcagacgagtgcgtcacgaccggtgctcgatttagtatgctagtatcgcgggggggtgttcggcggagggaccaaactgaccgtcctaggtcagcccaaggctcgcccctcggtcactctgttcccgccctcctctactgctagtctgagcggctggcaggcgcatagnnnnnn

SEQ ID NO: 87904 - DNA, 194 bp, Homo sapiens
  misc_feature: GYAE6OF02F0NTA.1.89.I01.1.454.CMB.1.raw
  modified_base (175)..(194): a, c, t, g, unknown or other
  misc_feature (175)..(194): n is a, c, g, or t
tcagacgagtgcgtcacgaccggtgctcgatttttagtatgctagtatcgcgggggggtgttcggcggagggaccaaactgacccgtcctaggtcagcccaaggcctgccccctcggtcactctgttcccgccctcctcacgtagcgtgctgagcgggctggcaaggcgcatagnnnnnnnnnnnnnnnnnnnn

SEQ ID NO: 87905 - DNA, 176 bp, Homo sapiens
  misc_feature: GYAE6OF02H94LX.1.89.I01.1.454.CMB.1.raw
  modified_base (57)..(57): a, c, t, g, unknown or other
  misc_feature (57)..(57): n is a, c, g, or t
  modified_base (173)..(176): a, c, t, g, unknown or other
  misc_feature (173)..(176): n is a, c, g, or t
tcagacgagtgcgtcacgaccggtgctcgatttagtatgctagtatcgcggggggtnttcggcggagggaccaaactgaccgtcctaggtcagcccaaggctgccccctggtcactctgttctcaccctcctctgtcgagcgtctggagcgggctgggcaagggcgcaatagnnnn

SEQ ID NO: 87906 - DNA, 610 bp, Homo sapiens
  misc_feature: GYAE6OF02HB0NO.1.89.I01.1.454.CMB.1.raw
  modified_base (262)..(262): a, c, t, g, unknown or other
  misc_feature (262)..(262): n is a, c, g, or t
  modified_base (334)..(334): a, c, t, g, unknown or other
  misc_feature (334)..(334): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
tcagacgagtgcgtcacgaccggtgctcgatttagtatgctagtatcgcggggggggtctcaggaggcagcgctctcaggacatctccaccatggcctgggctctgctgcctcctcaccctcctcactcaggcacgaggtgacgcctcgagggaacggggcttcgacgggacctcgtgggctgattccgttggtctcctgctcctcaggctccggaccggggtccagccaacgtcgactcacgtggctagttgttctttccnccttactttccgagtacgttcccgtcggaccagttctagccccttgacctgacgtccctgcctcggtacgtntcggcctcgtcggtacagtcatccacatcncctggctaacgtcggaaaccngacgtagtcggtagttggttagttactcgtactgttctccgtacgacgtaactactactaccgaacgtacggaaccgtaaccgacctaagtacctacgtagttaacgttaattcggcgtaacgtactacgtcgtaccgtccggttaccgtaaggttacgttactacgtcgttcttcggtctcggtacaacgtgtccgagtacaccgtccgtcccactacgactcg

SEQ ID NO: 87907 - DNA, 658 bp, Homo sapiens
  misc_feature: GYAE6OF02HLU04.1.89.I01.1.454.CMB.1.raw
  modified_base (196)..(196): a, c, t, g, unknown or other
  misc_feature (196)..(196): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagcccacctgtcttgtctccgaggggaaangccaccctctcctgcagggccagtcagtagtgttagcagtctacttagcctggtaccaacagaaacctggccaggcctccgaggcctcctcatctatgtactaacactacccaacgacgggcccacgtcggaccacgtacccagtccgtaagggttccaggtcggactagggtcgggttactcggggaactaggtacctttcgaaccttcgtaccctaaccacgtccgaacgcctaacgccgtaagaccgtaccgtaggaaacgttattttacgacgttaagtttacttacgttacgtacgagtacgagtcgtaagaccgtaacgtccggtccttacgtccgttaccgtttccggaccgttacgggaaacctaaacggtgtaacgtacgtaaccgaaaccggtaacgtcggtacgtcgtacgtacgaccgtacgtaccttacggtcttacgtacgttccccg

SEQ ID NO: 87908 - DNA, 179 bp, Homo sapiens
  misc_feature: GYAE6OF02FQVBF.1.89.I01.1.454.CMB.1.raw
  modified_base (171)..(179): a, c, t, g, unknown or other
  misc_feature (171)..(179): n is a, c, g, or t
tcagacgagtgcgtcacgaccggtgctcgatttagtatgctagtatcggcgggggggtattcggcggagggaccaaactgacccgtcctaggtcagcccaaggctgccccctggtcactctgttcccgcctcctctactgctagtctgagcgggctggcaaggcgcatagnnnnnnnnn

SEQ ID NO: 87909 - DNA, 249 bp, Homo sapiens
  misc_feature: GYAE6OF02IEDJF.1.89.I01.1.454.CMB.1.raw
  modified_base (239)..(249): a, c, t, g, unknown or other
  misc_feature (239)..(249): n is a, c, g, or t
tcagacgagtgcgtcacgaccggtgctcgatttagtatgctagtatcgcgggaccatctctggctccaggctgaggacgaggctgattatttctgcagctcatatacaaccagcagcaccaaagtcttcggaactggaccagggtcaccgtcctaggtcagcccaaggccaaccccactgtcactctcgttcccaccctcctcaccgcactcgtctgagcggctggcaaggcgcatagnnnnnnnnnnn

SEQ ID NO: 87910 - DNA, 177 bp, Homo sapiens
  misc_feature: GYAE6OF02FV5XY.1.89.I01.1.454.CMB.1.raw
  modified_base (154)..(154): a, c, t, g, unknown or other
  misc_feature (154)..(154): n is a, c, g, or t
  modified_base (170)..(177): a, c, t, g, unknown or other
  misc_feature (170)..(177): n is a, c, g, or t
tcagacgagtgcgtcacgaccggtgctcgatttagtatgctagtatcgcgggagggtgttcggcggagggaccaaactgaccgtcctaggtcagcccaaggctgccccctggtcactctgttcccaccctcctcacgtctactgctgagcgggntggcaaggcgcatagnnnnnnnn

SEQ ID NO: 87911 - DNA, 660 bp, Homo sapiens
  misc_feature: GYAE6OF02GS1JW.1.89.I01.1.454.CMB.1.raw
  modified_base (111)..(111): a, c, t, g, unknown or other
  misc_feature (111)..(111): n is a, c, g, or t
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (234)..(235): a, c, t, g, unknown or other
  misc_feature (234)..(235): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (256)..(257): a, c, t, g, unknown or other
  misc_feature (256)..(257): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (275)..(276): a, c, t, g, unknown or other
  misc_feature (275)..(276): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
tcagacgagtgcgtcacgaccggtgctcgatttagtatgctagtatcgcgggacgaggccgattattactgcgggacctgggataccagtctgagttctgtggtgttcggnggagggtaccaagctgaccgtgcaggtcagcccaagtctcgccccctggtcacgtcctcgttcccaccctcctntagacgactacgcttagagcggntcggacaaggctcaagttgncngacnngnacgntcnacngtntcaagnngntnaangcngntnaacnncgtcgntcgaancaagtcngtcncgngtacngntaaacgntcgtanactaggtcagtctaaagtctaggctggtcaaaccgtacgttcggataaccggtcgtaccgtatacggtactacgtaccggttaaacgtcgtaccgtaacgtacggttaccgtaccggttaacgtccggttacgtacgttacggttaccgaccgttaaccgttaacgtaccttacgttacgtaaccgttcggtaacccgttacgtaccgtaccgttaaacgaccgtttaccggtaccgtacggttaccggtacgtaacccgggtttaactaccgggtacccggtaacttaacccggttacgtaccggttaaccgtaccgtacggttaacctcggttacg

SEQ ID NO: 87912 - DNA, 231 bp, Homo sapiens
  misc_feature: GYAE6OF02FLADN.1.89.I01.1.454.CMB.1.raw
  modified_base (144)..(144): a, c, t, g, unknown or other
  misc_feature (144)..(144): n is a, c, g, or t
  modified_base (181)..(231): a, c, t, g, unknown or other
  misc_feature (181)..(231): n is a, c, g, or t
tcagacgagtgcgtcacgaccggtgctcgatttagtatgctagtatcgcggggggggtgttacggcggagggaccaaacttggacccgtcctagggtaacgcccaagggctcgccccctcggtcactctgttcccaccctcctnacgtagcgtgctgagcgggctggcaaggcgacatagnnnnnnnnnnnnnnnnnnnnnnnnnnnnnnnnnnnnnnnnnnnnnnnnnnn

SEQ ID NO: 87913 - DNA, 179 bp, Homo sapiens
  misc_feature: GYAE6OF02FKKNZ.1.89.I01.1.454.CMB.1.raw
  modified_base (170)..(179): a, c, t, g, unknown or other
  misc_feature (170)..(179): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctctctgtcgagcgtctgagcgggctggcaaggcgcatagnnnnnnnnnn

SEQ ID NO: 87914 - DNA, 778 bp, Homo sapiens
  misc_feature: GYAE6OF02F3O21.1.89.I01.1.454.CMB.1.raw
  modified_base (170)..(170): a, c, t, g, unknown or other
  misc_feature (170)..(170): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
tcagacgagtgcgtcacgaccggtgctcgatttagtatgctagtatcgcgggggtgttcgcggaggacaaactgaccgtctaggtcaggcccaaggctgcccctggtcactctgttcccgcctcgtcaacgtcactgcgtgagcgggctggcaaggcgtcaatacgctgncgctgagactatctgctacatccgtagctatggacntagtntgcgtgtcacgtactcgtgtcacgtcgatacgacgcgacgtagcacggtacacctactaggattgtaccgtactacgacgtaacgtctacgacgtacggtacctaggtactacgtactacgtacgtacgtacgtacgtacgtacgtacgtacgtacgacgtacgtaccgtacgtacgtacgtacgtacgtacgtacgtacgtacgtacgtaacgtacgtaacggtaacgtaacgtaacgttaacgtaacgttaacgttaacgttaacggtaaccgtaacggttaacgtaacggttaaccgtaaaccgttaaaccggtaaacggtaacgtaaacgtttaaaccggttaaccgttaaccggttaaccggttaaccggtaaccggttaaccggtaaccgttaaccgtttaaaccgttaaccggttaaccggttaacggtaacccgtacccgtaaccggtaaccggtaaaccgtaacccggttaaaccgttaaccggttaaaccgttaccgttaacccgtttaacccgttaaccccgtaacccgttaaccgtttacccgtaccgttaaccg

SEQ ID NO: 87915 - DNA, 194 bp, Homo sapiens
  misc_feature: GYAE6OF02HU881.1.89.I01.1.454.CMB.1.raw
  modified_base (188)..(194): a, c, t, g, unknown or other
  misc_feature (188)..(194): n is a, c, g, or t
tcagacgagtgcgtcacgaccggtgctcgatttagtatgctagtatgggatggccacctgagtggtctttgggtgttcggcggggggaccaagctgaccgtcctaggtcagcccaaggctgccccctcggtcactctgttcccgccatctgatctctcgactctgagcgggctggcaaggcgcatagnnnnnnn

SEQ ID NO: 87916 - DNA, 485 bp, Homo sapiens
  misc_feature: GYAE6OF02I3HZ8.1.89.I01.1.454.CMB.1.raw
  modified_base (425)..(425): a, c, t, g, unknown or other
  misc_feature (425)..(425): n is a, c, g, or t
  modified_base (430)..(485): a, c, t, g, unknown or other
  misc_feature (430)..(485): n is a, c, g, or t
tcagacgagtgcgtcacgaccggtgctcgatttagtatgctagtatggggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcacgccaggaccaaggacagcagcctccaaccgaacgggcccagtccggtccttcccccgtcggcccacccctcctaccaacgacgccacctcggtcgggggcacgacgccggcccgtgggcctcggccgtggggtaccaacgggtaccttacccgtttcccgtacggtacgtcccaacgttccgtagggaccgggtcgggggtccgttcgggaccgaacgggtccgacaaggtagncagcnnnnnnnnnnnnnnnnnnnnnnnnnnnnnnnnnnnnnnnnnnnnnnnnnnnnnnnn

SEQ ID NO: 87917 - DNA, 178 bp, Homo sapiens
  misc_feature: GYAE6OF02IICAI.1.89.I01.1.454.CMB.1.raw
  modified_base (58)..(58): a, c, t, g, unknown or other
  misc_feature (58)..(58): n is a, c, g, or t
  modified_base (170)..(178): a, c, t, g, unknown or other
  misc_feature (170)..(178): n is a, c, g, or t
tcagacgagtgcgtcacgaccggtgctcgatttagtatgctagtatcgcgggggggtnttcggcggagggaccaaactgaccgtcctaggtcagcccaaggctgccccctggtcactctgttcccaccctcctctagagacacgctgagcgggctggcaaggcgcatagnnnnnnnnn

SEQ ID NO: 87918 - DNA, 538 bp, Homo sapiens
  misc_feature: GYAE6OF02GNSKN.1.89.I01.1.454.CMB.1.raw
  modified_base (114)..(114): a, c, t, g, unknown or other
  misc_feature (114)..(114): n is a, c, g, or t
  modified_base (228)..(229): a, c, t, g, unknown or other
  misc_feature (228)..(229): n is a, c, g, or t
  modified_base (231)..(231): a, c, t, g, unknown or other
  misc_feature (231)..(231): n is a, c, g, or t
  modified_base (233)..(234): a, c, t, g, unknown or other
  misc_feature (233)..(234): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
tcagacgagtgcgtcacgaccggtgctcgatttagtatgctagtatcgcggggcccaggcagatgatgaactctgattattactgtgtgctctatctgagtggtgcctttgggnttcggcggagggaccaagctgaccgtctaggtcagcccaaggtctggccccctggtcactctgttcccaccctctcacgcactcgtctgagcggactggcaaggcgacataggnngnanntgctcngntcngancgtcgcagcttnangacaacngtaactgctttanaccgangccaggccnggttanacgctggacccttatgacnacgactacngtancgtacgctagcgtagtccaggtttacacactagagttactgagtcgtacgtagccgagtttacncgtaccgtntacgtacgtacgtacgacgtacgtacgacgtacgtacgacgtacgtacgtacgtacgtacgtacgtacgtacgtacgtcgacgtacgtacgtacgtacgtacgtacgtaccgaccgacgtacgtagtacg

SEQ ID NO: 87919 - DNA, 236 bp, Homo sapiens
  misc_feature: GYAE6OF02F935J.1.89.I01.1.454.CMB.1.raw
  modified_base (226)..(236): a, c, t, g, unknown or other
  misc_feature (226)..(236): n is a, c, g, or t
tcagacgagtgcgtcacgaccggtgctcgatttagtatgctagtatcgcgggggcccaggcagatgatgaatctaattattactgtttgctttattttgatagtggctgggtgttcggcggcgggaccaagctgaccgtcctaggtcagcccaaggctgtcccctcggtcactctgttcccaccctcctctatacgatcgctgagcgggctggcaaggcgcatagnnnnnnnnnnn

SEQ ID NO: 87920 - DNA, 662 bp, Homo sapiens
  misc_feature: GYAE6OF02FR9VW.1.89.I01.1.454.CMB.1.raw
  modified_base (59)..(59): a, c, t, g, unknown or other
  misc_feature (59)..(59): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
  modified_base (390)..(390): a, c, t, g, unknown or other
  misc_feature (390)..(390): n is a, c, g, or t
tcagacgagtgcgtcacgaccggtgctcgatttagtatgctagtatcggcgggggggtnttcggcggaggccaaactgaccgtctaggtcaagcccaaggctcgcccccttggcactctggttcccaccctctcatagccgtactctgagtcgggcttagggcaaggcgctataggcncngcnacangtcangacngtgctcgaagcttaagcactccggtancttggaggcaatggtcagtccggttcncgtggtntaccgtgactgcaggaacacgttagcgagccgtcgngtacngtcgacgtggtntaggngttacggagtcggtctaacgtagccncgttagtgtcgggtcgaagtcgacgttactaacgttcgtacggtaaccncggttcgttaacactcggtacctgaaaccgacgcgttaacggacgtacggtacgttagtacgtacttacggtaccgttaaggcttacgtccgaaacgttaccctaggtacctctcggtaccttacccgaaaccgttctacgggtaccaccggtcgtaccgtacgtacctacggttacggtaaccacggttaccggaccgttacgggttaacccgtaccgtcgttacccggtattacccggttccgtaaaccggttccgtaccggtaacccgg

SEQ ID NO: 87921 - DNA, 188 bp, Homo sapiens
  misc_feature: GYAE6OF02HCV14.1.89.I01.1.454.CMB.1.raw
  modified_base (171)..(188): a, c, t, g, unknown or other
  misc_feature (171)..(188): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnnnnnnnnnnnnnnnnnn

SEQ ID NO: 87922 - DNA, 202 bp, Homo sapiens
  misc_feature: GYAE6OF02HON8H.1.89.I01.1.454.CMB.1.raw
  modified_base (59)..(59): a, c, t, g, unknown or other
  misc_feature (59)..(59): n is a, c, g, or t
  modified_base (171)..(202): a, c, t, g, unknown or other
  misc_feature (171)..(202): n is a, c, g, or t
tcagacgagtgcgtcacgaccggtgctcgatttagtatgctagtatcgcggggggggtnttcggcggagggaccaaactgaccgtcctaggtcagcccaaggctgccccctggtcactctgttcccgccctcctcatagcgtactctgagcgggctggcaaggcgcatagnnnnnnnnnnnnnnnnnnnnnnnnnnnnnnnn

SEQ ID NO: 87923 - DNA, 201 bp, Homo sapiens
  misc_feature: GYAE6OF02IKP6P.1.89.I01.1.454.CMB.1.raw
  modified_base (189)..(201): a, c, t, g, unknown or other
  misc_feature (189)..(201): n is a, c, g, or t
tcagacgagtgcgtcacgaccggtgctcgatttagtatgctagtatgggatgacagcctgagtgcccttatgtcttcggaactgggaccaaggtcaccgtctaggtcagcccaaggcccaaccccactgtcactctcgttcccaccctcctctctctcgactctgagcgggctggcaaggcgacatagnnnnnnnnnnnnn

SEQ ID NO: 87924 - DNA, 197 bp, Homo sapiens
  misc_feature: GYAE6OF02IR07Z.1.89.I01.1.454.CMB.1.raw
  modified_base (187)..(197): a, c, t, g, unknown or other
  misc_feature (187)..(197): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggcccaaccccactgtcactctcgttcccaccctctctctctcgactctgagcggctggcaaggcgcatagnnnnnnnnnnn

SEQ ID NO: 87925 - DNA, 174 bp, Homo sapiens
  misc_feature: GYAE6OF02HRK2G.1.89.I01.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatagnnnn

SEQ ID NO: 87926 - DNA, 671 bp, Homo sapiens
  misc_feature: GYAE6OF02IUBBS.1.89.I01.1.454.CMB.1.raw
  modified_base (195)..(195): a, c, t, g, unknown or other
  misc_feature (195)..(195): n is a, c, g, or t
tcagacgagtgcgtcacgaccggtgctcgatttagtatgctagtatgggggaggaactgctcagttaggacccagagggaaccatggaagccccagctcagcttctcttcctcctgctactctggctcccagataccaccggagaaattgtgttgacacagtctccagccaccctgtctttgtctccgagggaancgccacctctcctgcgagggccagtcagtagtgttagcagcttactagcctaggtaaccaacgaacgaaaccgtggacccaaggcccgtccccgaagggtcctaccctactactacgtatacgtaactacaactacccgaacgtacgggaccaacgtcggacctacgtccccagccgtaggttccaggtcgacgtggtcgggtactgggaccagtaaccttcaacttcgtaacacctagtaccgacgacacgtaccgtagacggtacgtaacggtaaagttactttacgtacttaacgtttaacttacgttcgtactaggacgtaaggaccgtaagacgaacgtacggtacctctaccgtaccgttccggtaccgttacggaactaaaagtcgtaacttacgtacgtaaaacggtaccgtacggtacggtacgtacgaactacctacttcgttaccgttacgttactacgttcccg

SEQ ID NO: 87927 - DNA, 183 bp, Homo sapiens
  misc_feature: GYAE6OF02FX3S9.1.89.I01.1.454.CMB.1.raw
  modified_base (171)..(183): a, c, t, g, unknown or other
  misc_feature (171)..(183): n is a, c, g, or t
tcagacgagtgcgtcacgaccggtgctcgatttagtatgctagtatcgcgggggggtgttcggcggagggaccaaactgaccgtcctaggtcagcccaaggctgccccctcggtcactctgttcccgccctcctcacgtctactgctgagcgggctggcaaggcgcatagnnnnnnnnnnnnn

SEQ ID NO: 87928 - DNA, 199 bp, Homo sapiens
  misc_feature: GYAE6OF02JD4UF.1.89.I01.1.454.CMB.1.raw
  modified_base (153)..(153): a, c, t, g, unknown or other
  misc_feature (153)..(153): n is a, c, g, or t
  modified_base (157)..(157): a, c, t, g, unknown or other
  misc_feature (157)..(157): n is a, c, g, or t
  modified_base (167)..(167): a, c, t, g, unknown or other
  misc_feature (167)..(167): n is a, c, g, or t
  modified_base (175)..(175): a, c, t, g, unknown or other
  misc_feature (175)..(175): n is a, c, g, or t
  modified_base (180)..(199): a, c, t, g, unknown or other
  misc_feature (180)..(199): n is a, c, g, or t
tcagacgagtgcgtcacgaccggtgctcgatttagtatgctagtagtgggatgacagcctgagtgcccttatgtcttcggaactgggaccaaggtcacgtctaggtcagccgaagccaacccactgtcactctgttcccgcctctctatgtanactntgagcgggcnggcaggcncatgnnnnnnnnnnnnnnnnnnnn

SEQ ID NO: 87929 - DNA, 175 bp, Homo sapiens
  misc_feature: GYAE6OF02H6N0C.1.89.I01.1.454.CMB.1.raw
  modified_base (126)..(126): a, c, t, g, unknown or other
  misc_feature (126)..(126): n is a, c, g, or t
  modified_base (171)..(175): a, c, t, g, unknown or other
  misc_feature (171)..(175): n is a, c, g, or t
tcagacgagtgcgtcacgaccggtgctcgatttagtatgctagtatcggcgggggggtgttcggcggagggaccaaactgaccgtcctaggtcagcccaaggctgcccctggtcactctgttcccnccctcctctactgctagtctgagcgggctgggcaaggcgcatagnnnnn

SEQ ID NO: 87930 - DNA, 172 bp, Homo sapiens
  misc_feature: GYAE6OF02GF37I.1.89.I01.1.454.CMB.1.raw
  modified_base (163)..(163): a, c, t, g, unknown or other
  misc_feature (163)..(163): n is a, c, g, or t
  modified_base (169)..(172): a, c, t, g, unknown or other
  misc_feature (169)..(172): n is a, c, g, or t
tcagacgagtgcgtcacgaccggtgctcgatttagtatgctagtatcgcgggggggtgttcggcggagggaccaaactgaccgtctaggtcagcccaaggctgccccctggtcactctgttcccgccctcctcatagcgtactctgagcgggctggcaaggcncatagnnnn

SEQ ID NO: 87931 - DNA, 197 bp, Homo sapiens
  misc_feature: GYAE6OF02HMK9L.1.89.I01.1.454.CMB.1.raw
  modified_base (173)..(173): a, c, t, g, unknown or other
  misc_feature (173)..(173): n is a, c, g, or t
  modified_base (178)..(197): a, c, t, g, unknown or other
  misc_feature (178)..(197): n is a, c, g, or t
tcagacgagtgcgtcacgaccggtgctcgatttagtatgctagtatcgcgggggggtgttcggcggagggaccaaactgaccgtcctaggtcagcccaaggctgccccctggtcactctcgttccccacccttcctcacgtctacctggctggagcgggctggacaaggccgnatagnnnnnnnnnnnnnnnnnnnn

SEQ ID NO: 87932 - DNA, 546 bp, Homo sapiens
  misc_feature: GYAE6OF02H6NK9.1.89.I01.1.454.CMB.1.raw
  modified_base (210)..(210): a, c, t, g, unknown or other
  misc_feature (210)..(210): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (451)..(452): a, c, t, g, unknown or other
  misc_feature (451)..(452): n is a, c, g, or t
  modified_base (457)..(457): a, c, t, g, unknown or other
  misc_feature (457)..(457): n is a, c, g, or t
  modified_base (463)..(464): a, c, t, g, unknown or other
  misc_feature (463)..(464): n is a, c, g, or t
  modified_base (466)..(466): a, c, t, g, unknown or other
  misc_feature (466)..(466): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcgagcatccgaccggcgccgaggcgaggtcagcgtagtcgcgtcggcggtcggccctctcgcgacgcacggacgagacncgcgcgccacaacgacggccagtcgtacctcccgcgtccaccctcgtacgaagtaccgctacgtcggcggacacgacgccggaccgtggctccgtacggtcgaccgaacgtaccttaccgttccgagtacgacctcgtaggtccggtagccggtataccggacggtacggcgacgtagtagacgtgcacgcgtgcgtacncgtcgctgcgatgngttccgncgngacgcgagagtcgatanncacgngtcatnngngtgacgtcgacgacgacgagcgacagacgtcgtacgtacgacgtcacgtcgtacgcgtacgtacgtacgtgtcgcgtagc

SEQ ID NO: 87933 - DNA, 178 bp, Homo sapiens
  misc_feature: GYAE6OF02GW7LT.1.89.I01.1.454.CMB.1.raw
  modified_base (170)..(178): a, c, t, g, unknown or other
  misc_feature (170)..(178): n is a, c, g, or t
tcagacgagtgcgtcacgaccggtgctcgatttagtatgctagtatcgcgggggtcttcggagctgggaccaaggtcaccgtcctaggtaagcccaaggccaaaccccactgtcactctgttcccaccctcctcacgtctactgctgagcgggctggcaaggcgcatagnnnnnnnnn

SEQ ID NO: 87934 - DNA, 210 bp, Homo sapiens
  misc_feature: GYAE6OF02JKLIU.1.89.I01.1.454.CMB.1.raw
  modified_base (185)..(210): a, c, t, g, unknown or other
  misc_feature (185)..(210): n is a, c, g, or t
tcagacgagtgcgtcacgaccggtgctcgatttagtatgctagtatggggatgacagcctgagtgcccttatgtcttcggaactgggaccaaggtcaccgtctaggtcagcccaaggccaacccactgtcactctgttcccaccctctctctctcgactctgagcgggctggcaaggcgcatagnnnnnnnnnnnnnnnnnnnnnnnnnn

SEQ ID NO: 87935 - DNA, 170 bp, Homo sapiens; identical to SEQ ID NO: 86803
  misc_feature: GYAE6OF02IOPTO.1.89.I01.1.454.CMB.1.raw

SEQ ID NO: 87936 - DNA, 466 bp, Homo sapiens
  misc_feature: GYAE6OF02I5RMZ.1.89.I01.1.454.CMB.1.raw
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (429)..(466): a, c, t, g, unknown or other
  misc_feature (429)..(466): n is a, c, g, or t
tcagacgagtgcgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctctctcagccaggacccaaggacagcacgcctcaaccgaacggccctatcggtcctccccctggccacccctctaccaagcgacctacccgtacgtcgggggccacgacggccggcccctggggtaccctcggcccgttagggtacccaaaacgggtcctttaaccgtccggtaacggtcggtacccggttccttacgggccggtccggggtactcgggacgaacggggtcgacctagaacgncngcnnnnnnnnnnnnnnnnnnnnnnnnnnnnnnnnnnnnnn

SEQ ID NO: 87937 - DNA, 216 bp, Homo sapiens
  misc_feature: GYAE6OF02FWKSA.1.89.I01.1.454.CMB.1.raw
  modified_base (168)..(168): a, c, t, g, unknown or other
  misc_feature (168)..(168): n is a, c, g, or t
  modified_base (174)..(175): a, c, t, g, unknown or other
  misc_feature (174)..(175): n is a, c, g, or t
  modified_base (177)..(216): a, c, t, g, unknown or other
  misc_feature (177)..(216): n is a, c, g, or t
tcagacgagtgcgtccacgaccggtgctcgatttagtatgctagtagtcggcgggggtcttcggagctgggaccaaggtcaccgtcctaggtcagcccaaggccaaccccactgtcactctgttcccaccctcctcacgtctactgctgagcgggctggacaagggcncatagnnannnnnnnnnnnnnnnnnnnnnnnnnnnnnnnnnnnnnnnn

SEQ ID NO: 87938 - DNA, 186 bp, Homo sapiens
  misc_feature: GYAE6OF02FP8OD.1.89.I01.1.454.CMB.1.raw
  modified_base (163)..(163): a, c, t, g, unknown or other
  misc_feature (163)..(163): n is a, c, g, or t
  modified_base (169)..(186): a, c, t, g, unknown or other
  misc_feature (169)..(186): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccacctcctcacgtagcgtgctgagtcgggctggcaaggcncatagnnnnnnnnnnnnnnnnnn

SEQ ID NO: 87939 - DNA, 763 bp, Homo sapiens
  misc_feature: GYAE6OF02FWF13.1.89.I01.1.454.CMB.1.raw
  modified_base (224)..(224): a, c, t, g, unknown or other
  misc_feature (224)..(224): n is a, c, g, or t
tcagacgagtgcgtcacgaccggtgctcgatttagtatgctagtatcggcggggggggtctcaggaggcagcgctctcaggacatctccaccatggcctgggctctgctgctcctcaccctcctcactcgagggcacgaggtcgaccgccctccgaagggggaacggggtccttcgaggggtaccctcgtggggctggacttccgttggtcctccgtgcctccncgaggcctccggacccgggcccagccacgtgacctcacgtgactagttcgttcgtttcctacccgttctttaccgaggtacgttcccgtcgggcccctaggtcctccgtccctaggacctcgacgtccctcggtcccttcggtcgtccgtcgggtcctcgtaggactgtcgactccacctattccctctgacctaggtaccgaactgacgtaggttacggtaacggtttgggtagttacgtacgtaacttcgttcgttccgtaccgtacgtaacctaactacgtacccgaaccgtaacggaacccgaaaccggtacccgaacgtacctacgtaacgttagttaacgtttacggtacggtacgttacgtacgttaccgttaccggtacccggttaccgttacggtttaaccgggtttaaccttaccggttcccgttccgtttccgtaccggttccgttaccgttaccgttaaccggtccgttaacggacccgtaaccggtaccccggtaccccgttcccgtaaccgttacccttaaccgg

SEQ ID NO: 87940 - DNA, 201 bp, Homo sapiens
  misc_feature: GYAE6OF02GNZYA.1.89.I01.1.454.CMB.1.raw
  modified_base (168)..(201): a, c, t, g, unknown or other
  misc_feature (168)..(201): n is a, c, g, or t
tcagacgagtgcgtcacgaccggtgctcgatttagtatgctagtatcgcggggggtgttcggcggagggaccaaactgaccgtcctaggtcagcccaaggctgccccctggtcactctgttcccgccctcctcatgcgtactctgagcgggctggcaaggcgcatagnnnnnnnnnnnnnnnnnnnnnnnnnnnnnnnnnn

SEQ ID NO: 87941 - DNA, 240 bp, Homo sapiens
  misc_feature: GYAE6OF02HCFIM.1.89.I01.1.454.CMB.1.raw
  modified_base (190)..(191): a, c, t, g, unknown or other
  misc_feature (190)..(191): n is a, c, g, or t
  modified_base (193)..(240): a, c, t, g, unknown or other
  misc_feature (193)..(240): n is a, c, g, or t
tcagacgagtgcgtcacgaccggtgctcgatttagtatgctagtatgggatgacagcctgagtgcccttatgtcttcggaactgggaccaaggtcaccgtcctaggtcagcccaaggcccaaccccactgtcactcgtcgttacccccctctctctctcactctgacgcgggctggccaaggctcatagnntnnnnnnnnnnnnnnnnnnnnnnnnnnnnnnnnnnnnnnnnnnnnnnnn

SEQ ID NO: 87942 - DNA, 996 bp, Homo sapiens
  misc_feature: GYAE6OF02H45UW.1.89.I01.1.454.CMB.1.raw
  modified_base (538)..(538): a, c, t, g, unknown or other
  misc_feature (538)..(538): n is a, c, g, or t
tcagacgagtgcgtcacgaccggtgctcgatttagtatgctagtatcgcgggggggggtctcaggaggcagcgctctcaggacatctccaccatcggcctgggctctgctgcctcctcacctcctcactcgagggcacgtacggtgaccgtcctccggaagggggtaacggggtcgttacgacgggggaccgtcggttcggggtctacggtacgttccgttcgggttcctccgtcggtcctcctacgacggtccgtccgggacccggggaccaggcctacgtacgactactacgtcggcgtacggttcgttccgttttaccttccccgtttcgtttacccgaggtaccgttccggttccggggtcctaacgttccggtaccccgtcccggttacgtaccggttacctaacggtcccgttacgtccccgtttccggttggttcccggttcggttccgttacgggtacgtcggtaaccggttaactctaacccgtaacctcgttcccttacggtaccgtctaaaccggtacggaaacccngtcggttaacggtttcgggttaaccgggtttagggtttccggaaacgtttacggtacgttttaacgtcgttaccgttaccggtttaccggttaaacctaaacgttaccggttaaccgaaacccgggtaccggaaacccggaaaccgggtaccccgtaaacggtttaccgtaaacggttaactttaaacccggtttagtttaacgggttaacgggttaaccggttaaaccgggtacggttaaccggtaccccggtttaaccgggtttacccgggttaaccggggtttaaccgggttttaaacccgtttacccgggtttacctttacccgtttttccgggttcccgttacggggttaaccccggtttaaccggttacccggttaaccgttaaccccgggaccgttaaacccggtcccccgggttacccgttacccggtaaccgttaccctttaccccggg

SEQ ID NO: 87943 - DNA, 267 bp, Homo sapiens
  misc_feature: GYAE6OF02GMB88.1.89.I01.1.454.CMB.1.raw
  modified_base (237)..(237): a, c, t, g, unknown or other
  misc_feature (237)..(237): n is a, c, g, or t
  modified_base (244)..(267): a, c, t, g, unknown or other
  misc_feature (244)..(267): n is a, c, g, or t
tcagacgagtgcgtcacgaccggtgctcgatttagtatgctagtatcgcgggaccatctctgggctccaggctgaggacgaggctgattatttctgcagctcatatacaccagcagcaccaaagtcttcggaactgggaccagggtcaccgtcctaggtcagcccaaggcccaaccccactgtcactctgttccccaccctcctcacgcacctcgtctgagtcgggctggcaaggcncataggnnnnnnnnnnnnnnnnnnnnnnnn

SEQ ID NO: 87944 - DNA, 267 bp, Homo sapiens
  misc_feature: GYAE6OF02JMTW2.1.89.I01.1.454.CMB.1.raw
  modified_base (174)..(174): a, c, t, g, unknown or other
  misc_feature (174)..(174): n is a, c, g, or t
  modified_base (177)..(184): a, c, t, g, unknown or other
  misc_feature (177)..(184): n is a, c, g, or t
  modified_base (186)..(267): a, c, t, g, unknown or other
  misc_feature (186)..(267): n is a, c, g, or t
tcagacgagtgcgtcacgaccggtgctcgatttagtatgctagtatcgcgggggtcttcggagctgggaccaaggtcaccgtcctaggtaagccccaaggccaaacccccactgtcactctgttcccaccctcctcacgtctactgctgagcgggctggcaaggcgctatagcnacnnnnnnnngnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 87945 - DNA, 177 bp, Homo sapiens
  misc_feature: GYAE6OF02GSOWK.1.89.I01.1.454.CMB.1.raw
  modified_base (164)..(164): a, c, t, g, unknown or other
  misc_feature (164)..(164): n is a, c, g, or t
  modified_base (169)..(177): a, c, t, g, unknown or other
  misc_feature (169)..(177): n is a, c, g, or t
tcagacgagtgcgtcacgaccggtgctcgatttagtatgctagtatcgcgggggggtgttcggcggagggaccaaactgaccgtctaggtcagcccaaggctgccccctggtcactctgttcccgccctcctcagtagcgtactctgagcgggctggcaaggcnatagnnnnnnnnn

SEQ ID NO: 87946 - DNA, 243 bp, Homo sapiens
  misc_feature: GYAE6OF02HIH6W.1.89.I01.1.454.CMB.1.raw
  modified_base (181)..(243): a, c, t, g, unknown or other
  misc_feature (181)..(243): n is a, c, g, or t
tcagacgagtgcgtcacgaccggtgctcgatttagtatgctagtatcggcgggggggtgttcggcggagggaccaaactgaccgtcctaggtcagcccaaggctcgccccctcggtcactctcgttcccgccctcctctactgctagtctggagcgggctgggcaagggcgacagtgacgnnnnnnnnnnnnnnnnnnnnnnnnnnnnnnnnnnnnnnnnnnnnnnnnnnnnnnnnnnnnnnn

SEQ ID NO: 87947 - DNA, 438 bp, Homo sapiens
  misc_feature: GYAE6OF01DDYID.5.70.G04.1.454.CMB.1.raw
  modified_base (436)..(438): a, c, t, g, unknown or other
  misc_feature (436)..(438): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaaagaactccctgtatctaacaaatgaaacagtctgagagttgaggacacggcctttctattactgtgacaaaaagatcggggaacgaagtggtggtggctgcaaatcgactacgtggggcctgggaaccctggtcaccgtctcctcagcctccaccaagggcccatcggtccttccccctggccaccctcctccaaagagcacctcgtggggcacagccggcctgggctgcctggtcaaggactacttcccgtgtctgatctgagcgggctgggcaaggcgcatagnnn

SEQ ID NO: 87948 - DNA, 430 bp, Homo sapiens
  misc_feature: GYAE6OF01EH0ZZ.5.70.G04.1.454.CMB.1.raw
  modified_base (220)..(220): a, c, t, g, unknown or other
  misc_feature (220)..(220): n is a, c, g, or t
  modified_base (423)..(430): a, c, t, g, unknown or other
  misc_feature (423)..(430): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaaagntcgggacgaagtggtggtggctgcaatcgactactggggcctgggaaccctggtcaccgtctcctcagcctccaccaagggcccatcggtcttccccctggccaccctcctccaagagcacctctggggcacagcggccctgggctgcctggtcaaggactacttcccgtgtctgatctgagcgggctggcaaggcgcatagnnnnnnnn

SEQ ID NO: 87949 - DNA, 426 bp, Homo sapiens
  misc_feature: GYAE6OF01EFH6K.5.70.G04.1.454.CMB.1.raw
  modified_base (420)..(426): a, c, t, g, unknown or other
  misc_feature (420)..(426): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaaagatcgggacgaagtggtggtggctgcaatcgactactggggcctgggaaccctggtcaccgtctcctcagcctccaccaagggcccatcggtcttccccctggcaccctcctccaagagcacctctggggcacagcggccctgggctgcctggtcaaggactactcccgtgtctgatctgagcggctggcaaggcgcatagnnnnnnn

SEQ ID NO: 87950 - DNA, 536 bp, Homo sapiens
  misc_feature: GYAE6OF01CBIL6.5.70.G04.1.454.CMB.1.raw
  modified_base (226)..(226): a, c, t, g, unknown or other
  misc_feature (226)..(226): n is a, c, g, or t
  modified_base (501)..(536): a, c, t, g, unknown or other
  misc_feature (501)..(536): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctaacaaatgaacagtctgagagttgaggacacggtcctttctattactgtgacaaaaaaggngtcgggaacgaaggttgggtggtgctgacaatcgactacgtggggcctcgggaacctggcaccgtctcctcacgcctccacgaacggcccagtccggtccttcccccgtggccctacccctccctaccaaacggtacgccctaccgttcggtcgggggccaccggacggccggcccggttgggctcggcccgtggtacaacgggtaccttaccgttcccggtgtctagtacgtcgtaggacggcgggtctacgggcgaaggccacgtatagcagnnnnnnnnnnnnnnnnnnnnnnnnnnnnnnnnnnnn

SEQ ID NO: 87951 - DNA, 535 bp, Homo sapiens
  misc_feature: GYAE6OF01AUR17.5.70.G04.1.454.CMB.1.raw
  modified_base (222)..(222): a, c, t, g, unknown or other
  misc_feature (222)..(222): n is a, c, g, or t
  modified_base (503)..(535): a, c, t, g, unknown or other
  misc_feature (503)..(535): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggcctttctattactgtgacaaaaagntcggggaacgaagtgggtggtggctggcaatcgactacgtgggcctgggaacccgtggtccaccgtctcctcacgccctccaaccgaacggggccccacgttccgggttccctttccccccgtcgggccctacccccgtccctaccgaacgtacgccacccgtcggtcgggggccacgacggcccggtccctggggcctggccctgggtacaacgggtacctacgttcccgtgtctgatcgtgacggcgggtcgtcggacgaacgggccgacgaagtacgnnnnnnnnnnnnnnnnnnnnnnnnnnnnnnnnn

SEQ ID NO: 87952 - DNA, 447 bp, Homo sapiens
  misc_feature: GYAE6OF01A1QKD.5.70.G04.1.454.CMB.1.raw
  modified_base (435)..(447): a, c, t, g, unknown or other
  misc_feature (435)..(447): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaaagatcggggacgaaggtggtggtggctgcaatcgactactggggcctggggaaccctggtcaccgtctcctcagcctccaccaagggcccatcggtcctccccctggcaccctcctccaagagcacctctgggggcacgagcggcccgtgggcctgccgtggtcaagggtactacgttcccgtgtcctgatctgagcgggctggcgaaggcgcatagnnnnnnnnnnnnn

SEQ ID NO: 87953 - DNA, 431 bp, Homo sapiens
  misc_feature: GYAE6OF01DSUHW.5.70.G04.1.454.CMB.1.raw
  modified_base (423)..(431): a, c, t, g, unknown or other
  misc_feature (423)..(431): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaaagatcggggacaagtggtggtggctgcaatcgactactggggcctgggaaccctggtcaccgtctcctcagcctccaccaagggcccatcggtcttccccctggccaccctcctccaagagcacctctggggcacagcggccctgggctgcctggcaaggctacttcccgtgtctgactctgagcgggctggcaaggcgcatagnnnnnnnnn

SEQ ID NO: 87954 - DNA, 432 bp, Homo sapiens
  misc_feature: GYAE6OF01C0U5K.5.70.G04.1.454.CMB.1.raw
  modified_base (425)..(432): a, c, t, g, unknown or other
  misc_feature (425)..(432): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactatggggcctgggaaccctggtcaccgtctcctcagcctccaccaagggccccatcggtcttccccctggccaccctcctccaagagcacctcgtgggggcacagcggccctgggctgcctggtcaaggctacttcccgtgtctgatctgagcgggctgggcaaggcgacatagnnnnnnnn

SEQ ID NO: 87955 - DNA, 468 bp, Homo sapiens
  misc_feature: GYAE6OF01ESZDS.5.70.G04.1.454.CMB.1.raw
  modified_base (221)..(221): a, c, t, g, unknown or other
  misc_feature (221)..(221): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (446)..(446): a, c, t, g, unknown or other
  misc_feature (446)..(446): n is a, c, g, or t
  modified_base (448)..(468): a, c, t, g, unknown or other
  misc_feature (448)..(468): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggcctttctattactgtgacaaaagntcgggaacgagtggtggtggctgcaatcgactacgtggggcctgggaaccctggtccaccgtctcctcagcctccaccaacgggcccatccggtccttcccccnggccaccctcctcaagcncacctcgtggggcacacgccggcctcgggctgcctggtcaaggtacctcgttcccgtgtctgtatctggaggcgggctcgggacgtaacggccgacgtatagncnnnnnnnnnnnnnnnnnnnnn

SEQ ID NO: 87956 - DNA, 645 bp, Homo sapiens
  misc_feature: GYAE6OF01EWKME.5.70.G04.1.454.CMB.1.raw
  modified_base (221)..(221): a, c, t, g, unknown or other
  misc_feature (221)..(221): n is a, c, g, or t
  modified_base (606)..(606): a, c, t, g, unknown or other
  misc_feature (606)..(606): n is a, c, g, or t
  modified_base (611)..(611): a, c, t, g, unknown or other
  misc_feature (611)..(611): n is a, c, g, or t
  modified_base (613)..(645): a, c, t, g, unknown or other
  misc_feature (613)..(645): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctaacaaatgaacagtctgagagttgaggacacggccttctattactgtgacaaaagngtcgggaacgaaggtggtgggtggctgacaatccgactacggtcggggccgtacggggaacccttggtacctacccgtcctcccgtacgaccgccccgtacccaaccccggaaccggggaccccctaccggttcccgggttcccctttccccccgtcggaccccctacccccttccccgtaccaacggaaccgccctaaccccggttcgggcgggggaccaaccggtaccggccccggtcccggtcggggtccgtccggtccgtacgggtaccgtaaacgggttcccttaccccgttttcccggtgttcccgttgtacgttaccggacgggtccggggacgggttcggtacgggaccgggaaaccgggcgtaaccgtaagtacgngcagngnnnnnnnnnnnnnnnnnnnnnnnnnnnnnnnnn

SEQ ID NO: 87957 - DNA, 573 bp, Homo sapiens
  misc_feature: GYAE6OF01AZV5H.5.70.G04.1.454.CMB.1.raw
  modified_base (535)..(535): a, c, t, g, unknown or other
  misc_feature (535)..(535): n is a, c, g, or t
  modified_base (538)..(573): a, c, t, g, unknown or other
  misc_feature (538)..(573): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaaagaactccctgtatctacaaatgaacagtctgagagttgaggacaccggccttctattactgtagacaaaaagagtcgggacgaaggtggtggtggctgcaagtcgacgtacgtggggccgtcgggaaccctggtccaccgttcctcctcgacgtccctacccaccgaacgggccccacgttcccggttcccttccccccgtcggccctacccctccctaccgaaacgacgccctaccctcggtcgggggccaccgacgccggtcccgtgggcctcggcccgttaggtaccgaacgggtacccttacccgtttcccggtagtcgtacgtacttcgtaggacgggtccggggtcgtcgggaccgaacgggtccgactaacgtacgngcnnnnnnnnnnnnnnnnnnnnnnnnnnnnnnnnnnnn

SEQ ID NO: 87958 - DNA, 580 bp, Homo sapiens
  misc_feature: GYAE6OF01CLWN9.5.70.G04.1.454.CMB.1.raw
  modified_base (223)..(223): a, c, t, g, unknown or other
  misc_feature (223)..(223): n is a, c, g, or t
  modified_base (543)..(544): a, c, t, g, unknown or other
  misc_feature (543)..(544): n is a, c, g, or t
  modified_base (546)..(546): a, c, t, g, unknown or other
  misc_feature (546)..(546): n is a, c, g, or t
  modified_base (548)..(550): a, c, t, g, unknown or other
  misc_feature (548)..(550): n is a, c, g, or t
  modified_base (552)..(580): a, c, t, g, unknown or other
  misc_feature (552)..(580): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacagtggcctttctattactgtgacaaaaagntcgggacgaagtggtggtggctgacatcgactacgtcgggccgtcggaacccgtggtcaccgtcctcctcacgccctccaccgaacggcccagtccggttccttcccccgttcggccctaccctccctacccaacggtacgccacctcggtcgggggaccaccgacggcccgggtccccgtgggccgtcgtcccggtacggtaccgtaaacgggtaacccgtttacccgtttaccccgttcgggtttctcgggtacttccgttcgggaacggggtccggggtccgttacgggaccgaacggggtccgaccgtagtaaggnngncnnngnnnnnnnnnnnnnnnnnnnnnnnnnnnnn

SEQ ID NO: 87959 - DNA, 609 bp, Homo sapiens
  misc_feature: GYAE6OF01CPN5P.5.70.G04.1.454.CMB.1.raw
  modified_base (319)..(319): a, c, t, g, unknown or other
  misc_feature (319)..(319): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (580)..(586): a, c, t, g, unknown or other
  misc_feature (580)..(586): n is a, c, g, or t
  modified_base (588)..(609): a, c, t, g, unknown or other
  misc_feature (588)..(609): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaaagaactccctgtatctaacaaatgaacagtctagagagttgaggacacggccttctattactgtgacaaaaagagtcggggaacgtaaggtggtgggtcggctgactaaagtccgaacgtacggtcggggacccgtacggggaaccccgtggtccacccgttccttccncacgtccctccgaaccgaacgggcccacgttcccggtcccttcccccgtggcccctacccttcctacccaaaggaccgacctacccgtcgggtacggggccaccggacggcccggcccgtcggggactcggcccgttagggtaccgaaacgggtcctttaacccggtttccccggttacgttccgtacggtccgttcggtacgggaccgggtccggggtcctcggggaacgaaccggggcggtactaagtcgangctgncnnnnnnntnnnnnnnnnnnnnnnnnnnnnn

SEQ ID NO: 87960 - DNA, 546 bp, Homo sapiens
  misc_feature: GYAE6OF01DJS6H.5.70.G04.1.454.CMB.1.raw
  modified_base (221)..(221): a, c, t, g, unknown or other
  misc_feature (221)..(221): n is a, c, g, or t
  modified_base (519)..(546): a, c, t, g, unknown or other
  misc_feature (519)..(546): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaacctccctgtatctacaaatgaacagtctgagagttgaggacacggccttctattactgtgacaaaagntcgggacgaagtgggtggtggctgcaatcgactacgtggggcctgggaaccctggtccaccgtctcctcacgcctaccaccgaacgggccccatccggtcccttcccccgtggacccaccccttcctacccgaaagacggaccacccgtcggtcgggggccacgacggccggcccgtggggcctcggtcccgtcgggtaccgaaacgggtacctttacccgttccccggttagttcctaggtacttcgtggacgggtaccgggtcgtacgggaccggaacgggccgtacacgtagcannnnnnnnnnnnnnnnnnnnnnnnnnnn

SEQ ID NO: 87961 - DNA, 419 bp, Homo sapiens
  misc_feature: GYAE6OF02JOP0B.5.70.G04.1.454.CMB.1.raw
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
  modified_base (419)..(419): a, c, t, g, unknown or other
  misc_feature (419)..(419): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctcagagacaacgccaagaactccctgtatctacaaatgaacagtctgagagttgaggacacggccttctattactgtgcaaaagntcgggacgaagtggtgtggctgcaatcgactactgggcctggaccctggtcnccgtctcctcagcctccaccaagggccccatcggtcttccccctggcacccctcctccaagagcacctctgggggcacagcggccctgggctgcctggtcaaggactacttcccgtgtctgatctgagcgggctggcaaggcgcatagn

SEQ ID NO: 87962 - DNA, 423 bp, Homo sapiens
  misc_feature: GYAE6OF02FHX6C.5.70.G04.1.454.CMB.1.raw
  modified_base (420)..(423): a, c, t, g, unknown or other
  misc_feature (420)..(423): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactggggcctgggaaccctggtcaccgtctcctcagcctccaccaagggcccatcggtcttcccctggcaccctcctccaagagcacctctggggcacagcggccctgggctgcctggtcaaggctacttcccgtgtctgatctgagcgggctgggcaaggcgcatagnnnn

SEQ ID NO: 87963 - DNA, 460 bp, Homo sapiens
  misc_feature: GYAE6OF02JMPEM.5.70.G04.1.454.CMB.1.raw
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (424)..(424): a, c, t, g, unknown or other
  misc_feature (424)..(424): n is a, c, g, or t
  modified_base (450)..(460): a, c, t, g, unknown or other
  misc_feature (450)..(460): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagctcgggacaagtggtggtggctgcaatcgactacgtgggcctgggaaccctggtcaccgtctctacngcctccaccgaagggcccagtccggtccttccccctggacctacccctcctcccaagcgccnccttcgnggggcaacgngtcggcccctgggcctggaccctggtccaacggccttacgttcccgtgtactgattcgngaggcggctggcaacggcgacagtgnnnnnnnnnnn

SEQ ID NO: 87964 - DNA, 433 bp, Homo sapiens
  misc_feature: GYAE6OF02HVTFD.5.70.G04.1.454.CMB.1.raw
  modified_base (426)..(433): a, c, t, g, unknown or other
  misc_feature (426)..(433): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactggggcctgggaaccctggtcaccgtctcctcagcctccaccaagggcccatcggtcttccccctggccaccctcctccaagacgcacctcgtgggggcacagccggccctgggctgcctggtcaaggactacttctcgtgtctgatctgagcgggctggcaaggcgcatagnnnnnnnn

SEQ ID NO: 87965 - DNA, 431 bp, Homo sapiens
  misc_feature: GYAE6OF02GCLEN.5.70.G04.1.454.CMB.1.raw
  modified_base (402)..(402): a, c, t, g, unknown or other
  misc_feature (402)..(402): n is a, c, g, or t
  modified_base (423)..(431): a, c, t, g, unknown or other
  misc_feature (423)..(431): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactggggcctgggaaccctggtcaccgtctcctcagcctccaccaagggcccatcggtcttccccctggccaccctcctccaagacgcacctctggggcacagcgcctgggctgcctggtcaggactacttcccgtgtctgatctggggancgggctggcaaggcgcatagnnnnnnnnn

SEQ ID NO: 87966 - DNA, 441 bp, Homo sapiens
  misc_feature: GYAE6OF02F1MRQ.5.70.G04.1.454.CMB.1.raw
  modified_base (421)..(421): a, c, t, g, unknown or other
  misc_feature (421)..(421): n is a, c, g, or t
  modified_base (423)..(441): a, c, t, g, unknown or other
  misc_feature (423)..(441): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaaagatcgggacgaagtggtggtggctgcaatcgactactgggcctgggaaccctggtcaccgtctcctcagcctccaccaagggcccatcggtcttccccctggcaccctcctccaagagcacctctgggggcacagcggccctgggctgcctggtaagactacttcccgtgtctgatcgtgagcgggctggcaaggcgcatagncnnnnnnnnnnnnnnnnnnn

SEQ ID NO: 87967 - DNA, 902 bp, Homo sapiens
  misc_feature: GYAE6OF02H4DMO.5.70.G04.1.454.CMB.1.raw
  modified_base (807)..(807): a, c, t, g, unknown or other
  misc_feature (807)..(807): n is a, c, g, or t
  modified_base (855)..(855): a, c, t, g, unknown or other
  misc_feature (855)..(855): n is a, c, g, or t
tcagatcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaacctccctgtatctaacaaatgaacagtctgagagttgaggacaccggccttctattactgtagacaaaagagtcgggaacgtaaggtggtgggtgctgacaagtcgacttacggtggggccgttacgggaacccgttgggtacccgtacccgttaccgtccttacgaaccgtcccttacccgaaacccggaaccgggtcccccctaaaggtttcccccgggttttccccccctttttaccccccggaccgggttacccccccttaacccccccgttacccccgtttaaacccccggaaaacggtaacccgggtaccccttaacccccggttaccccggggggttaaccgggggggaacccccaacccgggtaaacccgggggttccccccggggtcccccggggtttacggggggtccccttacccggggtccccccgggtttaaaacggggtaaaccccggtaaacccgggggtaaacccttttttaaccccccgggttttcccccggggttacggtttacccggttttacggtacccgttttaccgggttaacggggtaccccgggggacccgggggtttcccgggtaaccgggggtaaaccggtaaacccgggggtccgtaacccgggaaagtttacggagcggttaggangacacagtacgtacgagtacgacgacgcgtacgtcgtacgagtcgacncgagtcgtcgacggacatacgtacgccgtagactgactcgtcgtacg

SEQ ID NO: 87968 - DNA, 605 bp, Homo sapiens
  misc_feature: GYAE6OF02GMTZ5.5.70.G04.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (561)..(562): a, c, t, g, unknown or other
  misc_feature (561)..(562): n is a, c, g, or t
  modified_base (566)..(574): a, c, t, g, unknown or other
  misc_feature (566)..(574): n is a, c, g, or t
  modified_base (576)..(577): a, c, t, g, unknown or other
  misc_feature (576)..(577): n is a, c, g, or t
  modified_base (580)..(581): a, c, t, g, unknown or other
  misc_feature (580)..(581): n is a, c, g, or t
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
  modified_base (591)..(596): a, c, t, g, unknown or other
  misc_feature (591)..(596): n is a, c, g, or t
  modified_base (599)..(605): a, c, t, g, unknown or other
  misc_feature (599)..(605): n is a, c, g, or t
tcagatcagacacgcacgaccggtgctcgatttagtgtagtgtgaagggaagggcctggagtgggtctcaggtattacttggaatagtggtgacataggctatgcggactctatgaagggccgcttcaccatcctccagagacaacgccaaagaactccctgtatctaacaaatgaacagtctgagagttgaggacacggcctttctattacngtgacaaaaagntcgggacgaagtggtggtggctgcaaatcgacttacgtggggcctgggaaccctggtcctaccggtcctcctcacgccctacccaccgaaccgggccccaacgttcccggtccctttacccccccgtggcccctacccccgttaccctacccgaaacgaccgtacccaacccgtcggtaccgggggccaaccgacggcccggccccgttaggggcctcggtcccgttacgggtaccaaacgggtaccctttaccggtttcccgtacgttctacgtacttccgtggacgggtccgggcgttcgggaccgagggtaccggtacaacgttacgagtcgnngacnnnnnnnnncnngcnngnngngnngnnnnnngcnnnnnnn

SEQ ID NO: 87969 - DNA, 250 bp, Homo sapiens
  misc_feature: GYAE6OF01B1JBW.49.10.A10.1.454.CMB.1.raw
  modified_base (249)..(250): a, c, t, g, unknown or other
  misc_feature (249)..(250): n is a, c, g, or t
tcagagtcgagagacacgaccggtgctcgatttagcgtcgatctcagggatggccaccctgaccattaccagggccgaagccgggatgaggccgactattactgtcaggtgtgggatagtgatacggaccattgggtgttcggcggagggaccaaggtgaccgtcctaggtcagcccaaggctgcccctcggtcactctgttcccgcctcctctctctcgactctgagcgggctggcaaggcgcatagnn

SEQ ID NO: 87970 - DNA, 255 bp, Homo sapiens
  misc_feature: GYAE6OF01CTRXI.49.10.A10.1.454.CMB.1.raw
  modified_base (252)..(255): a, c, t, g, unknown or other
  misc_feature (252)..(255): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagnnnn

SEQ ID NO: 87971 - DNA, 255 bp, Homo sapiens
  misc_feature: GYAE6OF01D5N2Z.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnn

SEQ ID NO: 87972 - DNA, 253 bp, Homo sapiens
  misc_feature: GYAE6OF01B363K.49.10.A10.1.454.CMB.1.raw
  modified_base (253)..(253): a, c, t, g, unknown or other
  misc_feature (253)..(253): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagn

SEQ ID NO: 87973 - DNA, 256 bp, Homo sapiens
  misc_feature: GYAE6OF01EUDGC.49.10.A10.1.454.CMB.1.raw
  modified_base (255)..(256): a, c, t, g, unknown or other
  misc_feature (255)..(256): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnn

SEQ ID NO: 87974 - DNA, 253 bp, Homo sapiens; identical to SEQ ID NO: 87972
  misc_feature: GYAE6OF01D5HIW.49.10.A10.1.454.CMB.1.raw
  modified_base (253)..(253): a, c, t, g, unknown or other
  misc_feature (253)..(253): n is a, c, g, or t

SEQ ID NO: 87975 - DNA, 251 bp, Homo sapiens
  misc_feature: GYAE6OF01CPUVD.49.10.A10.1.454.CMB.1.raw
  modified_base (250)..(251): a, c, t, g, unknown or other
  misc_feature (250)..(251): n is a, c, g, or t
tcagagtcgagagacacgaccggtgctcgatttagcgtcgatctcagggatggccaccctgaccattaccagggccgaagccgggatgaggccgactattactgtcaggtgtgggatagtgatacggaccattgggtgttcggcggagggaccaaggtgaccgtcctaggtcagcccaaggctgcccctcggtcactctgttcccaccctcctctctctcgactctgagcgggctggcaaggcgcatagnn

SEQ ID NO: 87976 - DNA, 254 bp, Homo sapiens
  misc_feature: GYAE6OF01CY628.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnn

SEQ ID NO: 87977 - DNA, 256 bp, Homo sapiens
  misc_feature: GYAE6OF01D7TKM.49.10.A10.1.454.CMB.1.raw
  modified_base (253)..(256): a, c, t, g, unknown or other
  misc_feature (253)..(256): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnnn

SEQ ID NO: 87978 - DNA, 261 bp, Homo sapiens
  misc_feature: GYAE6OF01C8XEQ.49.10.A10.1.454.CMB.1.raw
  modified_base (254)..(261): a, c, t, g, unknown or other
  misc_feature (254)..(261): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnnnnnnn

SEQ ID NO: 87979 - DNA, 255 bp, Homo sapiens; identical to SEQ ID NO: 87971
  misc_feature: GYAE6OF01AKO8X.49.10.A10.1.454.CMB.1.raw
  modified_base (253)..(255): a, c, t, g, unknown or other
  misc_feature (253)..(255): n is a, c, g, or t

SEQ ID NO: 87980 - DNA, 316 bp, Homo sapiens
  misc_feature: GYAE6OF01CXP7M.49.10.A10.1.454.CMB.1.raw
  modified_base (276)..(316): a, c, t, g, unknown or other
  misc_feature (276)..(316): n is a, c, g, or t
tcagagtcgagagacacgaccggtgctcgatttagcgtcgatctcaggggagatgggccaaccctgaccctacttaccgagggaccgaacggccgggatgaggccgactattactgtcgaggtggtgggatagtgatacggaccagttgggtggtcggcggagggaccaaggtgaccgtcctaggtcagacccaaggctcgccccctggtcactctcgttcccgccctcctctctctcgactcgtgacggcgggctggacgaacggccgcaatagnnnnnnnnnnnnnnnnnnnnnnnnnnnnnnnnnnnnnnnnn

SEQ ID NO: 87981 - DNA, 254 bp, Homo sapiens
  misc_feature: GYAE6OF01BZWDL.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnn

SEQ ID NO: 87982 - DNA, 272 bp, Homo sapiens
  misc_feature: GYAE6OF01BE2WE.49.10.A10.1.454.CMB.1.raw
  modified_base (254)..(272): a, c, t, g, unknown or other
  misc_feature (254)..(272): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctctctctctcgactctgagcgggctggcaaggcgcatagnnnnnnnnnnnnnnnnnnn

SEQ ID NO: 87983 - DNA, 255 bp, Homo sapiens
  misc_feature: GYAE6OF01AOPS4.49.10.A10.1.454.CMB.1.raw
  modified_base (252)..(255): a, c, t, g, unknown or other
  misc_feature (252)..(255): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagnnnn

SEQ ID NO: 87984 - DNA, 254 bp, Homo sapiens
  misc_feature: GYAE6OF01BGF18.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcgagggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagnn

SEQ ID NO: 87985 - DNA, 256 bp, Homo sapiens; identical to SEQ ID NO: 87973
  misc_feature: GYAE6OF01C6F74.49.10.A10.1.454.CMB.1.raw
  modified_base (255)..(256): a, c, t, g, unknown or other
  misc_feature (255)..(256): n is a, c, g, or t

SEQ ID NO: 87986 - DNA, 254 bp, Homo sapiens; identical to SEQ ID NO: 87981
  misc_feature: GYAE6OF01EGAQO.49.10.A10.1.454.CMB.1.raw
  modified_base (253)..(254): a, c, t, g, unknown or other
  misc_feature (253)..(254): n is a, c, g, or t

SEQ ID NO: 87987 - DNA, 255 bp, Homo sapiens; identical to SEQ ID NO: 87983
  misc_feature: GYAE6OF01B88F1.49.10.A10.1.454.CMB.1.raw
  modified_base (252)..(255): a, c, t, g, unknown or other
  misc_feature (252)..(255): n is a, c, g, or t

SEQ ID NO: 87988 - DNA, 256 bp, Homo sapiens
  misc_feature: GYAE6OF01DAAVZ.49.10.A10.1.454.CMB.1.raw
  modified_base (253)..(256): a, c, t, g, unknown or other
  misc_feature (253)..(256): n is a, c, g, or t
tcagagtcgagagacacgaccggtgctcgatttagcgtcgatctcaggggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnn

SEQ ID NO: 87989 - DNA, 256 bp, Homo sapiens
  misc_feature: GYAE6OF01DWPPT.49.10.A10.1.454.CMB.1.raw
  modified_base (254)..(256): a, c, t, g, unknown or other
  misc_feature (254)..(256): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnn

SEQ ID NO: 87990 - DNA, 256 bp, Homo sapiens
  misc_feature: GYAE6OF01CCK9Y.49.10.A10.1.454.CMB.1.raw
  modified_base (255)..(256): a, c, t, g, unknown or other
  misc_feature (255)..(256): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnn

SEQ ID NO: 87991 - DNA, 256 bp, Homo sapiens
  misc_feature: GYAE6OF01CM68K.49.10.A10.1.454.CMB.1.raw
  modified_base (254)..(256): a, c, t, g, unknown or other
  misc_feature (254)..(256): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnn

SEQ ID NO: 87992 - DNA, 254 bp, Homo sapiens; identical to SEQ ID NO: 87976
  misc_feature: GYAE6OF01BDQNK.49.10.A10.1.454.CMB.1.raw
  modified_base (253)..(254): a, c, t, g, unknown or other
  misc_feature (253)..(254): n is a, c, g, or t

SEQ ID NO: 87993 - DNA, 279 bp, Homo sapiens
  misc_feature: GYAE6OF01B73VG.49.10.A10.1.454.CMB.1.raw
  modified_base (249)..(249): a, c, t, g, unknown or other
  misc_feature (249)..(249): n is a, c, g, or t
  modified_base (255)..(279): a, c, t, g, unknown or other
  misc_feature (255)..(279): n is a, c, g, or t
tcagagtcgagagacacgaccggtgctcgatttagcgtcgatctcgaggggagagtggccaccctgaccattaccagggccgaagccggggatgaggccgactattactgtcaggtgtggatagtgatacggaccattgggtgttcggcggagggaccaaggtgaccgtcctaggtcagcccaaggctgccccctggtcactctgttcccgcctcctctctctcgactctgagcgggctggcaagggcncatagnnnnnnnnnnnnnnnnnnnnnnnnn

SEQ ID NO: 87994 - DNA, 255 bp, Homo sapiens
  misc_feature: GYAE6OF01CS698.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcagggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnn

SEQ ID NO: 87995 - DNA, 257 bp, Homo sapiens
  misc_feature: GYAE6OF01BXPRH.49.10.A10.1.454.CMB.1.raw
  modified_base (254)..(257): a, c, t, g, unknown or other
  misc_feature (254)..(257): n is a, c, g, or t
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnn

SEQ ID NO: 87996 - DNA, 256 bp, Homo sapiens
  misc_feature: GYAE6OF01AFY2G.49.10.A10.1.454.CMB.1.raw
  modified_base (255)..(256): a, c, t, g, unknown or other
  misc_feature (255)..(256): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctccgactctgagcgggctggcaaggcgcatagnn

SEQ ID NO: 87997 - DNA, 265 bp, Homo sapiens
  misc_feature: GYAE6OF01D9F01.49.10.A10.1.454.CMB.1.raw
  modified_base (253)..(265): a, c, t, g, unknown or other
  misc_feature (253)..(265): n is a, c, g, or t
tcagagtcgagagacacgaccggtgctcgatttagcgtcgatctcaggggaggatggccaccctgaccattaccagggccgaagccggggatgaggccgactattactgtcaggtgtgggatagtgatacggaccattgggtgttcggcggagggaccaaggtgaccgtcctaggtcagcccaaggctgcccctggtcactctgttcccgcctcctctctctcgactctgagcgggctggcaaggcgcatagnnnnnnnnnnnnn

SEQ ID NO: 87998 - DNA, 255 bp, Homo sapiens
  misc_feature: GYAE6OF01A857Q.49.10.A10.1.454.CMB.1.raw
  modified_base (254)..(255): a, c, t, g, unknown or other
  misc_feature (254)..(255): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnn

SEQ ID NO: 87999 - DNA, 254 bp, Homo sapiens
  misc_feature: GYAE6OF01BV3ZZ.49.10.A10.1.454.CMB.1.raw
  modified_base (254)..(254): a, c, t, g, unknown or other
  misc_feature (254)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagn

SEQ ID NO: 88000 - DNA, 253 bp, Homo sapiens
  misc_feature: GYAE6OF01BQLUJ.49.10.A10.1.454.CMB.1.raw
  modified_base (252)..(253): a, c, t, g, unknown or other
  misc_feature (252)..(253): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagnn

SEQ ID NO: 88001 - DNA, 251 bp, Homo sapiens
  misc_feature: GYAE6OF01DNX88.49.10.A10.1.454.CMB.1.raw
  modified_base (161)..(161): a, c, t, g, unknown or other
  misc_feature (161)..(161): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (250)..(251): a, c, t, g, unknown or other
  misc_feature (250)..(251): n is a, c, g, or t
tcagagtcgagagacacgaccggtgctcgatttagcgtcgatctcaggggagatggccaccctgaccattaccagggccgaagccggggatgaggccgactattactgtcaggtgtggatagtgatacggaccattgggtgttcggcggaggaccaaggtnaccgtcctaggcagcccaaggctgccccctggtcactctgttcccgccctctctctctcgactntgagcgggctggcaaggcncatagnn

SEQ ID NO: 88002 - DNA, 274 bp, Homo sapiens
  misc_feature: GYAE6OF01DKVFW.49.10.A10.1.454.CMB.1.raw
  modified_base (257)..(274): a, c, t, g, unknown or other
  misc_feature (257)..(274): n is a, c, g, or t
tcagagtcgagagacacgaccggtgctcgatttagcgtcgatctcgaaggggggatggccaccctgaccattaccagggccgaagccggggatgaggccgactacttactgtcaggtgtggggatagtgatacggaccattgggtgttcggcggagggaccaaggtgaccgtcctaggtcagcccaaggctgccccctcggtcactctgttcccactcctctctctcgactctgagcgggctggcaaggcgcatagnnnnnnnnnnnnnnnnnn

SEQ ID NO: 88003 - DNA, 261 bp, Homo sapiens
  misc_feature: GYAE6OF01A3ME3.49.10.A10.1.454.CMB.1.raw
  modified_base (254)..(261): a, c, t, g, unknown or other
  misc_feature (254)..(261): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnnnnn

SEQ ID NO: 88004 - DNA, 272 bp, Homo sapiens
  misc_feature: GYAE6OF01BGYVX.49.10.A10.1.454.CMB.1.raw
  modified_base (254)..(272): a, c, t, g, unknown or other
  misc_feature (254)..(272): n is a, c, g, or t
tcagagtcgagagacacgaccggtgctcgatttagcgtcgatctcgaggggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnnnnnnnnnnnnnnnnn

SEQ ID NO: 88005 - DNA, 274 bp, Homo sapiens
  misc_feature: GYAE6OF01E3GRQ.49.10.A10.1.454.CMB.1.raw
  modified_base (255)..(274): a, c, t, g, unknown or other
  misc_feature (255)..(274): n is a, c, g, or t
tcagagtcgagagacacgaccggtgctcgatttagcgtcgatctcagggggagtggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnnnnnnnnnnnnnnnnn

SEQ ID NO: 88006 - DNA, 255 bp, Homo sapiens
  misc_feature: GYAE6OF01AXYTQ.49.10.A10.1.454.CMB.1.raw
  modified_base (254)..(255): a, c, t, g, unknown or other
  misc_feature (254)..(255): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnn

SEQ ID NO: 88007 - DNA, 258 bp, Homo sapiens
  misc_feature: GYAE6OF01C3CH5.49.10.A10.1.454.CMB.1.raw
  modified_base (254)..(258): a, c, t, g, unknown or other
  misc_feature (254)..(258): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnn

SEQ ID NO: 88008 - DNA, 257 bp, Homo sapiens
  misc_feature: GYAE6OF01BB7IX.49.10.A10.1.454.CMB.1.raw
  modified_base (255)..(257): a, c, t, g, unknown or other
  misc_feature (255)..(257): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnn

SEQ ID NO: 88009 - DNA, 258 bp, Homo sapiens
  misc_feature: GYAE6OF01EGZ2G.49.10.A10.1.454.CMB.1.raw
  modified_base (255)..(258): a, c, t, g, unknown or other
  misc_feature (255)..(258): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnn

SEQ ID NO: 88010 - DNA, 256 bp, Homo sapiens; identical to SEQ ID NO: 87991
  misc_feature: GYAE6OF01CO6QW.49.10.A10.1.454.CMB.1.raw
  modified_base (254)..(256): a, c, t, g, unknown or other
  misc_feature (254)..(256): n is a, c, g, or t

SEQ ID NO: 88011 - DNA, 256 bp, Homo sapiens
  misc_feature: GYAE6OF01CGCBL.49.10.A10.1.454.CMB.1.raw
  modified_base (252)..(256): a, c, t, g, unknown or other
  misc_feature (252)..(256): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtctaggtcagcccaaggctgccccctggtcactctgttcccgccctcctctctctcgactctgagcgggctggcaaggcgcatagnnnnn

SEQ ID NO: 88012 - DNA, 280 bp, Homo sapiens
  misc_feature: GYAE6OF01ERO9Z.49.10.A10.1.454.CMB.1.raw
  modified_base (256)..(280): a, c, t, g, unknown or other
  misc_feature (256)..(280): n is a, c, g, or t
tcagagtcgagagacacgaccggtgctcgatttagcgtcgatctcaggggggagtggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnnnnnnnnnnnnnnnnnnnnnn

SEQ ID NO: 88013 - DNA, 255 bp, Homo sapiens
  misc_feature: GYAE6OF01DQT9T.49.10.A10.1.454.CMB.1.raw
  modified_base (255)..(255): a, c, t, g, unknown or other
  misc_feature (255)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagn

SEQ ID NO: 88014 - DNA, 284 bp, Homo sapiens
  misc_feature: GYAE6OF01D9LQT.49.10.A10.1.454.CMB.1.raw
  modified_base (256)..(284): a, c, t, g, unknown or other
  misc_feature (256)..(284): n is a, c, g, or t
tcagagtcgagagacacgaccggtgctcgatttagcgtcgatctcgaggggggatggccaccctgaccattaccagggccgaagccggggatgaggccgactacttactgtcaggtgtgggatagtgatacggaccattggggtgttcgggcggagggaccaaggtgaccgtcctaggtcagcccaaggctgccccctggtcactctgttcccactcctctctctcgactctgagcgggctggcaaggcgcatagnnnnnnnnnnnnnnnnnnnnnnnnnnnnn

SEQ ID NO: 88015 - DNA, 255 bp, Homo sapiens
  misc_feature: GYAE6OF01CIYWU.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtctaggtcagcccaaggctgccccctcggtcactctgttcccaccctcctctctctcgactctgagcgggctggcaaggcgcatagnnn

SEQ ID NO: 88016 - DNA, 273 bp, Homo sapiens
  misc_feature: GYAE6OF01CU56S.49.10.A10.1.454.CMB.1.raw
  modified_base (250)..(250): a, c, t, g, unknown or other
  misc_feature (250)..(250): n is a, c, g, or t
  modified_base (256)..(273): a, c, t, g, unknown or other
  misc_feature (256)..(273): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctcgttcccaccctcctctcgtctcgactctgagcgggctggcaaggcncatagnnnnnnnnnnnnnnnnnn

SEQ ID NO: 88017 - DNA, 256 bp, Homo sapiens
  misc_feature: GYAE6OF01EZ9ZL.49.10.A10.1.454.CMB.1.raw
  modified_base (252)..(256): a, c, t, g, unknown or other
  misc_feature (252)..(256): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcggctggcaaggcgcatagnnnnn

SEQ ID NO: 88018 - DNA, 255 bp, Homo sapiens
  misc_feature: GYAE6OF01C945U.49.10.A10.1.454.CMB.1.raw
  modified_base (255)..(255): a, c, t, g, unknown or other
  misc_feature (255)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagn

SEQ ID NO: 88019 - DNA, 254 bp, Homo sapiens
  misc_feature: GYAE6OF01D73Q8.49.10.A10.1.454.CMB.1.raw
  modified_base (252)..(254): a, c, t, g, unknown or other
  misc_feature (252)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgcccctcggtcactctgttcccacctcctctctctcgactctgagcgggctggcaaggcgcatagnnn

SEQ ID NO: 88020 - DNA, 275 bp, Homo sapiens
  misc_feature: GYAE6OF01BEG37.49.10.A10.1.454.CMB.1.raw
  modified_base (255)..(275): a, c, t, g, unknown or other
  misc_feature (255)..(275): n is a, c, g, or t
tcagagtcgagagacacgaccggtgctcgatttagcgtcgatctcagggggggataggccaccctgaccattaccagggccgaagccggggatgaggccgactattactgtcaggtgtgggatagtgattacggaccattgggtgttcggcggagggaccaaggtgaccgtcctaggtcagcccaaggctgccccctggtcactctgttcccacctctctctctcgactctgagcgggctggcaaggcgcatagnnnnnnnnnnnnnnnnnnnnn

SEQ ID NO: 88021 - DNA, 256 bp, Homo sapiens; identical to SEQ ID NO: 87990
  misc_feature: GYAE6OF01DKMIR.49.10.A10.1.454.CMB.1.raw
  modified_base (255)..(256): a, c, t, g, unknown or other
  misc_feature (255)..(256): n is a, c, g, or t

SEQ ID NO: 88022 - DNA, 263 bp, Homo sapiens
  misc_feature: GYAE6OF01B988Y.49.10.A10.1.454.CMB.1.raw
  modified_base (252)..(263): a, c, t, g, unknown or other
  misc_feature (252)..(263): n is a, c, g, or t
tcagagtcgagagacacgaccggtgctcgatttagcgtcgatctcagggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnnnnnnnnnnn

SEQ ID NO: 88023 - DNA, 279 bp, Homo sapiens
  misc_feature: GYAE6OF01CP6CK.49.10.A10.1.454.CMB.1.raw
  modified_base (254)..(254): a, c, t, g, unknown or other
  misc_feature (254)..(254): n is a, c, g, or t
  modified_base (257)..(279): a, c, t, g, unknown or other
  misc_feature (257)..(279): n is a, c, g, or t
tcagagtcgagagacacgaccggtgctcgatttagcgtcgatctcaggggggtagtggccaccctgaccattaccagggccgaagccggggatgaggccgactattactgtcaggtgtgggatagtgactacggaccattgggtgttcggcggaggaccaaggtgaccgtctaggtcagcccaaggctcgccccctggtcactctgttcccaccctccgtctctctcgactctgacgcggctggcaaggcgcanagnnnnnnnnnnnnnnnnnnnnnnn

SEQ ID NO: 88024 - DNA, 258 bp, Homo sapiens; identical to SEQ ID NO: 88009
  misc_feature: GYAE6OF01BH3GR.49.10.A10.1.454.CMB.1.raw
  modified_base (255)..(258): a, c, t, g, unknown or other
  misc_feature (255)..(258): n is a, c, g, or t

SEQ ID NO: 88025 - DNA, 259 bp, Homo sapiens
  misc_feature: GYAE6OF01C40M4.49.10.A10.1.454.CMB.1.raw
  modified_base (255)..(259): a, c, t, g, unknown or other
  misc_feature (255)..(259): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctcgttcccacctcctctctctcgactctgagcgggctggcaaggcgcatagnnnnn

SEQ ID NO: 88026 - DNA, 257 bp, Homo sapiens
  misc_feature: GYAE6OF01DH29W.49.10.A10.1.454.CMB.1.raw
  modified_base (254)..(257): a, c, t, g, unknown or other
  misc_feature (254)..(257): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnn

SEQ ID NO: 88027 - DNA, 258 bp, Homo sapiens
  misc_feature: GYAE6OF01AVL0P.49.10.A10.1.454.CMB.1.raw
  modified_base (254)..(258): a, c, t, g, unknown or other
  misc_feature (254)..(258): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctccgactctgagcgggctggcaaggcgcatagnnnnn

SEQ ID NO: 88028 - DNA, 255 bp, Homo sapiens
  misc_feature: GYAE6OF01CUX45.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcaggggagatggccaccctgaccattaccagggccgaagccggggatgaggccgactattactgtcaggtgtggatagtgatacggaccattgggtgttcggcggagggaccaaggtgaccgtcctaggtcagcccaaggctgccccctggtcactctgttcccaccctcctctctctcgactctgagcgggctggcaaggcgcatagnnn

SEQ ID NO: 88029 - DNA, 326 bp, Homo sapiens
  misc_feature: GYAE6OF01D18DS.49.10.A10.1.454.CMB.1.raw
  modified_base (268)..(326): a, c, t, g, unknown or other
  misc_feature (268)..(326): n is a, c, g, or t
tcagagtcgagagacacgaccggtgctcgatttagcgtcgatctcagggggtaggatggccaccctgacccattaccaagggccgaagccggggatgaggccgactattacctgtcaggtgtgggatagtgatacgggaccagttgggtgttcgggcggagggaccaaggtgaccgtcctaggtcagcccaaggctcgccccctcggtcactctgttcccaccctcctctctctcgactctgagcgggctgggcaaggcgcagtagcnnnnnnnnnnnnnnnnnnnnnnnnnnnnnnnnnnnnnnnnnnnnnnnnnnnnnnnnnnn

SEQ ID NO: 88030 - DNA, 257 bp, Homo sapiens
  misc_feature: GYAE6OF01BBYRU.49.10.A10.1.454.CMB.1.raw
  modified_base (254)..(257): a, c, t, g, unknown or other
  misc_feature (254)..(257): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagnnnn

SEQ ID NO: 88031 - DNA, 293 bp, Homo sapiens
  misc_feature: GYAE6OF01ECR53.49.10.A10.1.454.CMB.1.raw
  modified_base (265)..(293): a, c, t, g, unknown or other
  misc_feature (265)..(293): n is a, c, g, or t
tcagagtcgagagacacgaccggtgctcgatttagcgtcgatctcgtagggggacgaatggcccaccctggaccattacccagggccgaagccggggatgaggccgactattactgtcaggtgtgggatagtgtatacgggaccattgggtgttcggcggagggaccaaggtgaccgtcctaggtcagcccaaggctgccccctggtcactctgttcccaccctcctctcgtctcgactctgagcgggctggcaaggcgcatagnnnnnnnnnnnnnnnnnnnnnnnnnnnnn

SEQ ID NO: 88032 - DNA, 257 bp, Homo sapiens
  misc_feature: GYAE6OF01DO7NW.49.10.A10.1.454.CMB.1.raw
  modified_base (255)..(257): a, c, t, g, unknown or other
  misc_feature (255)..(257): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnn

SEQ ID NO: 88033 - DNA, 422 bp, Homo sapiens
  misc_feature: GYAE6OF01A4TS7.49.10.A10.1.454.CMB.1.raw
  modified_base (120)..(120): a, c, t, g, unknown or other
  misc_feature (120)..(120): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (313)..(314): a, c, t, g, unknown or other
  misc_feature (313)..(314): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (328)..(329): a, c, t, g, unknown or other
  misc_feature (328)..(329): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (345)..(346): a, c, t, g, unknown or other
  misc_feature (345)..(346): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (370)..(422): a, c, t, g, unknown or other
  misc_feature (370)..(422): n is a, c, g, or t
tcagagtcgagagacacgaccggtgctcgattttagcgtcgatctctaggggggtaggatcggaccaccctggaccagttaccgagggccggaagccggggatgaggccggactattacngtcaggtgtgggactagtgatacgggaccattgggtgttcggcggagggaccaaggtgaccgtcctaggtccagcccaaggtctgccccctggtcactctgttccctacctcctctctcttccggactctggagacggggctgggcaacgggccncatagcncncagcangctcccagcactcncacagcncnncgncngcgcgcgcnncngcagactctcangnntctgngcggcgcgcgagcgcntgnnnnnnnnnnnnnnnnnnnnnnnnnnnnnnnnnnnnnnnnnnnnnnnnnnnnn

SEQ ID NO: 88034 - DNA, 298 bp, Homo sapiens
  misc_feature: GYAE6OF01AWO4T.49.10.A10.1.454.CMB.1.raw
  modified_base (255)..(260): a, c, t, g, unknown or other
  misc_feature (255)..(260): n is a, c, g, or t
  modified_base (262)..(298): a, c, t, g, unknown or other
  misc_feature (262)..(298): n is a, c, g, or t
tcagagtcgagagacacgaccggtgctcgatttagcgtcgatctcagggggggatggccaccctgaccattaccagggccgaagccggggatgaggccgaactattactgtcaggtgtgggatagtgatacgggaccattggggtgttcgggcggagggaccaagggtgaccgtcctaggtcagcccaaggctgccccctggtcactccgttccacctctctctctcgactctgagcgggctggcaggcgcatgnnnnnnannnnnnnnnnnnnnnnnnnnnnnnnnnnnnnnnnnnn

SEQ ID NO: 88035 - DNA, 256 bp, Homo sapiens
  misc_feature: GYAE6OF01BKCHE.49.10.A10.1.454.CMB.1.raw
  modified_base (254)..(256): a, c, t, g, unknown or other
  misc_feature (254)..(256): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnn

SEQ ID NO: 88036 - DNA, 255 bp, Homo sapiens
  misc_feature: GYAE6OF01CGHIZ.49.10.A10.1.454.CMB.1.raw
  modified_base (254)..(255): a, c, t, g, unknown or other
  misc_feature (254)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnn

SEQ ID NO: 88037 - DNA, 254 bp, Homo sapiens
  misc_feature: GYAE6OF01D2HRD.49.10.A10.1.454.CMB.1.raw
  modified_base (246)..(246): a, c, t, g, unknown or other
  misc_feature (246)..(246): n is a, c, g, or t
  modified_base (252)..(254): a, c, t, g, unknown or other
  misc_feature (252)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaggcncatagnnn

SEQ ID NO: 88038 - DNA, 257 bp, Homo sapiens
  misc_feature: GYAE6OF01CM2EJ.49.10.A10.1.454.CMB.1.raw
  modified_base (252)..(257): a, c, t, g, unknown or other
  misc_feature (252)..(257): n is a, c, g, or t
tcagagtcgagagacacgaccggtgctcgatttagcgtcgatctcaggggggatgggccaccctgacccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccacctcctctcgactctgagcgggctggcaaggcgcatagnnnnnn

SEQ ID NO: 88039 - DNA, 255 bp, Homo sapiens; identical to SEQ ID NO: 87998
  misc_feature: GYAE6OF01BS7VX.49.10.A10.1.454.CMB.1.raw
  modified_base (254)..(255): a, c, t, g, unknown or other
  misc_feature (254)..(255): n is a, c, g, or t

SEQ ID NO: 88040 - DNA, 256 bp, Homo sapiens; identical to SEQ ID NO: 87989
  misc_feature: GYAE6OF01DWGGM.49.10.A10.1.454.CMB.1.raw
  modified_base (254)..(256): a, c, t, g, unknown or other
  misc_feature (254)..(256): n is a, c, g, or t

SEQ ID NO: 88041 - DNA, 256 bp, Homo sapiens
  misc_feature: GYAE6OF01DBYB8.49.10.A10.1.454.CMB.1.raw
  modified_base (254)..(256): a, c, t, g, unknown or other
  misc_feature (254)..(256): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnn

SEQ ID NO: 88042 - DNA, 257 bp, Homo sapiens
  misc_feature: GYAE6OF01BTULE.49.10.A10.1.454.CMB.1.raw
  modified_base (254)..(257): a, c, t, g, unknown or other
  misc_feature (254)..(257): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnnn

SEQ ID NO: 88043 - DNA, 337 bp, Homo sapiens
  misc_feature: GYAE6OF01BD93Q.49.10.A10.1.454.CMB.1.raw
  modified_base (285)..(337): a, c, t, g, unknown or other
  misc_feature (285)..(337): n is a, c, g, or t
tcagagtcgagagacacgaccggtgctcgatttagcgtcgatctctagggggtaggggatggccgacccgtgaccattacccagggcccggaaagcccggggactgaggccggacctagttactgtcaggtgttcgggatacgtgatacggaccagttgggtgttcgggcggaggggacccaaggtgaccgtccctaggtcagcccaaggctcgccccctcggtcacgtctcgttcccgccctcctctctctcgactcctgagcggctggaccaaggcgcatagnnnnnnnnnnnnnnnnnnnnnnnnnnnnnnnnnnnnnnnnnnnnnnnnnnnnn

SEQ ID NO: 88044 - DNA, 255 bp, Homo sapiens
  misc_feature: GYAE6OF01CIKOE.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcggctggcaaggcgcatagnnn

SEQ ID NO: 88045 - DNA, 257 bp, Homo sapiens
  misc_feature: GYAE6OF01CWI2R.49.10.A10.1.454.CMB.1.raw
  modified_base (255)..(257): a, c, t, g, unknown or other
  misc_feature (255)..(257): n is a, c, g, or t
tcagagtcgagagacacgaccggtgctcgatttagcgtcgatctcaggggggatggccaccctgaacattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnn

SEQ ID NO: 88046 - DNA, 298 bp, Homo sapiens
  misc_feature: GYAE6OF01E4UPV.49.10.A10.1.454.CMB.1.raw
  modified_base (258)..(298): a, c, t, g, unknown or other
  misc_feature (258)..(298): n is a, c, g, or t
tcagagtcgagagacacgaccggtgctcgattttagcgtcgatctcaggggggatggccgaccctgaccattaccagggccgaagccgggggatgaggccgactattactgtcaggtgtgggatagtgatacggaccattgggtgttcggcggagggaccaaggtgaccgtcctaggtcagcccaaggctgccccctcggtcactctgttcccgcctctctctctcgctctgaggcgggcgtggcgaggcgcactagnnnnnnnnnnnnnnnnnnnnnnnnnnnnnnnnnnnnnnnnn

SEQ ID NO: 88047 - DNA, 315 bp, Homo sapiens
  misc_feature: GYAE6OF01AP8HD.49.10.A10.1.454.CMB.1.raw
  modified_base (255)..(262): a, c, t, g, unknown or other
  misc_feature (255)..(262): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (270)..(315): a, c, t, g, unknown or other
  misc_feature (270)..(315): n is a, c, g, or t
tcagagtcgagagacacgaccggtgctcgatttagcgtcgatctcagggggggatggccaccctgaccattaccagggccgaagccggggatgaggccgactattactgtcaggtgtgggatagtgatacgggaccattggggtgttcggcggagggaccaagggtgaccgtcctaggtcagcccaaggctgccccctggtcactccgttccacctctctctctcgactctgagcgggctggcaaggcgcatagnnnnnnnnctncgnannnnnnnnnnnnnnnnnnnnnnnnnnnnnnnnnnnnnnnnnnnnnn

SEQ ID NO: 88048 - DNA, 254 bp, Homo sapiens
  misc_feature: GYAE6OF01A9JHH.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnn

SEQ ID NO: 88049 - DNA, 254 bp, Homo sapiens; identical to SEQ ID NO: 87999
  misc_feature: GYAE6OF01BTC12.49.10.A10.1.454.CMB.1.raw
  modified_base (254)..(254): a, c, t, g, unknown or other
  misc_feature (254)..(254): n is a, c, g, or t

SEQ ID NO: 88050 - DNA, 288 bp, Homo sapiens
  misc_feature: GYAE6OF01AGEDN.49.10.A10.1.454.CMB.1.raw
  modified_base (109)..(109): a, c, t, g, unknown or other
  misc_feature (109)..(109): n is a, c, g, or t
  modified_base (250)..(250): a, c, t, g, unknown or other
  misc_feature (250)..(250): n is a, c, g, or t
  modified_base (256)..(288): a, c, t, g, unknown or other
  misc_feature (256)..(288): n is a, c, g, or t
tcagagtcgagagacacgaccggtgctcgatttagcgtcgatctcgaggggagatggccaccctgaccattaccgagggccgaagccggggatgaggccgactattacngtcaggtgtgggatagtgatacggaccattgggtgttcggcggagggaccaaggtgaccgtcctaggtcagcccaaggctgccccctcggtcactctgttcccgccctccgtctctctcgactctgagcggctggcaggcncatagnnnnnnnnnnnnnnnnnnnnnnnnnnnnnnnnn

SEQ ID NO: 88051 - DNA, 278 bp, Homo sapiens
  misc_feature: GYAE6OF01D349S.49.10.A10.1.454.CMB.1.raw
  modified_base (256)..(278): a, c, t, g, unknown or other
  misc_feature (256)..(278): n is a, c, g, or t
tcagagtcgagagacacgaccggtgctcgatttagcgtcgatctcgagggggggagtggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgcatagnnnnnnnnnnnnnnnnnnnnnnn

SEQ ID NO: 88052 - DNA, 267 bp, Homo sapiens
  misc_feature: GYAE6OF01CWA9C.49.10.A10.1.454.CMB.1.raw
  modified_base (257)..(267): a, c, t, g, unknown or other
  misc_feature (257)..(267): n is a, c, g, or t
tcagagtcgagagacacgaccggtgctcgatttagcgtcgatctcaggggaggatcggccaccctgaccattaccagggccgaagccggggatgaggccgactattactgtcaggtgtgggatagtgatacggaccattgggtgttcggcggagggaccaaggtgaccgtctaggtcagcccaaggctgcccctggtcactctcgttcccacccgtcctctctctcgactcgtgagcgggctggcaaggcgcatagnnnnnnnnnnn

SEQ ID NO: 88053 - DNA, 254 bp, Homo sapiens
  misc_feature: GYAE6OF01A92RV.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnn

SEQ ID NO: 88054 - DNA, 253 bp, Homo sapiens
  misc_feature: GYAE6OF01CMWO9.49.10.A10.1.454.CMB.1.raw
  modified_base (251)..(253): a, c, t, g, unknown or other
  misc_feature (251)..(253): n is a, c, g, or t
tcagagtcgagagacacgaccggtgctcgatttagcgtcgatctcagggagatggccaccctgaccattaccagggccgaagccgggatgaggccgactattactgtcaggtgtggatagtgatacggaccattgggtgttcggcggagggaccaaggtgaccgtcctaggtcagcccaaggctgccccctggtcactctgttcccaccctcctctctctcgactctgagcgggctggcaaggcgcatagnnn

SEQ ID NO: 88055 - DNA, 257 bp, Homo sapiens; identical to SEQ ID NO: 88008
  misc_feature: GYAE6OF01CA0UH.49.10.A10.1.454.CMB.1.raw
  modified_base (255)..(257): a, c, t, g, unknown or other
  misc_feature (255)..(257): n is a, c, g, or t

SEQ ID NO: 88056 - DNA, 259 bp, Homo sapiens
  misc_feature: GYAE6OF01C2E5N.49.10.A10.1.454.CMB.1.raw
  modified_base (254)..(259): a, c, t, g, unknown or other
  misc_feature (254)..(259): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnnnnn

SEQ ID NO: 88057 - DNA, 260 bp, Homo sapiens
  misc_feature: GYAE6OF01ARFI0.49.10.A10.1.454.CMB.1.raw
  modified_base (255)..(260): a, c, t, g, unknown or other
  misc_feature (255)..(260): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnnn

SEQ ID NO: 88058 - DNA, 262 bp, Homo sapiens
  misc_feature: GYAE6OF01ENK9W.49.10.A10.1.454.CMB.1.raw
  modified_base (255)..(262): a, c, t, g, unknown or other
  misc_feature (255)..(262): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggacaaggcgcatagnnnnnnnn

SEQ ID NO: 88059 - DNA, 255 bp, Homo sapiens
  misc_feature: GYAE6OF01CN425.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggaggaccaaggtgaccgtcctaggtcagcccaaggctgccccctggtcactctgttcccgccctcctctctctcgactctgagcgggctggcaaggcgcatagnnn

SEQ ID NO: 88060 - DNA, 256 bp, Homo sapiens
  misc_feature: GYAE6OF01A0VMS.49.10.A10.1.454.CMB.1.raw
  modified_base (254)..(256): a, c, t, g, unknown or other
  misc_feature (254)..(256): n is a, c, g, or t
tcagagtcgagagacacgaccggtgctcgatttagcgtcgatctcaggggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnn

SEQ ID NO: 88061 - DNA, 261 bp, Homo sapiens
  misc_feature: GYAE6OF01BRTSA.49.10.A10.1.454.CMB.1.raw
  modified_base (236)..(236): a, c, t, g, unknown or other
  misc_feature (236)..(236): n is a, c, g, or t
  modified_base (252)..(261): a, c, t, g, unknown or other
  misc_feature (252)..(261): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctctctctctcgactctgagcgggntggcaaggcgcatagnnnnnnnnnn

SEQ ID NO: 88062 - DNA, 256 bp, Homo sapiens
  misc_feature: GYAE6OF01AVZM0.49.10.A10.1.454.CMB.1.raw
  modified_base (248)..(248): a, c, t, g, unknown or other
  misc_feature (248)..(248): n is a, c, g, or t
  modified_base (254)..(256): a, c, t, g, unknown or other
  misc_feature (254)..(256): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctcgttcccacctcctctctctcgactctgagcgggctggcaaggcncatagnnn

SEQ ID NO: 88063 - DNA, 281 bp, Homo sapiens
  misc_feature: GYAE6OF01A7ONP.49.10.A10.1.454.CMB.1.raw
  modified_base (261)..(281): a, c, t, g, unknown or other
  misc_feature (261)..(281): n is a, c, g, or t
tcagagtcgagagacacgaccggtgctcgatttagcgtcgatctcagggggggatggccaccctgaccattaccagggccgaagccggggatgaggccgactattactgtcaggtgtgggatagtgatacggaccattgggtgttcggcggagggaccaaggtgaccgtcctaggtcagcccaaggctcgccccctggtcactctactctgttcccaccctcctctctctcgactctgagcgggctggcaaggcgcatagnnnnnnnnnnnnnnnnnnnnn

SEQ ID NO: 88064 - DNA, 255 bp, Homo sapiens
  misc_feature: GYAE6OF01AWT93.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnn

SEQ ID NO: 88065 - DNA, 265 bp, Homo sapiens
  misc_feature: GYAE6OF01CDGP2.49.10.A10.1.454.CMB.1.raw
  modified_base (256)..(265): a, c, t, g, unknown or other
  misc_feature (256)..(265): n is a, c, g, or t
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctcgcccctggtcactctcgttcccaccctcctctctctcgactctgagcggctggacctaagcgcagtagnnnnnnnnnn

SEQ ID NO: 88066 - DNA, 263 bp, Homo sapiens
  misc_feature: GYAE6OF01C3149.49.10.A10.1.454.CMB.1.raw
  modified_base (251)..(263): a, c, t, g, unknown or other
  misc_feature (251)..(263): n is a, c, g, or t
tcagagtcgagagacacgaccggtgctcgatttagcgtcgatctcaggggagatggccaccctgaccattaccaggccgaagccggggatgaggccgactattactgtcaggtgtgggatagtgatacggaccattgggtgttcggcggaggaccaaggtgaccgtcctaggtcagcccaaggctcgccccctggtcactctgttcccaccctctctctctcgactctgagcggctggcaaggcgcatagnnnnnnnnnnnnn

SEQ ID NO: 88067 - DNA, 261 bp, Homo sapiens
  misc_feature: GYAE6OF01B27MM.49.10.A10.1.454.CMB.1.raw
  modified_base (256)..(261): a, c, t, g, unknown or other
  misc_feature (256)..(261): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcagcccaaggctcgccccctcggtcactctgttcccaccctcctctctctcgactctgagcgggctggcaaggcgcatagnnnnnn

SEQ ID NO: 88068 - DNA, 263 bp, Homo sapiens
  misc_feature: GYAE6OF01ES6KO.49.10.A10.1.454.CMB.1.raw
  modified_base (256)..(263): a, c, t, g, unknown or other
  misc_feature (256)..(263): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctcgccccctcggtcactctgttcccgccctcctctctctcgactctgagcgggctggcaaggcgcatagnnnnnnnn

SEQ ID NO: 88069 - DNA, 265 bp, Homo sapiens
  misc_feature: GYAE6OF01EW4IN.49.10.A10.1.454.CMB.1.raw
  modified_base (241)..(241): a, c, t, g, unknown or other
  misc_feature (241)..(241): n is a, c, g, or t
  modified_base (257)..(265): a, c, t, g, unknown or other
  misc_feature (257)..(265): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcacgcccaaggctcgccccctcggtcactctcgttcccgccctcctctctctcgactctgagcggntggcaaggcgcatagnnnnnnnnn

SEQ ID NO: 88070 - DNA, 281 bp, Homo sapiens
  misc_feature: GYAE6OF01DMT53.49.10.A10.1.454.CMB.1.raw
  modified_base (261)..(281): a, c, t, g, unknown or other
  misc_feature (261)..(281): n is a, c, g, or t
tcagagtcgagagacacgaccggtgctcgatttagcgtcgatctcgaggggggatgggccaccctgaccattaccagggccgaagccggggatgaggccgactattactgtcaggtgtgggatagtgatacggaccattgggtgttcggcggagggaccaaggtgaccgtcctaggtcagcccaaggctcgccccctggtcactctcgttcccgccctcctcctctctcgactctgagcgggctggacaaggcgacatagnnnnnnnnnnnnnnnnnnnnn

SEQ ID NO: 88071 - DNA, 285 bp, Homo sapiens
  misc_feature: GYAE6OF01AST36.49.10.A10.1.454.CMB.1.raw
  modified_base (215)..(215): a, c, t, g, unknown or other
  misc_feature (215)..(215): n is a, c, g, or t
  modified_base (259)..(285): a, c, t, g, unknown or other
  misc_feature (259)..(285): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggacagttgggtgttcggcggagggaccaaggtcgaccgtcctaggtcagcccaaggtcctcgccccctggtcactctcgttcccncctctctctctcgactctgagcgggtctggaccaggcacatagnnnnnnnnnnnnnnnnnnnnnnnnnnn

SEQ ID NO: 88072 - DNA, 261 bp, Homo sapiens
  misc_feature: GYAE6OF01BXWRY.49.10.A10.1.454.CMB.1.raw
  modified_base (252)..(261): a, c, t, g, unknown or other
  misc_feature (252)..(261): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggaggaccaaggtgaccgtcctaggtcagcccaaggctgccccctggtcactctcgttcccacctccctctctcgactctgagcgggctggcaaggcgcatagnnnnnnnnnn

SEQ ID NO: 88073 - DNA, 277 bp, Homo sapiens
  misc_feature: GYAE6OF01B6TKB.49.10.A10.1.454.CMB.1.raw
  modified_base (249)..(249): a, c, t, g, unknown or other
  misc_feature (249)..(249): n is a, c, g, or t
  modified_base (254)..(277): a, c, t, g, unknown or other
  misc_feature (254)..(277): n is a, c, g, or t
tcagagtcgagagacacgaccggtgctcgatttagcgtcgatctcaggggggatggccaccctgaccattaccagggccgaagccggggatgaggccgactatactgtcaggtgtgggatagtgatacggaccattgggtgttcggcggagggaccaaggtgaccgtcctaggtcagcccaaggctcgccccctggtccactctcgttcccacctcctctcttcgactcgtgagcggctggcaaggcgnatagnnnnnnnnnnnnnnnnnnnnnnnn

SEQ ID NO: 88074 - DNA, 281 bp, Homo sapiens
  misc_feature: GYAE6OF01DXG4M.49.10.A10.1.454.CMB.1.raw
  modified_base (264)..(281): a, c, t, g, unknown or other
  misc_feature (264)..(281): n is a, c, g, or t
tcagagtcgagagacacgaccggtgctcgatttagcgtcgatctcagggggggatggccaccctgaccattaccagggccgaagccggggatgaggccgactattactgtcaggtgtgggatagtgatacggaccattggggtgttcggcggagggaccaaggtgaccgtcctaggtcagcccaaggctcgccccctcgcactctcgttcccgccctcctctctctcgctctgagcgggtcgtcggacgaaggtcgacagtagnnnnnnnnnnnnnnnnnn

SEQ ID NO: 88075 - DNA, 253 bp, Homo sapiens
  misc_feature: GYAE6OF01EU454.49.10.A10.1.454.CMB.1.raw
  modified_base (252)..(253): a, c, t, g, unknown or other
  misc_feature (252)..(253): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgcatgnn

SEQ ID NO: 88076 - DNA, 264 bp, Homo sapiens
  misc_feature: GYAE6OF01B0FYH.49.10.A10.1.454.CMB.1.raw
  modified_base (233)..(233): a, c, t, g, unknown or other
  misc_feature (233)..(233): n is a, c, g, or t
  modified_base (257)..(264): a, c, t, g, unknown or other
  misc_feature (257)..(264): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccagttgggtgttcggcggagggaccaaggtgaccgtcctaggtcagcccaaggctcgccccctcggtcactctcgttcccgccctctctctctcgactcngacgcggctggacaggcgtcatgnnnnnnnn

SEQ ID NO: 88077 - DNA, 275 bp, Homo sapiens
  misc_feature: GYAE6OF01EY3C5.49.10.A10.1.454.CMB.1.raw
  modified_base (249)..(249): a, c, t, g, unknown or other
  misc_feature (249)..(249): n is a, c, g, or t
  modified_base (256)..(275): a, c, t, g, unknown or other
  misc_feature (256)..(275): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctcgttcccaccctcctctctctcgactctgagcggctggcaaggcncaatagnnnnnnnnnnnnnnnnnnnn

SEQ ID NO: 88078 - DNA, 299 bp, Homo sapiens
  misc_feature: GYAE6OF01D1CNE.49.10.A10.1.454.CMB.1.raw
  modified_base (144)..(144): a, c, t, g, unknown or other
  misc_feature (144)..(144): n is a, c, g, or t
  modified_base (229)..(229): a, c, t, g, unknown or other
  misc_feature (229)..(229): n is a, c, g, or t
  modified_base (280)..(299): a, c, t, g, unknown or other
  misc_feature (280)..(299): n is a, c, g, or t
tcagagtcgagagacacgaccggtgctcgatttagcgtcgatctcgagggggggatggccaccctgaccattaccagggccgaagccggggatggaggccgatattactgtcaggtgtgggatagtgatacggacattggggtnttcgggcgggaggaccaaggtcgaccgtacgtaggtacacggcccaaggccttccgcccccgttggtacacgttctccggtcccnccctcctctctctcgactcgtggacggcgggctaggacaagcgacaagtgnnnnnnnnnnnnnnnnnnnn

SEQ ID NO: 88079 - DNA, 268 bp, Homo sapiens
  misc_feature: GYAE6OF01AS1N0.49.10.A10.1.454.CMB.1.raw
  modified_base (248)..(248): a, c, t, g, unknown or other
  misc_feature (248)..(248): n is a, c, g, or t
  modified_base (254)..(268): a, c, t, g, unknown or other
  misc_feature (254)..(268): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcncatagnnnnnnnnnnnnnnn

SEQ ID NO: 88080 - DNA, 263 bp, Homo sapiens
  misc_feature: GYAE6OF01BW3Z9.49.10.A10.1.454.CMB.1.raw
  modified_base (259)..(263): a, c, t, g, unknown or other
  misc_feature (259)..(263): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccagttgggtgttcggcggagggaccaaggtgaccgtcctaggtcagcccaaggctcgccccctcggtcactctcgttcccgccctcctctctctcgactctgagcgggctggcaaggcgctatagnnnnn

SEQ ID NO: 88081 - DNA, 254 bp, Homo sapiens
  misc_feature: GYAE6OF01BWTO1.49.10.A10.1.454.CMB.1.raw
  modified_base (252)..(254): a, c, t, g, unknown or other
  misc_feature (252)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctcgccccctcggtcactctcgttcccaccctcctctctctcgactctgagcggctggcagcgcatgnnn

SEQ ID NO: 88082 - DNA, 262 bp, Homo sapiens
  misc_feature: GYAE6OF01APV3S.49.10.A10.1.454.CMB.1.raw
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (257)..(262): a, c, t, g, unknown or other
  misc_feature (257)..(262): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcacgcccaaggctcgccccctcggtcactctcgttcccaccctcctctctctcgactctgngcggctggcaaggcgcanagnnnnnn

SEQ ID NO: 88083 - DNA, 254 bp, Homo sapiens
  misc_feature: GYAE6OF02FLG3E.49.10.A10.1.454.CMB.1.raw
  modified_base (250)..(254): a, c, t, g, unknown or other
  misc_feature (250)..(254): n is a, c, g, or t
tcagagtcgagagacacgaccggtgctcgatttagcgtcgatctcaggggatggccaccctgaccattaccagggccgaagccgggatgaggccgactattactgtcaggtgtgggatagtgatacggaccattgggtgttcggcggagggaccaaggtgaccgtcctaggtcagcccaaggctgcccctcggtcactctgttcccacctcctctctctcgactctgagcgggctggcaaggcgcatagnnnnn

SEQ ID NO: 88084 - DNA, 252 bp, Homo sapiens
  misc_feature: GYAE6OF02GHUE0.49.10.A10.1.454.CMB.1.raw
  modified_base (252)..(252): a, c, t, g, unknown or other
  misc_feature (252)..(252): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgcccctcggtcactctgttcccaccctcctctctctcgactctgagcgggctggcaaggcgcatagn

SEQ ID NO: 88085 - DNA, 254 bp, Homo sapiens
  misc_feature: GYAE6OF02I34KU.49.10.A10.1.454.CMB.1.raw
  modified_base (254)..(254): a, c, t, g, unknown or other
  misc_feature (254)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagn

SEQ ID NO: 88086 - DNA, 263 bp, Homo sapiens
  misc_feature: GYAE6OF02GK6IO.49.10.A10.1.454.CMB.1.raw
  modified_base (253)..(263): a, c, t, g, unknown or other
  misc_feature (253)..(263): n is a, c, g, or t
tcagagtcgagagacacgaccggtgctcgatttagcgtcgatctcagggagatggccaccctgaccattaccagggccgaagccggggatgaggccgactattactgtcaggtgtgggattagtgatacggaccattgggtgttcggcggaggaccaaggtgaccgtcctaggtcagcccaaggctgccccctggtcactctgttcccaccctcctctctctcgactctgagcgggctggcaaggcgcatagnnnnnnnnnnn

SEQ ID NO: 88087 - DNA, 257 bp, Homo sapiens
  misc_feature: GYAE6OF02HD14Y.49.10.A10.1.454.CMB.1.raw
  modified_base (254)..(257): a, c, t, g, unknown or other
  misc_feature (254)..(257): n is a, c, g, or t
tcagagtcgagagacacgaccggtgctcgatttagcgtcgatctcaggggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnn

SEQ ID NO: 88088 - DNA, 254 bp, Homo sapiens; identical to SEQ ID NO: 87976
  misc_feature: GYAE6OF02F4QZG.49.10.A10.1.454.CMB.1.raw
  modified_base (253)..(254): a, c, t, g, unknown or other
  misc_feature (253)..(254): n is a, c, g, or t

SEQ ID NO: 88089 - DNA, 256 bp, Homo sapiens; identical to SEQ ID NO: 87977
  misc_feature: GYAE6OF02JYAON.49.10.A10.1.454.CMB.1.raw
  modified_base (253)..(256): a, c, t, g, unknown or other
  misc_feature (253)..(256): n is a, c, g, or t

SEQ ID NO: 88090 - DNA, 254 bp, Homo sapiens
  misc_feature: GYAE6OF02IQAMK.49.10.A10.1.454.CMB.1.raw
  modified_base (254)..(254): a, c, t, g, unknown or other
  misc_feature (254)..(254): n is a, c, g, or t
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagn

SEQ ID NO: 88091 - DNA, 252 bp, Homo sapiens
  misc_feature: GYAE6OF02FPH1Y.49.10.A10.1.454.CMB.1.raw
  modified_base (252)..(252): a, c, t, g, unknown or other
  misc_feature (252)..(252): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgcccctcggtcactctgttcccgccctcctctctctcgactctgagcgggctggcaaggcgcatagn

SEQ ID NO: 88092 - DNA, 253 bp, Homo sapiens
  misc_feature: GYAE6OF02HAQCG.49.10.A10.1.454.CMB.1.raw
  modified_base (253)..(253): a, c, t, g, unknown or other
  misc_feature (253)..(253): n is a, c, g, or t
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagn

SEQ ID NO: 88093 - DNA, 256 bp, Homo sapiens
  misc_feature: GYAE6OF02HO0VV.49.10.A10.1.454.CMB.1.raw
  modified_base (254)..(256): a, c, t, g, unknown or other
  misc_feature (254)..(256): n is a, c, g, or t
tcagagtcgagagacacgaccggtgctcgatttagcgtcgatctcaggggagatggtcaccctgaccattaccagggccgaagccggggatgaggccgactattactgtcaggtgtgggatagtgatacggaccattgggtgttcggctgagggaccaaggtgaccgtcctaggtcagcccaaggctgcccctcggtcactctgttcccaccctcctctctctcgactctgagcgggctggcaaggcgcatagnnn

SEQ ID NO: 88094 - DNA, 267 bp, Homo sapiens
  misc_feature: GYAE6OF02FHB3Q.49.10.A10.1.454.CMB.1.raw
  modified_base (255)..(267): a, c, t, g, unknown or other
  misc_feature (255)..(267): n is a, c, g, or t
tcagagtcgagagacacgaccggtgctcgatttagcgtcgatctcgagggggagtggccaccctgaccattaccacgggccgaagccgggatgaggccgactattactgtcaggtgtgggatagtgatacggaccattgggtgttcggcggagggaccaaggtgaccgtcctaggtcagcccaaggctgccccctggtcactctgttcccacctcctctctctcggactctgagcgggctgggcaaggcgcatgnnnnnnnnnnnnn

SEQ ID NO: 88095 - DNA, 254 bp, Homo sapiens
  misc_feature: GYAE6OF02G2CR5.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggtgatggccaccctgaccattaccagggccgaagccgggatgaggccgactattactgtcaggtgtgggatagtgatactgaccattggctgttcggcggagggaccaaggtgaccgtcctaggtcagcccaaggctgccccctcggtcactctgttcccgccctcctctctctcgactctgagcgggctggcaaggcgcatagnn

SEQ ID NO: 88096 - DNA, 255 bp, Homo sapiens
  misc_feature: GYAE6OF02GSLYT.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnn

SEQ ID NO: 88097 - DNA, 259 bp, Homo sapiens
  misc_feature: GYAE6OF02IPSGN.49.10.A10.1.454.CMB.1.raw
  modified_base (246)..(250): a, c, t, g, unknown or other
  misc_feature (246)..(250): n is a, c, g, or t
  modified_base (252)..(259): a, c, t, g, unknown or other
  misc_feature (252)..(259): n is a, c, g, or t
tcagagtcgagagacacgaccggtgctcgatttagcgtcgatctcagggagatggccaccctgaccattaccaggccgaagccgggatgaggccgactagttactgtcaggtgtgggatagtgatacggaccattggtgttcggcgagggaccaaggtgaccgtctaggtcagccaaggctgcccctggtcactctgttccacctcctctctctcgctctgacgcggctcgacaacggcgcatagnnnnntnnnnnnnn

SEQ ID NO: 88098 - DNA, 256 bp, Homo sapiens; identical to SEQ ID NO: 87973
  misc_feature: GYAE6OF02HLI7X.49.10.A10.1.454.CMB.1.raw
  modified_base (255)..(256): a, c, t, g, unknown or other
  misc_feature (255)..(256): n is a, c, g, or t

SEQ ID NO: 88099 - DNA, 254 bp, Homo sapiens
  misc_feature: GYAE6OF02H5FDY.49.10.A10.1.454.CMB.1.raw
  modified_base (252)..(254): a, c, t, g, unknown or other
  misc_feature (252)..(254): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagnnn

SEQ ID NO: 88100 - DNA, 253 bp, Homo sapiens
  misc_feature: GYAE6OF02GHYJK.49.10.A10.1.454.CMB.1.raw
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatag

SEQ ID NO: 88101 - DNA, 253 bp, Homo sapiens; identical to SEQ ID NO: 88100
  misc_feature: GYAE6OF02GSLBO.49.10.A10.1.454.CMB.1.raw

SEQ ID NO: 88102 - DNA, 253 bp, Homo sapiens
  misc_feature: GYAE6OF02IIP9B.49.10.A10.1.454.CMB.1.raw
  modified_base (253)..(253): a, c, t, g, unknown or other
  misc_feature (253)..(253): n is a, c, g, or t
tcagagtcgagagacacgaccggtgctcgatttagcgtcgatctcagggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagn

SEQ ID NO: 88103 - DNA, 254 bp, Homo sapiens; identical to SEQ ID NO: 88085
  misc_feature: GYAE6OF02GIAOU.49.10.A10.1.454.CMB.1.raw
  modified_base (254)..(254): a, c, t, g, unknown or other
  misc_feature (254)..(254): n is a, c, g, or t

SEQ ID NO: 88104 - DNA, 256 bp, Homo sapiens; identical to SEQ ID NO: 87989
  misc_feature: GYAE6OF02I7XVG.49.10.A10.1.454.CMB.1.raw
  modified_base (254)..(256): a, c, t, g, unknown or other
  misc_feature (254)..(256): n is a, c, g, or t

SEQ ID NO: 88105 - DNA, 256 bp, Homo sapiens
  misc_feature: GYAE6OF02HEXZW.49.10.A10.1.454.CMB.1.raw
  modified_base (254)..(256): a, c, t, g, unknown or other
  misc_feature (254)..(256): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagnnn

SEQ ID NO: 88106 - DNA, 258 bp, Homo sapiens
  misc_feature: GYAE6OF02FQGTY.49.10.A10.1.454.CMB.1.raw
  modified_base (253)..(258): a, c, t, g, unknown or other
  misc_feature (253)..(258): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnnnn

SEQ ID NO: 88107 - DNA, 258 bp, Homo sapiens
  misc_feature: GYAE6OF02FGX02.49.10.A10.1.454.CMB.1.raw
  modified_base (255)..(258): a, c, t, g, unknown or other
  misc_feature (255)..(258): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnnn

SEQ ID NO: 88108 - DNA, 258 bp, Homo sapiens
  misc_feature: GYAE6OF02HFI4M.49.10.A10.1.454.CMB.1.raw
  modified_base (254)..(258): a, c, t, g, unknown or other
  misc_feature (254)..(258): n is a, c, g, or t
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnnnn

SEQ ID NO: 88109 - DNA, 252 bp, Homo sapiens
  misc_feature: GYAE6OF02HFLKV.49.10.A10.1.454.CMB.1.raw
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctgcccctcggtcactctgttcccgccctcctctctctcgactctgagcgggctggcaaggcgcatag

SEQ ID NO: 88110 - DNA, 258 bp, Homo sapiens
  misc_feature: GYAE6OF02I653N.49.10.A10.1.454.CMB.1.raw
  modified_base (253)..(258): a, c, t, g, unknown or other
  misc_feature (253)..(258): n is a, c, g, or t
tcagagtcgagagacacgaccggtgctcgatttagcgtcgatctcagggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnnn

SEQ ID NO: 88111 - DNA, 254 bp, Homo sapiens; identical to SEQ ID NO: 87999
  misc_feature: GYAE6OF02GAY7D.49.10.A10.1.454.CMB.1.raw
  modified_base (254)..(254): a, c, t, g, unknown or other
  misc_feature (254)..(254): n is a, c, g, or t

SEQ ID NO: 88112 - DNA, 255 bp, Homo sapiens
  misc_feature: GYAE6OF02FJYIV.49.10.A10.1.454.CMB.1.raw
  modified_base (254)..(255): a, c, t, g, unknown or other
  misc_feature (254)..(255): n is a, c, g, or t
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnn

SEQ ID NO: 88113 - DNA, 254 bp, Homo sapiens
  misc_feature: GYAE6OF02F2KA2.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcaggggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagnn

SEQ ID NO: 88114 - DNA, 254 bp, Homo sapiens
  misc_feature: GYAE6OF02HHTD4.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagnn

SEQ ID NO: 88115 - DNA, 253 bp, Homo sapiens
  misc_feature: GYAE6OF02G6VX0.49.10.A10.1.454.CMB.1.raw
  modified_base (252)..(253): a, c, t, g, unknown or other
  misc_feature (252)..(253): n is a, c, g, or t
tcagagtcgagagacacgaccggtgctcgatttagcgtcgatctcagggggatggccaccctgaccattaccagggccgaggccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgctctgagcgggctggcaaggcgcatagnn

SEQ ID NO: 88116 - DNA, 257 bp, Homo sapiens; identical to SEQ ID NO: 88008
  misc_feature: GYAE6OF02HKXM8.49.10.A10.1.454.CMB.1.raw
  modified_base (255)..(257): a, c, t, g, unknown or other
  misc_feature (255)..(257): n is a, c, g, or t

SEQ ID NO: 88117 - DNA, 251 bp, Homo sapiens
  misc_feature: GYAE6OF02HGW0W.49.10.A10.1.454.CMB.1.raw
  modified_base (251)..(251): a, c, t, g, unknown or other
  misc_feature (251)..(251): n is a, c, g, or t
tcagagtcgagagacacgaccggtgctcgatttagcgtcgatctcaggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagn

SEQ ID NO: 88118 - DNA, 254 bp, Homo sapiens
  misc_feature: GYAE6OF02FIASV.49.10.A10.1.454.CMB.1.raw
  modified_base (254)..(254): a, c, t, g, unknown or other
  misc_feature (254)..(254): n is a, c, g, or t
tcagagtcgagagacacgaccggtgctcgatttagcgtcgatctcaggggagatggccaccctgaccattaccagggccgaagccgggatgaggccgactattactgtcaggtgtgggatagtgatacggaccattgggtgttcggcggagggaccaaggtgaccgtcctaggtcagcccaaggctgcaccctcggtcactctgttcccgccctcctctctctcgactctgagcgggctggcaaggcgcatagn

SEQ ID NO: 88119 - DNA, 308 bp, Homo sapiens
  misc_feature: GYAE6OF02JB8PK.49.10.A10.1.454.CMB.1.raw
  modified_base (261)..(308): a, c, t, g, unknown or other
  misc_feature (261)..(308): n is a, c, g, or t
tcagagtcgagagacacgaccggtgctcgatttagcgtcgatctcgaggggaggatggccaccctgaccattacccagggccggaagccggggatgacggccgactattactgtcaggtgtgggatagtgatacgggaccattgggtgttcggcggagggacctaaggtgaccgtcctaggtcagcccaaggctgccccctggtcactctggttcccacctcctctctctcgactctgagcgggctggcaaggcgcatagnnnnnnnnnnnnnnnnnnnnnnnnnnnnnnnnnnnnnnnnnnnnnnnn

SEQ ID NO: 88120 - DNA, 252 bp, Homo sapiens
  misc_feature: GYAE6OF02IL1HB.49.10.A10.1.454.CMB.1.raw
  modified_base (252)..(252): a, c, t, g, unknown or other
  misc_feature (252)..(252): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctctctgagcgggctggcaaggcgcatagn

SEQ ID NO: 88121 - DNA, 256 bp, Homo sapiens; identical to SEQ ID NO: 87990
  misc_feature: GYAE6OF02INJ7J.49.10.A10.1.454.CMB.1.raw
  modified_base (255)..(256): a, c, t, g, unknown or other
  misc_feature (255)..(256): n is a, c, g, or t

SEQ ID NO: 88122 - DNA, 254 bp, Homo sapiens
  misc_feature: GYAE6OF02GRXL7.49.10.A10.1.454.CMB.1.raw
  modified_base (254)..(254): a, c, t, g, unknown or other
  misc_feature (254)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctccgactctgagcgggctggcaaggcgcatagn

SEQ ID NO: 88123 - DNA, 255 bp, Homo sapiens
  misc_feature: GYAE6OF02IFROX.49.10.A10.1.454.CMB.1.raw
  modified_base (252)..(255): a, c, t, g, unknown or other
  misc_feature (252)..(255): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgcccctcggtcactctgttcccacctcctctctctcgactctgagcgggctggcaaggcgcatagnnnn

SEQ ID NO: 88124 - DNA, 254 bp, Homo sapiens
  misc_feature: GYAE6OF02ILR3M.49.10.A10.1.454.CMB.1.raw
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatag

SEQ ID NO: 88125 - DNA, 256 bp, Homo sapiens; identical to SEQ ID NO: 87973
  misc_feature: GYAE6OF02I9NTP.49.10.A10.1.454.CMB.1.raw
  modified_base (255)..(256): a, c, t, g, unknown or other
  misc_feature (255)..(256): n is a, c, g, or t

SEQ ID NO: 88126 - DNA, 269 bp, Homo sapiens
  misc_feature: GYAE6OF02GZVCR.49.10.A10.1.454.CMB.1.raw
  modified_base (255)..(269): a, c, t, g, unknown or other
  misc_feature (255)..(269): n is a, c, g, or t
tcagagtcgagagacacgaccggtgctcgatttagcgtcgatctcagggggagtggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctcgtcgactctgagcgggctggcaaggcgcatagnnnnnnnnnnnnnnn

SEQ ID NO: 88127 - DNA, 255 bp, Homo sapiens; identical to SEQ ID NO: 88006
  misc_feature: GYAE6OF02IVB7P.49.10.A10.1.454.CMB.1.raw
  modified_base (254)..(255): a, c, t, g, unknown or other
  misc_feature (254)..(255): n is a, c, g, or t

SEQ ID NO: 88128 - DNA, 258 bp, Homo sapiens; identical to SEQ ID NO: 88107
  misc_feature: GYAE6OF02IUML6.49.10.A10.1.454.CMB.1.raw
  modified_base (255)..(258): a, c, t, g, unknown or other
  misc_feature (255)..(258): n is a, c, g, or t

SEQ ID NO: 88129 - DNA, 255 bp, Homo sapiens; identical to SEQ ID NO: 87998
  misc_feature: GYAE6OF02HMILX.49.10.A10.1.454.CMB.1.raw
  modified_base (254)..(255): a, c, t, g, unknown or other
  misc_feature (254)..(255): n is a, c, g, or t

SEQ ID NO: 88130 - DNA, 268 bp, Homo sapiens
  misc_feature: GYAE6OF02IZ8F5.49.10.A10.1.454.CMB.1.raw
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (248)..(249): a, c, t, g, unknown or other
  misc_feature (248)..(249): n is a, c, g, or t
  modified_base (251)..(252): a, c, t, g, unknown or other
  misc_feature (251)..(252): n is a, c, g, or t
  modified_base (254)..(268): a, c, t, g, unknown or other
  misc_feature (254)..(268): n is a, c, g, or t
tcagagtcgagagacacgaccggtgctcgatttagcgtcgatctcaggggagatggccaccctgaccacttaccagggccgaagccggggatcgaggccgactattactgtcaggtgtgggatagtgatacggaccatggtgtcggnggaggaccaaggtgacgtcctaggtcagccaaggctgcccctggtcactcnggtccacctctctctctcggactctgancgggctggcaaggcgcattagnntnnannnnnnnnnnnnnnn

SEQ ID NO: 88131 - DNA, 255 bp, Homo sapiens
  misc_feature: GYAE6OF02GUFUB.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcaggggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnn

SEQ ID NO: 88132 - DNA, 253 bp, Homo sapiens
  misc_feature: GYAE6OF02F324U.49.10.A10.1.454.CMB.1.raw
  modified_base (253)..(253): a, c, t, g, unknown or other
  misc_feature (253)..(253): n is a, c, g, or t
tcagagtcgagagacacgaccggtgctcgatttagcgtcgatctcagggggatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagn

SEQ ID NO: 88133 - DNA, 255 bp, Homo sapiens; identical to SEQ ID NO: 87998
  misc_feature: GYAE6OF02GDF43.49.10.A10.1.454.CMB.1.raw
  modified_base (254)..(255): a, c, t, g, unknown or other
  misc_feature (254)..(255): n is a, c, g, or t

SEQ ID NO: 88134 - DNA, 254 bp, Homo sapiens
  misc_feature: GYAE6OF02GJRVQ.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnn

SEQ ID NO: 88135 - DNA, 255 bp, Homo sapiens; identical to SEQ ID NO: 87998
  misc_feature: GYAE6OF02IB1XE.49.10.A10.1.454.CMB.1.raw
  modified_base (254)..(255): a, c, t, g, unknown or other
  misc_feature (254)..(255): n is a, c, g, or t

SEQ ID NO: 88136 - DNA, 255 bp, Homo sapiens
  misc_feature: GYAE6OF02I0MJV.49.10.A10.1.454.CMB.1.raw
  modified_base (254)..(255): a, c, t, g, unknown or other
  misc_feature (254)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtattcggcggagggaccaaggtgaccgtcctaggtcagcccaaggctgccccctcggtcactctgttcccgcctcctctctctcgactctgagcgggctggcaaggcgcatagnn

SEQ ID NO: 88137 - DNA, 256 bp, Homo sapiens; identical to SEQ ID NO: 87989
  misc_feature: GYAE6OF02FN3QZ.49.10.A10.1.454.CMB.1.raw
  modified_base (254)..(256): a, c, t, g, unknown or other
  misc_feature (254)..(256): n is a, c, g, or t

SEQ ID NO: 88138 - DNA, 255 bp, Homo sapiens
  misc_feature: GYAE6OF02I1OBR.49.10.A10.1.454.CMB.1.raw
  modified_base (254)..(255): a, c, t, g, unknown or other
  misc_feature (254)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnn

SEQ ID NO: 88139 - DNA, 254 bp, Homo sapiens
  misc_feature: GYAE6OF02H5JOY.49.10.A10.1.454.CMB.1.raw
  modified_base (252)..(254): a, c, t, g, unknown or other
  misc_feature (252)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcggctggcaaggcgcatagnnn

SEQ ID NO: 88140 - DNA, 257 bp, Homo sapiens
  misc_feature: GYAE6OF02HMLCY.49.10.A10.1.454.CMB.1.raw
  modified_base (254)..(257): a, c, t, g, unknown or other
  misc_feature (254)..(257): n is a, c, g, or t
tcagagtcgagagacacgaccggtgctcgatttagcgtcgatctcgagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnnn

SEQ ID NO: 88141 - DNA, 307 bp, Homo sapiens
  misc_feature: GYAE6OF02FQBWJ.49.10.A10.1.454.CMB.1.raw
  modified_base (263)..(265): a, c, t, g, unknown or other
  misc_feature (263)..(265): n is a, c, g, or t
  modified_base (267)..(307): a, c, t, g, unknown or other
  misc_feature (267)..(307): n is a, c, g, or t
tcagagtcgagagacacgaccggtgctcgatttagcgtcgatctcaggggagaggtggccaccctgaccattaccagggccgaagccgggggatgaggccgactattactgtcaggtgtgggattagtgataccggaccattgggtgttcgggcggagggaccaaggtgaccggtcctaggtcagcccaaggctgccccctggtccactctgttccccaccctcctctctctcgactctgagcgggctggcaaggcgcatagnnntnnnnnnnnnnnnnnnnnnnnnnnnnnnnnnnnnnnnnnnnn

SEQ ID NO: 88142 - DNA, 256 bp, Homo sapiens
  misc_feature: GYAE6OF02G9DLE.49.10.A10.1.454.CMB.1.raw
  modified_base (253)..(256): a, c, t, g, unknown or other
  misc_feature (253)..(256): n is a, c, g, or t
tcagagtcgagagacacgaccggtgctcgatttagcgtcgatctcagggagatggccaccctgaccattaccagggccgaagccgggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnn

SEQ ID NO: 88143 - DNA, 256 bp, Homo sapiens; identical to SEQ ID NO: 87973
  misc_feature: GYAE6OF02F1DDF.49.10.A10.1.454.CMB.1.raw
  modified_base (255)..(256): a, c, t, g, unknown or other
  misc_feature (255)..(256): n is a, c, g, or t

SEQ ID NO: 88144 - DNA, 258 bp, Homo sapiens; identical to SEQ ID NO: 88107
  misc_feature: GYAE6OF02GAMP8.49.10.A10.1.454.CMB.1.raw
  modified_base (255)..(258): a, c, t, g, unknown or other
  misc_feature (255)..(258): n is a, c, g, or t

SEQ ID NO: 88145 - DNA, 255 bp, Homo sapiens; identical to SEQ ID NO: 88096
  misc_feature: GYAE6OF02I41OQ.49.10.A10.1.454.CMB.1.raw
  modified_base (253)..(255): a, c, t, g, unknown or other
  misc_feature (253)..(255): n is a, c, g, or t

SEQ ID NO: 88146 - DNA, 254 bp, Homo sapiens; identical to SEQ ID NO: 87981
  misc_feature: GYAE6OF02GGJUF.49.10.A10.1.454.CMB.1.raw
  modified_base (253)..(254): a, c, t, g, unknown or other
  misc_feature (253)..(254): n is a, c, g, or t

SEQ ID NO: 88147 - DNA, 255 bp, Homo sapiens; identical to SEQ ID NO: 88006
  misc_feature: GYAE6OF02JDC3T.49.10.A10.1.454.CMB.1.raw
  modified_base (254)..(255): a, c, t, g, unknown or other
  misc_feature (254)..(255): n is a, c, g, or t

SEQ ID NO: 88148 - DNA, 254 bp, Homo sapiens
  misc_feature: GYAE6OF02HQ4VJ.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagnn

SEQ ID NO: 88149 - DNA, 255 bp, Homo sapiens
  misc_feature: GYAE6OF02IA8QH.49.10.A10.1.454.CMB.1.raw
  modified_base (254)..(255): a, c, t, g, unknown or other
  misc_feature (254)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagnn

SEQ ID NO: 88150 - DNA, 264 bp, Homo sapiens
  misc_feature: GYAE6OF02IJ86U.49.10.A10.1.454.CMB.1.raw
  modified_base (253)..(264): a, c, t, g, unknown or other
  misc_feature (253)..(264): n is a, c, g, or t
tcagagtcgagagacacgaccggtgctcgatttagcgtcgatctcagggggatggccaccctgaccattaccagggccgaagccgggatgaggccgactattactgtcaggtgtgggatagtgatacggaccattgggtgttcggcggagggaccaaggtgaccgtcctaggtcagcccaaggctgcccctcggtcactctgtcccacctcctctctctcgtactctgacgtcggctcggacaagcgcatagnnnnnnnnnnnn

SEQ ID NO: 88151 - DNA, 256 bp, Homo sapiens
  misc_feature: GYAE6OF02JPU70.49.10.A10.1.454.CMB.1.raw
  modified_base (252)..(256): a, c, t, g, unknown or other
  misc_feature (252)..(256): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgcccctcggtcactctgttcccgcctcctctctctcgactctgagcgggctggcaaggcgcatagnnnnn

SEQ ID NO: 88152 - DNA, 255 bp, Homo sapiens
  misc_feature: GYAE6OF02H02MO.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgcatagnnn

SEQ ID NO: 88153 - DNA, 264 bp, Homo sapiens
  misc_feature: GYAE6OF02HMADE.49.10.A10.1.454.CMB.1.raw
  modified_base (253)..(264): a, c, t, g, unknown or other
  misc_feature (253)..(264): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgcatagnnnnnnnnnnnn

SEQ ID NO: 88154 - DNA, 256 bp, Homo sapiens; identical to SEQ ID NO: 88041
  misc_feature: GYAE6OF02GD3C4.49.10.A10.1.454.CMB.1.raw
  modified_base (254)..(256): a, c, t, g, unknown or other
  misc_feature (254)..(256): n is a, c, g, or t

SEQ ID NO: 88155 - DNA, 254 bp, Homo sapiens
  misc_feature: GYAE6OF02H5DW2.49.10.A10.1.454.CMB.1.raw
  modified_base (253)..(254): a, c, t, g, unknown or other
  misc_feature (253)..(254): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgcatagnn

SEQ ID NO: 88156 - DNA, 256 bp, Homo sapiens; identical to SEQ ID NO: 88041
  misc_feature: GYAE6OF02G74WO.49.10.A10.1.454.CMB.1.raw
  modified_base (254)..(256): a, c, t, g, unknown or other
  misc_feature (254)..(256): n is a, c, g, or t

SEQ ID NO: 88157 - DNA, 259 bp, Homo sapiens
  misc_feature: GYAE6OF02F5R68.49.10.A10.1.454.CMB.1.raw
  modified_base (255)..(259): a, c, t, g, unknown or other
  misc_feature (255)..(259): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnn

SEQ ID NO: 88158 - DNA, 257 bp, Homo sapiens; identical to SEQ ID NO: 88032
  misc_feature: GYAE6OF02FM4WZ.49.10.A10.1.454.CMB.1.raw
  modified_base (255)..(257): a, c, t, g, unknown or other
  misc_feature (255)..(257): n is a, c, g, or t

SEQ ID NO: 88159 - DNA, 255 bp, Homo sapiens
  misc_feature: GYAE6OF02H6864.49.10.A10.1.454.CMB.1.raw
  modified_base (253)..(255): a, c, t, g, unknown or other
  misc_feature (253)..(255): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcagcccaaggctgcccctcggtcactctgttcccgcctcctctctctcgactctgagcgggctggcaaggcgcatagnnn

SEQ ID NO: 88160 - DNA, 256 bp, Homo sapiens; identical to SEQ ID NO: 87973
  misc_feature: GYAE6OF02G1C6N.49.10.A10.1.454.CMB.1.raw
  modified_base (255)..(256): a, c, t, g, unknown or other
  misc_feature (255)..(256): n is a, c, g, or t

SEQ ID NO: 88161 - DNA, 297 bp, Homo sapiens
  misc_feature: GYAE6OF02GD92J.49.10.A10.1.454.CMB.1.raw
  modified_base (253)..(253): a, c, t, g, unknown or other
  misc_feature (253)..(253): n is a, c, g, or t
  modified_base (258)..(297): a, c, t, g, unknown or other
  misc_feature (258)..(297): n is a, c, g, or t
tcagagtcgagagacacgaccggtgctcgatttagcgtcgatctcgaggggagatggccaccctgaccattaccaggggcccgaagccggggatgaggcccgactattactgtcaggtgtgggatagtgactacggaccattgggtgttcggcggagggaccaaggtgaccgtcctaggtcagcccaaggctgccccctggtcactctgttcccacctcctctctctcgactctgagcgggctggcaaggcgnatagnnnnnnnnnnnnnnnnnnnnnnnnnnnnnnnnnnnnnnnn

SEQ ID NO: 88162 - DNA, 253 bp, Homo sapiens
  misc_feature: GYAE6OF02FORCD.49.10.A10.1.454.CMB.1.raw
  modified_base (253)..(253): a, c, t, g, unknown or other
  misc_feature (253)..(253): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgcccctcggtcactctgttcccaccctcctctctctcgactctgagcgggctggcaaggcgcatagn

SEQ ID NO: 88163 - DNA, 253 bp, Homo sapiens
  misc_feature: GYAE6OF02GPT7Y.49.10.A10.1.454.CMB.1.raw
  modified_base (253)..(253): a, c, t, g, unknown or other
  misc_feature (253)..(253): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagn

SEQ ID NO: 88164 - DNA, 255 bp, Homo sapiens
  misc_feature: GYAE6OF02HZCJA.49.10.A10.1.454.CMB.1.raw
  modified_base (252)..(255): a, c, t, g, unknown or other
  misc_feature (252)..(255): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctcctcgactctgagcgggctggcaaggcgcatagnnnn

SEQ ID NO: 88165 - DNA, 333 bp, Homo sapiens
  misc_feature: GYAE6OF02IGOIM.49.10.A10.1.454.CMB.1.raw
  modified_base (271)..(273): a, c, t, g, unknown or other
  misc_feature (271)..(273): n is a, c, g, or t
  modified_base (276)..(333): a, c, t, g, unknown or other
  misc_feature (276)..(333): n is a, c, g, or t
tcagagtcgagagacacgaccggtgctcgatttagcgtcgatctcagggggggtagtggcccacccgtgaccattaaccagggccgaagccgggggatgaggccggacctattactgtcaggtggtgggatagtgatacggaccattgggtgttcggcggagggaccaaggtgaccgtcctaggtcagcccaacggctgcccccctcggtcacctctgttcccgccctacctcgtctctcgactctgagcggctggccaaggcgcaatagnnntannnnnnnnnnnnnnnnnnnnnnnnnnnnnnnnnnnnnnnnnnnnnnnnnnnnnnnnnn

SEQ ID NO: 88166 - DNA, 254 bp, Homo sapiens
  misc_feature: GYAE6OF02H9BMW.49.10.A10.1.454.CMB.1.raw
  modified_base (254)..(254): a, c, t, g, unknown or other
  misc_feature (254)..(254): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagn

SEQ ID NO: 88167 - DNA, 256 bp, Homo sapiens; identical to SEQ ID NO: 87991
  misc_feature: GYAE6OF02HE7SA.49.10.A10.1.454.CMB.1.raw
  modified_base (254)..(256): a, c, t, g, unknown or other
  misc_feature (254)..(256): n is a, c, g, or t

SEQ ID NO: 88168 - DNA, 262 bp, Homo sapiens
  misc_feature: GYAE6OF02GYVYA.49.10.A10.1.454.CMB.1.raw
  modified_base (254)..(262): a, c, t, g, unknown or other
  misc_feature (254)..(262): n is a, c, g, or t
tcagagtcgagagacacgaccggtgctcgatttagcgtcgatctcagggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgcatagnnnnnnnnn

SEQ ID NO: 88169 - DNA, 289 bp, Homo sapiens
  misc_feature: GYAE6OF02G4TO1.49.10.A10.1.454.CMB.1.raw
  modified_base (256)..(289): a, c, t, g, unknown or other
  misc_feature (256)..(289): n is a, c, g, or t
tcagagtcgagagacacgaccggtgctcgatttagcgtcgatctcaggggggtagtggccaccctgaccattaccagggccgaagccgggatgaggccgactattacctgtcaggtgtgggatagtgatacggaccattgggtgttcggcggagggaccaaggtgaccgtcctaggtcagcccaaggcctgccccctcggtcactctgttcccgcctcctctctctcgactctgagcggctggcaaggcgcatagnnnnnnnnnnnnnnnnnnnnnnnnnnnnnnnnnn

SEQ ID NO: 88170 - DNA, 256 bp, Homo sapiens; identical to SEQ ID NO: 87989
  misc_feature: GYAE6OF02G35SG.49.10.A10.1.454.CMB.1.raw
  modified_base (254)..(256): a, c, t, g, unknown or other
  misc_feature (254)..(256): n is a, c, g, or t

SEQ ID NO: 88171 - DNA, 265 bp, Homo sapiens
  misc_feature: GYAE6OF02GCBM1.49.10.A10.1.454.CMB.1.raw
  modified_base (256)..(259): a, c, t, g, unknown or other
  misc_feature (256)..(259): n is a, c, g, or t
  modified_base (261)..(265): a, c, t, g, unknown or other
  misc_feature (261)..(265): n is a, c, g, or t
tcagagtcgagagacacgaccggtgctcgatttagcgtcgatctcaggggagatggccaccctgaccattaccagggccgaagcccggggatgaggccgactagttactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnnannnnn

SEQ ID NO: 88172 - DNA, 255 bp, Homo sapiens; identical to SEQ ID NO: 88152
  misc_feature: GYAE6OF02F9L41.49.10.A10.1.454.CMB.1.raw
  modified_base (253)..(255): a, c, t, g, unknown or other
  misc_feature (253)..(255): n is a, c, g, or t

SEQ ID NO: 88173 - DNA, 257 bp, Homo sapiens; identical to SEQ ID NO: 88008
  misc_feature: GYAE6OF02FWZP3.49.10.A10.1.454.CMB.1.raw
  modified_base (255)..(257): a, c, t, g, unknown or other
  misc_feature (255)..(257): n is a, c, g, or t

SEQ ID NO: 88174 - DNA, 264 bp, Homo sapiens
  misc_feature: GYAE6OF02JV6QO.49.10.A10.1.454.CMB.1.raw
  modified_base (254)..(264): a, c, t, g, unknown or other
  misc_feature (254)..(264): n is a, c, g, or t
tcagagtcgagagacacgaccggtgctcgatttagcgtcgatctcagggggagtggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccacctcctctctctcgactctgagcgggctggcaaggcgcatagnnnnnnnnnnn

SEQ ID NO: 88175 - DNA, 278 bp, Homo sapiens
  misc_feature: GYAE6OF02GIIUR.49.10.A10.1.454.CMB.1.raw
  modified_base (254)..(254): a, c, t, g, unknown or other
  misc_feature (254)..(254): n is a, c, g, or t
  modified_base (256)..(278): a, c, t, g, unknown or other
  misc_feature (256)..(278): n is a, c, g, or t
tcagagtcgagagacacgaccggtgctcgatttagcgtcgatctcaggggagagtggccaccctgaccattaccagggccgaagccgggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcggctggcaaggcgcagtagnannnnnnnnnnnnnnnnnnnnnnn

SEQ ID NO: 88176 - DNA, 266 bp, Homo sapiens
  misc_feature: GYAE6OF02H731E.49.10.A10.1.454.CMB.1.raw
  modified_base (248)..(248): a, c, t, g, unknown or other
  misc_feature (248)..(248): n is a, c, g, or t
  modified_base (254)..(266): a, c, t, g, unknown or other
  misc_feature (254)..(266): n is a, c, g, or t
tcagagtcgagagacacgaccggtgctcgatttagcgtcgatctcagggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcncatagnnnnnnnnnnnnn

SEQ ID NO: 88177 - DNA, 257 bp, Homo sapiens; identical to SEQ ID NO: 88042
  misc_feature: GYAE6OF02IR4UV.49.10.A10.1.454.CMB.1.raw
  modified_base (254)..(257): a, c, t, g, unknown or other
  misc_feature (254)..(257): n is a, c, g, or t

SEQ ID NO: 88178 - DNA, 258 bp, Homo sapiens; identical to SEQ ID NO: 88007
  misc_feature: GYAE6OF02GHGKG.49.10.A10.1.454.CMB.1.raw
  modified_base (254)..(258): a, c, t, g, unknown or other
  misc_feature (254)..(258): n is a, c, g, or t

SEQ ID NO: 88179 - DNA, 154 bp, Homo sapiens
  misc_feature: GYAE6OF02HJZH2.49.10.A10.1.454.CMB.1.raw
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggaggg

SEQ ID NO: 88180 - DNA, 264 bp, Homo sapiens
  misc_feature: GYAE6OF02GLC55.49.10.A10.1.454.CMB.1.raw
  modified_base (253)..(264): a, c, t, g, unknown or other
  misc_feature (253)..(264): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcgcatagnnnnnnnnnnnn

SEQ ID NO: 88181 - DNA, 256 bp, Homo sapiens; identical to SEQ ID NO: 88035
  misc_feature: GYAE6OF02GLYMF.49.10.A10.1.454.CMB.1.raw
  modified_base (254)..(256): a, c, t, g, unknown or other
  misc_feature (254)..(256): n is a, c, g, or t

SEQ ID NO: 88182 - DNA, 262 bp, Homo sapiens
  misc_feature: GYAE6OF02F3V1L.49.10.A10.1.454.CMB.1.raw
  modified_base (255)..(262): a, c, t, g, unknown or other
  misc_feature (255)..(262): n is a, c, g, or t
tcagagtcgagagacacgaccggtgctcgatttagcgtcgatctcaggggaggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcgactctgagcgggctggcaaggcgcatagnnnnnnnn

SEQ ID NO: 88183 - DNA, 259 bp, Homo sapiens
  misc_feature: GYAE6OF02J2M68.49.10.A10.1.454.CMB.1.raw
  modified_base (249)..(255): a, c, t, g, unknown or other
  misc_feature (249)..(255): n is a, c, g, or t
  modified_base (257)..(259): a, c, t, g, unknown or other
  misc_feature (257)..(259): n is a, c, g, or t
tcagagtcgagagacacgaccggtgctcgatttagcgtcgatctcagggggatggccaccctgaccattaccagggccgaagccgggatgaggccgactagttactgtcaggtgtgggatagtgatacggaccattgggtgttcggcggagggaccaaggtgaccgtcctaggtcagccaaggctgcccctggtcactctgttcccacctcctctctctcgactctgacgcggctggcaaggcgcatgnnnnnnnannn

SEQ ID NO: 88184 - DNA, 256 bp, Homo sapiens
  misc_feature: GYAE6OF02FXRQI.49.10.A10.1.454.CMB.1.raw
  modified_base (248)..(248): a, c, t, g, unknown or other
  misc_feature (248)..(248): n is a, c, g, or t
  modified_base (254)..(256): a, c, t, g, unknown or other
  misc_feature (254)..(256): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcncatagnnn

SEQ ID NO: 88185 - DNA, 250 bp, Homo sapiens
  misc_feature: GYAE6OF02HYUK5.49.10.A10.1.454.CMB.1.raw
  modified_base (250)..(250): a, c, t, g, unknown or other
  misc_feature (250)..(250): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggccagcccaaggctgccccctggtcactctgttcccaccctcctctctctcgactctgagcggctggcaggcgcatgn

SEQ ID NO: 88186 - DNA, 260 bp, Homo sapiens
  misc_feature: GYAE6OF02F24IT.49.10.A10.1.454.CMB.1.raw
  modified_base (254)..(260): a, c, t, g, unknown or other
  misc_feature (254)..(260): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnnnnn

SEQ ID NO: 88187 - DNA, 257 bp, Homo sapiens; identical to SEQ ID NO: 88045
  misc_feature: GYAE6OF02F3HMI.49.10.A10.1.454.CMB.1.raw
  modified_base (255)..(257): a, c, t, g, unknown or other
  misc_feature (255)..(257): n is a, c, g, or t

SEQ ID NO: 88188 - DNA, 268 bp, Homo sapiens
  misc_feature: GYAE6OF02HT3I8.49.10.A10.1.454.CMB.1.raw
  modified_base (258)..(268): a, c, t, g, unknown or other
  misc_feature (258)..(268): n is a, c, g, or t
tcagagtcgagagacacgaccggtgctcgatttagcgtcgatctcaggggagatggccaccctgaccattaccagggccgaagccggggatgaggccgactattactgtcaggtgtggatagtgatacggaccattgggtgttcggcggagggaccaaggtgaccgtcctaggtcagcccaaggctcgccccctcggtccactctcgttccccgcctcctctctctcgactctgagcgggctggcaaggcgacatagnnnnnnnnnnn

SEQ ID NO: 88189 - DNA, 265 bp, Homo sapiens
  misc_feature: GYAE6OF02ISIJ8.49.10.A10.1.454.CMB.1.raw
  modified_base (254)..(265): a, c, t, g, unknown or other
  misc_feature (254)..(265): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggtggagggccaaggtgaccgtctaggtcagcccaaggctgccccctcggtcactctgttcccgccctcctctctctcgactctgagcgggctggcaaggccgcatagnnnnnnnnnnnn

SEQ ID NO: 88190 - DNA, 258 bp, Homo sapiens
  misc_feature: GYAE6OF02GQAE5.49.10.A10.1.454.CMB.1.raw
  modified_base (254)..(258): a, c, t, g, unknown or other
  misc_feature (254)..(258): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnnn

SEQ ID NO: 88191 - DNA, 257 bp, Homo sapiens; identical to SEQ ID NO: 88032
  misc_feature: GYAE6OF02HEYQW.49.10.A10.1.454.CMB.1.raw
  modified_base (255)..(257): a, c, t, g, unknown or other
  misc_feature (255)..(257): n is a, c, g, or t

SEQ ID NO: 88192 - DNA, 340 bp, Homo sapiens
  misc_feature: GYAE6OF02F5OCL.49.10.A10.1.454.CMB.1.raw
  modified_base (143)..(143): a, c, t, g, unknown or other
  misc_feature (143)..(143): n is a, c, g, or t
  modified_base (165)..(165): a, c, t, g, unknown or other
  misc_feature (165)..(165): n is a, c, g, or t
  modified_base (227)..(227): a, c, t, g, unknown or other
  misc_feature (227)..(227): n is a, c, g, or t
  modified_base (265)..(266): a, c, t, g, unknown or other
  misc_feature (265)..(266): n is a, c, g, or t
  modified_base (269)..(269): a, c, t, g, unknown or other
  misc_feature (269)..(269): n is a, c, g, or t
  modified_base (271)..(274): a, c, t, g, unknown or other
  misc_feature (271)..(274): n is a, c, g, or t
  modified_base (276)..(340): a, c, t, g, unknown or other
  misc_feature (276)..(340): n is a, c, g, or t
tcagagtcgagagacacgaccggtgctcgatttagcgtcgatctcagggggatggccaccctgaccattaccagggccgaagccggggatgaggccgactattactggtcagggtgtgggatagtgatacggaccattgggtnttcgggcggagggaccaaggtnaccgtcctaggtcagcccaaggctgcccccctgggtcactctggttccccacctccgtctcnctcgactctgagcggggcttgggcaaggtcgcatagcnngtngnnnngnnnnnnnnnnnnnnnnnnnnnnnnnnnnnnnnnnnnnnnnnnnnnnnnnnnnnnnnnnnnnnnnn

SEQ ID NO: 88193 - DNA, 276 bp, Homo sapiens
  misc_feature: GYAE6OF02JKFWD.49.10.A10.1.454.CMB.1.raw
  modified_base (261)..(276): a, c, t, g, unknown or other
  misc_feature (261)..(276): n is a, c, g, or t
tcagagtcgagagacacgaccggtgctcgatttagcgtcgatctcagggagatggccaccctgaccattaccaggccgaagccgggatgaggccgactattactgtcaggtgtggagtagtgatacggaccattgggtgttcggcggtagggaccgaaggtgaccgtccgtaggtcgagcccaaggctcgcccctcggtcactctcgttcccaccctcctcctcctaactcgacctctgacgcggctggcaggcgcatagnnnnnnnnnnnnnnnn

SEQ ID NO: 88194 - DNA, 280 bp, Homo sapiens
  misc_feature: GYAE6OF02FOEOK.49.10.A10.1.454.CMB.1.raw
  modified_base (271)..(280): a, c, t, g, unknown or other
  misc_feature (271)..(280): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcgacgacccgaaggctcgcccccgtcggtctactctcgtcccaccctcctctctctcgactctgacggcggcgtggacgaagggccgactaatagnnnnnnnnnn

SEQ ID NO: 88195 - DNA, 258 bp, Homo sapiens
  misc_feature: GYAE6OF02FP6A3.49.10.A10.1.454.CMB.1.raw
  modified_base (255)..(258): a, c, t, g, unknown or other
  misc_feature (255)..(258): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcctaaggctgcccccagcgtcactctgttcccaccctcctctctctcgactctgagcgggctggcaaggcgcatagnnnn

SEQ ID NO: 88196 - DNA, 261 bp, Homo sapiens
  misc_feature: GYAE6OF02HOFBD.49.10.A10.1.454.CMB.1.raw
  modified_base (254)..(261): a, c, t, g, unknown or other
  misc_feature (254)..(261): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgccctcctctctctcgactctgagcgggctggcaaggcgcatagnnnnnnnn

SEQ ID NO: 88197 - DNA, 261 bp, Homo sapiens
  misc_feature: GYAE6OF02FXOVS.49.10.A10.1.454.CMB.1.raw
  modified_base (253)..(261): a, c, t, g, unknown or other
  misc_feature (253)..(261): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccgcctcctctctctcgactctgagcgggctggcaaggcgcatagnnnnnnnnn

SEQ ID NO: 88198 - DNA, 261 bp, Homo sapiens
  misc_feature: GYAE6OF02HMUMC.49.10.A10.1.454.CMB.1.raw
  modified_base (248)..(248): a, c, t, g, unknown or other
  misc_feature (248)..(248): n is a, c, g, or t
  modified_base (254)..(261): a, c, t, g, unknown or other
  misc_feature (254)..(261): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccaccctcctctctctcgactctgagcgggctggcaaggcncatagnnnnnnnn

SEQ ID NO: 88199 - DNA, 262 bp, Homo sapiens
  misc_feature: GYAE6OF02FIYMO.49.10.A10.1.454.CMB.1.raw
  modified_base (254)..(262): a, c, t, g, unknown or other
  misc_feature (254)..(262): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgacatagnnnnnnnnn

SEQ ID NO: 88200 - DNA, 257 bp, Homo sapiens
  misc_feature: GYAE6OF02FJLQV.49.10.A10.1.454.CMB.1.raw
  modified_base (253)..(257): a, c, t, g, unknown or other
  misc_feature (253)..(257): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctgttcccacctcctctctctcgactctgagcgggctggcaaggcgcatagnnnnn

SEQ ID NO: 88201 - DNA, 266 bp, Homo sapiens
  misc_feature: GYAE6OF02IYVOA.49.10.A10.1.454.CMB.1.raw
  modified_base (143)..(143): a, c, t, g, unknown or other
  misc_feature (143)..(143): n is a, c, g, or t
  modified_base (255)..(266): a, c, t, g, unknown or other
  misc_feature (255)..(266): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattggggtnttcggcggagggaccaaggtgaccgtcctaggtcagcccaaggctgccccctggtcactctgttcccacctcctctctctcgactctgagcgggctggccaaggcgcatagnnnnnnnnnnnn

SEQ ID NO: 88202 - DNA, 263 bp, Homo sapiens
  misc_feature: GYAE6OF02FLQZ7.49.10.A10.1.454.CMB.1.raw
  modified_base (256)..(263): a, c, t, g, unknown or other
  misc_feature (256)..(263): n is a, c, g, or t
tcagagtcgagagacacgaccggtgctcgatttagcgtcgatctcagggggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnnnnnnnn

SEQ ID NO: 88203 - DNA, 275 bp, Homo sapiens
  misc_feature: GYAE6OF02H4UZQ.49.10.A10.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (254)..(275): a, c, t, g, unknown or other
  misc_feature (254)..(275): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctcgttcccaccctcctctctctcgactntgagcgggctggcaggcgnagtgnnnnnnnnnnnnnnnnnnnnnn

SEQ ID NO: 88204 - DNA, 259 bp, Homo sapiens
  misc_feature: GYAE6OF02IJ3QN.49.10.A10.1.454.CMB.1.raw
  modified_base (254)..(259): a, c, t, g, unknown or other
  misc_feature (254)..(259): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcgggagggaccaaggtgaccgtcctaggtcagcccaaggctgccccctggtcactctgttcccgcctcctctctctcgactctgagcgggctggcaaggcgcatagnnnnnn

SEQ ID NO: 88205 - DNA, 263 bp, Homo sapiens
  misc_feature: GYAE6OF02JF4J9.49.10.A10.1.454.CMB.1.raw
  modified_base (247)..(247): a, c, t, g, unknown or other
  misc_feature (247)..(247): n is a, c, g, or t
  modified_base (253)..(263): a, c, t, g, unknown or other
  misc_feature (253)..(263): n is a, c, g, or t
tcagagtcgagagacacgaccggtgctcgatttagcgtcgatctcagggagatggccaccctgaccattaccagggccgaagccggggatgaggccgactattactgtcaggtgtggatagtgatacggaccattgggtgttcggcggagggaccaaggtgaccgtcctaggtcagcccaaggctcgccccctcggtccactctcgttcccaccctcctctctctcgactctgagcggctggcagcncatagnnnnnnnnnnn

SEQ ID NO: 88206 - DNA, 259 bp, Homo sapiens
  misc_feature: GYAE6OF02ILY52.49.10.A10.1.454.CMB.1.raw
  modified_base (253)..(259): a, c, t, g, unknown or other
  misc_feature (253)..(259): n is a, c, g, or t
tcagagtcgagagacacgaccggtgctcgatttagcgtcgatctcagggggatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcggctggcaaggcgcatagnnnnnnn

SEQ ID NO: 88207 - DNA, 277 bp, Homo sapiens
  misc_feature: GYAE6OF02I3LHE.49.10.A10.1.454.CMB.1.raw
  modified_base (259)..(277): a, c, t, g, unknown or other
  misc_feature (259)..(277): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctcgttcccaccctcctctctctcgactcgtgagcgggctggacaaggcgacagtagnnnnnnnnnnnnnnnnnnn

SEQ ID NO: 88208 - DNA, 276 bp, Homo sapiens
  misc_feature: GYAE6OF02HO05Z.49.10.A10.1.454.CMB.1.raw
  modified_base (261)..(276): a, c, t, g, unknown or other
  misc_feature (261)..(276): n is a, c, g, or t
tcagagtcgagagacacgaccggtgctcgatttagcgtcgatctcaggggagatggccaccctgaccattaccagggccgaagccggggatgaggccgactattactgtcaggtgtgggatagtgatacggaccattgggtgttcggcggagggaccaaggtgaccgtcctaggtcagcccaaggcctcgccccctggtccactctcgttcccgccctcctctctctcgactctgacggcgggctaggcaaggcgcagtgnnnnnnnnnnnnnnnn

SEQ ID NO: 88209 - DNA, 325 bp, Homo sapiens
  misc_feature: GYAE6OF02F4R3L.49.10.A10.1.454.CMB.1.raw
  modified_base (258)..(258): a, c, t, g, unknown or other
  misc_feature (258)..(258): n is a, c, g, or t
  modified_base (262)..(263): a, c, t, g, unknown or other
  misc_feature (262)..(263): n is a, c, g, or t
  modified_base (265)..(325): a, c, t, g, unknown or other
  misc_feature (265)..(325): n is a, c, g, or t
tcagagtcgagagacacgaccggtgctcgatttagcgtcgatctcagggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctggtcactctcgttcccgcctcctctctctcgactctgacgcggctggacaagggcacagtagnagtnntnnnnnnnnnnnnnnnnnnnnnnnnnnnnnnnnnnnnnnnnnnnnnnnnnnnnnnnnnnnnn

SEQ ID NO: 88210 - DNA, 264 bp, Homo sapiens
  misc_feature: GYAE6OF02HDZEA.49.10.A10.1.454.CMB.1.raw
  modified_base (256)..(264): a, c, t, g, unknown or other
  misc_feature (256)..(264): n is a, c, g, or t
tcagagtcgagagacacgaccggtgctcgatttagcgtcgatctcaggggagatggccaccctgaccattaccagggccgaagccgggggatgaggccgactattactgtcaggtgtgggatagtgatacggaccattgggtgttcggcggagggaccaaggtgaccgtcctaggtcagcccaaggctgccccctcggtcactctgttcccgccctcctctctctcgactctgagcgggctggcaaggcgcatagnnnnnnnnn

SEQ ID NO: 88211 - DNA, 277 bp, Homo sapiens
  misc_feature: GYAE6OF02H7P1I.49.10.A10.1.454.CMB.1.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (258)..(277): a, c, t, g, unknown or other
  misc_feature (258)..(277): n is a, c, g, or t
tcagagtcgagagacacgaccggtgctcgattttagcgtcgatctcagggggatggccaccctgaccattaccagggccgaagcggggatgaggccgactattactgtcaggtgtgggatagtgatacggaccattgggtgttcggcggagggaccgaaggtcgaccgtcctaggtcacgcccaaggctcgccccctcggtaactctcgttcccaccctcctctctctcgactctgagcggntcgacaggcgnagtannnnnnnnnnnnnnnnnnnn

SEQ ID NO: 88212 - DNA, 287 bp, Homo sapiens
  misc_feature: GYAE6OF02H4AG8.49.10.A10.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (262)..(287): a, c, t, g, unknown or other
  misc_feature (262)..(287): n is a, c, g, or t
tcagagtcgagagacacgaccggtgctcgatttagcgtcgatctcaggggggatggccaccctgaccattaccagggccgaagccggggatgaggccgactattactgtcaggtgtgggatagtgatacggaccattgggtgttcggcggagggaccaaaggtgaccgtcctaggtcagcccaaggctgcccccctggtcactctcgttcccaccctcctcctctctcgtacnctgagcgggctcggcaaggcncgaatagnnnnnnnnnnnnnnnnnnnnnnnnnn

SEQ ID NO: 88213 - DNA, 276 bp, Homo sapiens
  misc_feature: GYAE6OF02HQ6D0.49.10.A10.1.454.CMB.1.raw
  modified_base (254)..(276): a, c, t, g, unknown or other
  misc_feature (254)..(276): n is a, c, g, or t
tcagagtcgagagacacgaccggtgctcgatttagcgtcgatctcaggggggatggccaccctgaccattaccagggccgaagccgggggatgaggccgactattactgtcaggtgtgggatagtgatacggaccattgggtgttcggcggagggaccaaggtgaccgtcctaggtcagcccaaggctgccccctggtcactctgttcccgcctcctctctctcgactctgagcgggctggcaaggcgcatagnnnnnnnnnnnnnnnnnnnnnnn

SEQ ID NO: 88214 - DNA, 322 bp, Homo sapiens
  misc_feature: GYAE6OF02HZR5N.49.10.A10.1.454.CMB.1.raw
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(322): a, c, t, g, unknown or other
  misc_feature (258)..(322): n is a, c, g, or t
tcagagtcgagagacacgaccggtgctcgatttagcgtcgatctcaggggagatggccaccctgaccattaccagggccgaagccgggggatgaggccgactattactgtcaggtgtgggatagtgatacggaccattgggtgttcggcggaggaccaaggtgaccgtctaggtcagcccaaggctgccccctggtcactctgttcccacctcctctctctcgactctgagcgggctggcaacggcacagtagntncnnnnnnnnnnnnnnnnnnnnnnnnnnnnnnnnnnnnnnnnnnnnnnnnnnnnnnnnnnnnnnnnn

SEQ ID NO: 88215 - DNA, 130 bp, Homo sapiens
  misc_feature: GYAE6OF01EG26M.33.28.C06.1.454.CMB.1.raw
  modified_base (130)..(130): a, c, t, g, unknown or other
  misc_feature (130)..(130): n is a, c, g, or t
tcagtacacacactcacgaccggtgctcgatttagagctcacgtattgggtttgggcacagcggccctgggctgcctggtcaaggactacttccagtgtgtgtactgagcgggctggcaaggcgcatagn

SEQ ID NO: 88216 - DNA, 130 bp, Homo sapiens; identical to SEQ ID NO: 88215
  misc_feature: GYAE6OF01ACJAK.33.28.C06.1.454.CMB.1.raw
  modified_base (130)..(130): a, c, t, g, unknown or other
  misc_feature (130)..(130): n is a, c, g, or t

SEQ ID NO: 88217 - DNA, 130 bp, Homo sapiens; identical to SEQ ID NO: 88215
  misc_feature: GYAE6OF01CSHTV.33.28.C06.1.454.CMB.1.raw
  modified_base (130)..(130): a, c, t, g, unknown or other
  misc_feature (130)..(130): n is a, c, g, or t

SEQ ID NO: 88218 - DNA, 525 bp, Homo sapiens
  misc_feature: GYAE6OF01DU5CJ.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatccctgatcgttttcagggtccagctcgtggggctgagcgctacctcaccatctccagcctccagtctgaggatgaggctgactattactgtcagaccgtggggctacgttggttattggttgggttttcgggcgggtagggaccgaaggctggacccgttccgtagggtccgacggaccccgaaggcctcgcccccgtccggg

SEQ ID NO: 88219 - DNA, 173 bp, Homo sapiens
  misc_feature: GYAE6OF01BDBG1.33.28.C06.1.454.CMB.1.raw
  modified_base (173)..(173): a, c, t, g, unknown or other
  misc_feature (173)..(173): n is a, c, g, or t
tcagtacacacactcacgaccggtgctcgatttagagctcacgtattgggtttgggggaagaggaagactgacggtcccccaggagttcaggtgctgggcacagcggccctgggctgcctggtcaaggactacttccagtgtgtgtactgagcgggctggcaaggcgcatagn

SEQ ID NO: 88220 - DNA, 585 bp, Homo sapiens
  misc_feature: GYAE6OF01BWXNF.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccctcccgtggggacgcctcggtcaagctcatctgcactctgagcaggtgggcacagcaactacgccatcgcatggcatcagcagcagccagagaagggccctcggtacttgatgaaggttaacagtgatggacacgccacgaccgaagggggacggatccgtagtagttcgtttcgagggtccagctcgtgggctgacgcgactaccgtcaccatcctccacgccctcgagtcgtaggaggtagtggaggtctagtacttaagttacgtcgtacgacggtaccgtggggactacgttaggttagttcgggttgggtttccgggacgggtaacgggtacccgaaggtccgtacggtcccgttaccgtagggtaccgacggacccgtaaggccctcccggtcccccgttaccgg

SEQ ID NO: 88221 - DNA, 185 bp, Homo sapiens
  misc_feature: GYAE6OF01E06Y9.33.28.C06.1.454.CMB.1.raw
  modified_base (175)..(185): a, c, t, g, unknown or other
  misc_feature (175)..(185): n is a, c, g, or t
tcagtacacacactcacgaccggtgctcgatttagagctcacgtattgggtttgggggaagaggaagactgacggtcccccaggagttcaggtgctgggcacagcggccctgggctgcctggtcaaggactacttccagtgtgtgtactggagcgggctggcaaggtcgcatagnnnnnnnnnnn

SEQ ID NO: 88222 - DNA, 527 bp, Homo sapiens
  misc_feature: GYAE6OF01EULQ0.33.28.C06.1.454.CMB.1.raw
  modified_base (438)..(438): a, c, t, g, unknown or other
  misc_feature (438)..(438): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggatggtgaagccttcggagaccctgtccctcacctgcactgtctctggtgctccatcagcagaagtctttactactgggctggatccgccagcccccagggaaggggctggagtggattgggaatatctattatagtgggagcagctactacaacccgtcctcaagagtcgagtcacatatcctagacacgtccaagaacccagttcctccctgaagctcgacctctgtcgaccgccgcagacacggctgtatattacngtgcgagacagtaaccgggagtcggagtgtagttcggggaccaggggaccctgggtccacccgtctccctcacgtccctccgaacccgg

SEQ ID NO: 88223 - DNA, 523 bp, Homo sapiens
  misc_feature: GYAE6OF01BLRCY.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacgaccgaagggggacggatcccgtgattcgttttcgagggtccagctcgtgggctgagcgctacctcaccatctccacgcctcagtctgaggatgagctgactattacgtgtcagaccgtggggctacgttggttatggttgggtttcggcgggtagggaccaggtctacggacccgttccgtaggtccacgccccgaaggcctccggcccccgtcgg

SEQ ID NO: 88224 - DNA, 130 bp, Homo sapiens; identical to SEQ ID NO: 88215
  misc_feature: GYAE6OF01CUSN2.33.28.C06.1.454.CMB.1.raw
  modified_base (130)..(130): a, c, t, g, unknown or other
  misc_feature (130)..(130): n is a, c, g, or t

SEQ ID NO: 88225 - DNA, 544 bp, Homo sapiens
  misc_feature: GYAE6OF01CDFVX.33.28.C06.1.454.CMB.1.raw
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctggtacttgatagaagttaacagtgatggcagccacgaccgaaggggacggatcccgtgtagttcgttttacgacgggtccagctcgtgggctggagcgtctaccgtcaccactcnccacncctcagtctgagntgagctagactatactgtacagacgtgggactagttggttagtggttgggtttcggacgggtagggaccgtacggtcgtacggtacccggttaccgtacggtaccgacggacccgaagggcctcccgggcccccgttccggg

SEQ ID NO: 88226 - DNA, 524 bp, Homo sapiens
  misc_feature: GYAE6OF01EBQI4.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctggtactgatggaaggttaacagtgatggcagccacaccgaagggggacggatcctgatcgttttcgagggtcagctcgtgggctgagcgctacctcaccatctccacgcctacagtctgaggatggacggctgactattacgtgtacacggaccgtggggctacgttggttagttggttggttttcgggcggtacgggaccgaagtcgtcggtacccgtcgtacggtcgtacgacccgaggcctcgccccgtcgg

SEQ ID NO: 88227 - DNA, 548 bp, Homo sapiens
  misc_feature: GYAE6OF01DAXOL.33.28.C06.1.454.CMB.1.raw
  modified_base (380)..(380): a, c, t, g, unknown or other
  misc_feature (380)..(380): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtacttgatgaaggttaacagtgatggcagccaacgacgaagggggacggatcccgtgacttcgttttcgagggtccagctcgtgggctgagcgctacctcaccatccnccacgcctcagtcctgaggatgaggctgacttattacgtgtcacgaccgtggggctacgttggttagttggttgggttttcgggcgggtacgggaccgaaaggtcgttacggacccgttccgtaagggtccgaacggacccgaaggccgtcccgtccccccgtaccgg

SEQ ID NO: 88228 - DNA, 540 bp, Homo sapiens
  misc_feature: GYAE6OF01BBA5P.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctggtactgatgaaggttaacagtgatggcagccacgaccgaagggggacggactcccgtgattcgttttcgagggtccagctcgtggggctggagcgctaccctcaccatcctccacgccctccagtctgaggatggaggctgactattactgtcagtaccgtggggctacgttggttagttggttgggttttcgggcgggtagggaccgaaggtcgtggacccggttccgtaggtaccacggacccgaaggccctccggcccccgttccgg

SEQ ID NO: 88229 - DNA, 753 bp, Homo sapiens
  misc_feature: GYAE6OF01ARQLC.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcacgccagaggaacggcccgtacggtacttgataggtaaggttaacaggtgagtggcacgaccaccgaaccggaacgggggacggaactcccgtagtacgttcgttttacgacgggtccagtcgtcggtcgggcgtggacgtccgtaccgttaccctaccgaaccctacttcccgtacccgtaaccgtccccgttacccgtaacgttccggtacgggtaacgggtacgtacgggtaacgggtaccgttacggtaacctttaacgtttaaccgttcgggttaacccgtaaccggtaacccgggttcgggggtaccttaacggttttagggttttacggtttacggggttttccggggtttttaccgggggaccgggggttaaacggggtaacccggtaacgggttaccggttaccgggttaccccgggttaccggttacgggtaccgtaacccgggaccccgtaaaccgggtcccgtacccgggtccccccggttacccggg

SEQ ID NO: 88230 - DNA, 535 bp, Homo sapiens
  misc_feature: GYAE6OF01E1X3E.33.28.C06.1.454.CMB.1.raw
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctggggagcctcggtcaagctcatctgcactctgagcagtggcacagcaactacgccatcgcatggcatcagcagcagccagagaacgggccctcggtacttgatgaaggttaacagtgatggcagccacgaccgaaggggacggatccgtgattcgttttcgaggtccagctcgtgggctgacgcgcctaccncaccntcctccacgcctcgagtcgtgaggatgaggctagactattcgtgtacagtaccgtgggactacgttggttagtggttgggtttcggcgggacgggtaccgaagtcgtacggacccgttcgtaggtccacggtacccgaaggccgtccggcccccgtcgg

SEQ ID NO: 88231 - DNA, 605 bp, Homo sapiens
  misc_feature: GYAE6OF01EALDO.33.28.C06.1.454.CMB.1.raw
  modified_base (184)..(184): a, c, t, g, unknown or other
  misc_feature (184)..(184): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagcagtgggcacagcaactcgccatcgcatggcatcagcagcagccagagaacgggccctcggtacttgataggaaggttaacagtgatggcagccacgacggaagggggacggatcccgtgtacttcggttttacgagggtccaggtccgtcgtgggggctggacggcggtacctaccctccacccacttcctacccgaagtccccttacctaggttcctagggaaggtagttggaggtccttagtaactttaagttaccgtgtaccgacggtaccggtggggtacctacggttggttacgttgggttcgggtttacggcgggtaacggtaccgaagtcgtcggtacccgtcgtaggtaccgacgacccgaaggcctccggtccccgtaccggg

SEQ ID NO: 88232 - DNA, 526 bp, Homo sapiens
  misc_feature: GYAE6OF01B4VJR.33.28.C06.1.454.CMB.1.raw
  modified_base (511)..(511): a, c, t, g, unknown or other
  misc_feature (511)..(511): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtgctccatcagcagaagtctttactactggggctggatccgccagcccccagggaagggctggagtggattgggaatatctattatagtgggagcagctactacaacccgtcctacaagagtcgagtcaacatatccttagacacgtaccaagaaccagttcctccctagaagctgacctctgtcgaccgccgcacgacacggctgtatattactgtcgcgagacagtaaccgggagtcggagtgtagtggggccaggggtaccctggtccaccgtctcctanacgcctccaacccgg

SEQ ID NO: 88233 - DNA, 608 bp, Homo sapiens
  misc_feature: GYAE6OF01D5TPR.33.28.C06.1.454.CMB.1.raw
  modified_base (184)..(184): a, c, t, g, unknown or other
  misc_feature (184)..(184): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggancctcggtcaagctcatctgccactctgagcagtcgggcacagcaactacgccatcgcagtggcatcagcagcagccagacggaacggcctcggtactgatggaaggtaacagtgatggacacgaccaacgaccggaagggggaccgactccgtagtacgttcgttttcaggtccagctcggtgggctgacgcgcctacctcaccatctaccgacncctcngtctgaggtntcggagctagtacttagttcgtgtacgtacgaccggtagggacctacggtttgggtttagttcgggttcgggttttaccggggacgggtaacgggtaacccgtaagggtcccgttacgggtacccggttaccgttaagggttccccgtaacgggtaccccgaacgggtcccttacccggtccccccgttacggg

SEQ ID NO: 88234 - DNA, 655 bp, Homo sapiens
  misc_feature: GYAE6OF01BXOHB.33.28.C06.1.454.CMB.1.raw
  modified_base (119)..(119): a, c, t, g, unknown or other
  misc_feature (119)..(119): n is a, c, g, or t
  modified_base (231)..(231): a, c, t, g, unknown or other
  misc_feature (231)..(231): n is a, c, g, or t
  modified_base (354)..(354): a, c, t, g, unknown or other
  misc_feature (354)..(354): n is a, c, g, or t
tcagtacacacactcacgaccggtgctcgatttagagctcacgtattgggtttggggatgctttctgagagtcatggactctcatgtgcaacgaactgaagcacctggtggttccttcncctgctggtggcggctccgagatcgggtcctgtacccagcctggccagctgccaaggtcgttccgggcccgggtacttgggcaagtccctttacgggagaccctgtaccctnacctgacactggtctcgtggtagctaccgatcagccagaagttctttactacttggggctggatccgccacgcccccgagggacgggcctggagtggattgggaatatcgtatatagtcggancagctaacgtcgaacccgtcctgaagtagtcgagtcacctagtactcttagacacgtacaagtaacccagttctaccctagaacgctcggacctcgtcgtcgacccgccgtcacggactacgggttcctaggttaacttaacttacgtcggttacgaccgtagtaacgtaacggtaacccggggacgttacgggaggttaccgggttaacgttcgggggacccgtaacggggtaaccccgttggggttacccaacccgggttaccttccgttaaccgcggtccccttcccgaaaccccggg

SEQ ID NO: 88235 - DNA, 621 bp, Homo sapiens
  misc_feature: GYAE6OF01EHD9L.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctcttcctccctgggagcctcggtcaagctcatctgcactctgagcaggtggcacagcaactacgccatcgcagtggcatcagcagcagccagagacggccctcggtactgatggaaggtacagtgagtggacagaccacgaaccggaagggggaccggactcccgtagtagttcggttttcgacgggtccaggtcgtcggtggggctggacgcgtcctacctcacctactcctaccacgtccctaccgacgtctaggacggtagtggacggtctaggtacttacttacgtgtaccacggaccggtggggtacctacggtttgggttacgttcggggtttcgggtttaccgggcgggtaacgggtaaccgtaggtcccgtacggtacccgttccggtaggtacccgaaccggccccgtaagggtccccgtcccggtcccccgttcggtaccccg

SEQ ID NO: 88236 - DNA, 585 bp, Homo sapiens
  misc_feature: GYAE6OF01EXHOA.33.28.C06.1.454.CMB.1.raw
tcagtacacacactcacgaccggtgctcgatttagagctcacgtattgggtttgggggagctctggggagtctgcaccatggcttggatcccactcctcttcctcaccctcctcctccactgcacagggtctctctcccagcttgtgctgactacaatcgccctctgcctctgcctccctgggagcctcggtcaagctcatctgcactctgagcagtgggcacagcaactacgccatcgcatggcatcagcagcagccagagaagggccctcggtacttgataggaaggttaacagtgatggcagccacgaccgaagggggacggactccgtgtacttcgttttcgagggtccagtcgtcgtggggctggagcgtctacctcaccatcctccacgccctaccgtacgtcgtaggaggagtaggacggtctacgaacttacgttacgtcggtacgacgtaccgtcggggctacgttggttagtggttcgggttttacgggacgggtacgggtacctaaggtccgtacggtacccggttcgtacggtccgaaccggacccgaacgggtcccgtccggtaccccccgg

SEQ ID NO: 88237 - DNA, 608 bp, Homo sapiens
  misc_feature: GYAE6OF01EHER0.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccctcccgtgggagcctcggtcaagctcatctgcactctgagcaggtgggcacagcaactaccgccatccgcatcggcatcagcagcagccagacgaacggccctggtactgataggaaggttaacgagtgatggacacgaccaacgacggaaggggacggactcccgtgtacgttcgtttcgacggtccagtcgtcgtgggctggacgcgtaccgtaccgccacctactcctacctcgccctcgagtcgtagacgtagtacgacgtctagtaacttacgttacgtcgtacgtacggtcgtcgggaccttacgttagggttacgttggggttccggtttacgggacgggtacgggtaaccgtaggtccgtacggtacccggttacgtacgggacctacggtacccgaaccggtccttcccggcccccgttaccggg

SEQ ID NO: 88238 - DNA, 712 bp, Homo sapiens
  misc_feature: GYAE6OF01BN1N7.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcagccagagaacggccctggtacttgatagaaggttacagtgatggcagccaacgaccgaagggggacggactcccgtagtacgttcgttttcgacgggttccaggtcgttcggtcggggctaggacggtccggtaccttacccgtaccacccgtaactcccttacccgacggtcccctacccgagttccgtagggaaggtacgtcgggacggtccgttggtaaccttaagtttacgtcggtaccaacgggtacccggtacgggggtaccttaaccggtttagggtttaacgttcggggtttacgggggttttacccggggaccggggtaaacggggtaacccgtaacgggttcccgttaccgggttaaccccgggttacccgggttaacgggttacccggaaccggttacccccggaaacgggttccccgttcccgggtccccccccggtttacccgggg

SEQ ID NO: 88239 - DNA, 615 bp, Homo sapiens
  misc_feature: GYAE6OF01DDDDF.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacggccctcggtactgatagaaggttaacagtgatggcagccaacgacccggaagggggacggactcccgtaggtacgttcggtttttacgacgggttccaggtcgtcgtggggctggacgcgtctaccgtcaccactcctaccacgtcctaccacgtcgtagaggagtagacggcttacgtaacgttacgtttacgtacgttacgtaacggtaaccggtggggtactaacgttgggtttaagtcgggtttacggttttcggggacgggtaacgggtaccgtaaagtccggtacggtacccggttacgtacgggtaccacggtacccgaaggtccgtcccgccccgttaccgg

SEQ ID NO: 88240 - DNA, 677 bp, Homo sapiens
  misc_feature: GYAE6OF01BVR0H.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctggggacgccgtcggtcaacgctcatctgcactctgagcaggtggcacagcaactacgccatcgcagtggcatcagcacgcacgccgaaggacggaaccgggcccgtacggtacttagagtaggtaaaggttaacaggtagagtcggacacgaccaacgaaccgggaacgggggacggactccgtagtacgtttcggttttcgacgggtccaggtccgtcgggtacggggtcgtacggacggtccgtaccttaaccctaccaccctactccctacccgaccgtcccctaccgtacggttcgtaggaacgggtagtcggtacggtctacggtaacttacgttacgtcgtaccgacggtaccggtcggggtacttacggttggttacgttgggtttcgggtttacgggacgggtaacgggtaccgtacggtcggtaccggtacccggtacgtacggtacgaccggtacccggaacggtcccgttcccggccccggttccgg

SEQ ID NO: 88241 - DNA, 623 bp, Homo sapiens
  misc_feature: GYAE6OF01CE00E.33.28.C06.1.454.CMB.1.raw
  modified_base (216)..(216): a, c, t, g, unknown or other
  misc_feature (216)..(216): n is a, c, g, or t
  modified_base (528)..(528): a, c, t, g, unknown or other
  misc_feature (528)..(528): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctcgcctctcgccctcccgtgggacgccgtcggtcaagctcatctgcactcngagcagtggcacgagacaactacgcctatcgcatggcatcagcagcagaccagaggacggccctggtactgatgaaagttacagtgagtgcacgccacgaaccgaagggggtacgcgtaccgtgtacttcgttttacgacggtcgagtcgtcgtgggactggacggctctaccgcgaacctcgtcctaccacgccctccgaaggttcacggaggcttaggacggtctaacggtacttaacttacgtgtaccgaggtaacccggtcgggtacttaacggttgggtttacgttcgggtttcgggtttaccgggnggggtaaccggtacgtaaccggtccggtacggtaccccgtcggttaaccggtaccgaaccggtacccggaaggtccctccgggtccccctccggg

SEQ ID NO: 88242 - DNA, 609 bp, Homo sapiens
  misc_feature: GYAE6OF01EXJOS.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactcgccatcgcatggcatcagcagcagaccaggagaacgggccctcggtacttgatggaaggttaacagtgatggcacgccaacgaccggaaggggacgactccgtagacttcgtttacgaggtccagtctcgtgggctggacgcgtactaccgtccacctactcctaccgacgtcccgtacgtacgtctaggacggtagtcggacgctacgtacttattacgtcgtacgtacggtaccggtgggtactacgttggttacgtgggtttcgggtttaccgggacgggtaacgggtacccgtaacggtccgtacggtacccggttaccgtacgggtaccgaaccggtacccgtaaacggtcccgtcccggtcccccggttaccgg

SEQ ID NO: 88243 - DNA, 658 bp, Homo sapiens
  misc_feature: GYAE6OF01APPPL.33.28.C06.1.454.CMB.1.raw
  modified_base (352)..(352): a, c, t, g, unknown or other
  misc_feature (352)..(352): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactgggtgaagccttcggagaccctgtccctcacctgcactgtctctggtgctccatcagcagaagtctttactactggggctggactccgccacgcccccgagggacgggctggagtggagttgggaatatctattagtaggtggagcagctactaccaacccgtccctanaacgacgtcgacgtccaacctatactaccttagacctaaccgtaccaaacgaaccctacgtttcctaccccgtaggaaacgtccttacggtacccttcgtcggttaccggacccgtcccggacaccggaaccgacgggtccttagttaacttacttacgtcgttacggtaccgtaacggaaccgtaacggtaaccgggggtaggttcgggtaacggttacggttaacggttccgggggaccgtacgggtacccgtcggtaccctacccggttcctaccgtaccgaccgtcccgtacccgaacccgg

SEQ ID NO: 88244 - DNA, 535 bp, Homo sapiens
  misc_feature: GYAE6OF01E092T.33.28.C06.1.454.CMB.1.raw
  modified_base (328)..(328): a, c, t, g, unknown or other
  misc_feature (328)..(328): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (474)..(474): a, c, t, g, unknown or other
  misc_feature (474)..(474): n is a, c, g, or t
  modified_base (522)..(522): a, c, t, g, unknown or other
  misc_feature (522)..(522): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggatggtgaagccttcggagaccctgtccctcacctgcactgtctctggtgctccatcagcagaagtctttactactggggctggactccaccacgcccccgaggggaaggggctgggagtggattgggaatatctattataggtgggancagctactacaacccgtcctcaagagtcgagtcaccatactcctagacacgtccaagaacctagttcctccctgaacnctgaccttcgngtcgacccgccgcacgacaccggctagtactatactgtgcgagacagtaaccggggntcgggagtggtagtcgggacgaggacctcgacgtcctaccgtctaccncacgcctaacccg

SEQ ID NO: 88245 - DNA, 778 bp, Homo sapiens
  misc_feature: GYAE6OF01ED919.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggatggtgaagccttcggagaccctgtccctcaccctgcactgtctcgtggtgctccatcagcagaagtctttactactggggctggatccgccacgcccccgagggagggctggagtggattgggaatagtctattataggtgggatcgagtcctaacgtaaccgaaccccgtcccgtacgaaacggtacgtccggtaacgtaccaaccgtaattaacgttacccgtttaacggaaacccgtaacccggttaacccgtaaaacgtaaacccccgttaacggttttacccgttaccccgttaacggtaaaacggtcctttaaccggtaaaccccttcgttaccgggttacggaacccccgtcccggaacccgaacggaacccgtaacccgggtcgttacggtttaaacgttaacgtttaaccggttggtaccggtaccggtaaaccggaacgtaacgggttaaacccggggggtagttccggggaaagtttacgggtaacggttttaccggggggacccgtaaccggggtaaaccccgttgggtaccccaacccgggttcctacccgttccgaaccgtccccgttcccggaaaccccggg

SEQ ID NO: 88246 - DNA, 664 bp, Homo sapiens
  misc_feature: GYAE6OF01BSWF6.33.28.C06.1.454.CMB.1.raw
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctcgcctcccgtgggacgcctcggtcaagctcatctgcactctgagcaggtggacacagcaactacgccagtcgcagtcggcatcagcagcagccgaggagaacgggcccgtacggtacgttagacgtagaaggttaacgagtagtagtggcacgacgacgaaccggaagggggacgactcccgtagtactttccgtttcgacggtccgngtacgtcggtgggtcgacgcgtacgtaccncgtacctaagtccctaccgtacgtccccgtacgtagtccgtagggacgtagtcggacgtacctagtaacttacgttacgtacgacgtaccggtacggtagggtaccctaaggtttggttaacgtgggtttaccgggtcgggaccggtacggtaaccgtacggtcgttacccgggacgtttacccgggaggttaacccggtccggtaaaccccggacgggttcccttaccccgggtaccccgttccgggttacccc

SEQ ID NO: 88247 - DNA, 572 bp, Homo sapiens
  misc_feature: GYAE6OF01CACEB.33.28.C06.1.454.CMB.1.raw
  modified_base (325)..(325): a, c, t, g, unknown or other
  misc_feature (325)..(325): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (485)..(485): a, c, t, g, unknown or other
  misc_feature (485)..(485): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccggactggtgaagccttcggagaccctgtccctcacctgcactgtctctggtgctccatcagcagaagtctttactacgtgggctggactccgccacgcccccgaggggagggctggagtggattgggaatatctattagtggtgggancagctactacctaacccgtcctacaagagtcgagtccaacatactccgttagacacgtacaagaaccagttccnccctagaacncttcgacctcgtcgtcgacccgccgactacgaccgacggctagtacttattcgtgtgacgagacaggtaaccgggngtacggtagttcgtaagggttcgggaccgaacgggtaccctgggtacccgaccgttcctccctacgaccgccctacccgaacccggg

SEQ ID NO: 88248 - DNA, 174 bp, Homo sapiens
  misc_feature: GYAE6OF01B3NWK.33.28.C06.1.454.CMB.1.raw
tcagtacacacactcacgaccggtgctcgatttagagctcacgtattgggtttggggggaagaggaagactgacggtccccccaggagttcaggtgctgggcacagcggccctgggctgcctggtcaaggactacttccagtgtgtgtactgagcgggctggcaaggcgcatag

SEQ ID NO: 88249 - DNA, 757 bp, Homo sapiens
  misc_feature: GYAE6OF01CJX12.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctcgcctctcgcctccgtgggacgcctcggtcaagctcatctgcactctgagcgaggtggacacgagaccaactaccgaccagtccgcagtcggacactcgagcaagcgacgaccgaggacggacggtcccgtacggtactagtagtacggtaacggtaacgagtgagtacgacgacgaccgaacgaaccgggaaggggacggtaccgtccgtagtacgttaccgtttacggacggtaccgacggtcgtcggtacgggtcgtcggacgtccgtacctacccgtacgtaccctacgtaccctaaccggtactcccgtaccgtacggttcgaggggacgtaacgtcggacggttacgtacggttaactttaacggtttaccggtaccggttaacgacccgggttaaccggggttaccgggtacctttaacgggtttgggtttaccgggttggggttttaccggggtttacgggggaacccggggttacgggtaacccggtaacgggtcccgtaaccgggttacccggttccgggtaaacggtaccgaaccggtaaccccgtaagggtccccctcccgggttcccccggttacccgg

SEQ ID NO: 88250 - DNA, 658 bp, Homo sapiens
  misc_feature: GYAE6OF01C3NVU.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtgggcacagcaactacgccatcgcatggcatcagcagcagccagacggaacggccctcggtacttgataggaaggttaacagtgatggcagcccacgaccggaagggggacggactcccgtgtacgtttcggttttacgacgggtccagtcgtcggtggggctggacgccgtacctacctaccacctactcctccacgtccctccgtagttcgaggtaggagtaggacggtcttcggtaacttacgttacgtcggttaccgacggtacccggtcggggtacgttacgttagggtttacgtttgggttttcggggtttcggggaccggggtaacgggtaacccgtaacgggtcccgttacgggtaaccccggttcccggtaacgggttaccgtaacccgggacccgtaacgggtcccgtaccccggtccccccggttacccgg

SEQ ID NO: 88251 - DNA, 132 bp, Homo sapiens
  misc_feature: GYAE6OF01A3F62.33.28.C06.1.454.CMB.1.raw
  modified_base (130)..(132): a, c, t, g, unknown or other
  misc_feature (130)..(132): n is a, c, g, or t
tcagtacacacactcacgaccggtgctcgatttagagctcacgtattgggtttgggcacagcggccctgggctgcctggtcaaggactacttccagtgtgtgtactgagcgggctggcaaggcgcatagnnn

SEQ ID NO: 88252 - DNA, 662 bp, Homo sapiens
  misc_feature: GYAE6OF01BHCJM.33.28.C06.1.454.CMB.1.raw
tcagtacacacactcacgaccggtgctcgatttagagctcacgtattggggtttgggggagctctgggggagtctgcaccatggcttggaccccactcctcttcctcaccctcctcctccactgcacagggtctctctcccagcttgtgctgactcaatcgccctctgcctctgccctccctgggacgcctcggtcaagctcatctgcactctgagcagtgggcacagcaactacgcatcgcatggcatcagcagcagccagaggaacggccctggtactgagtaggaaggttaacagtgagtggcacgccaacgaaccggaaggggacggactcccgtgtacgtttaccggttttacgacgggttccaggtccgttcggtggggtctaggacggtccgccgttaccctaccgaacctcttccctacccgaacgtccctaccgtagtccgtaggaggtacgtacggtacggtcgttacgtaaccttagttacgtcgtaccgtaacggtacccggttggggtaccttacggttagggtttagttcggggtttcgggtttcggggacggggtaaccgggtaaccgtacggttccgtacgggtacccggtaccgttacgggacgtaccggtacccgaaggtcccgtcccggtcccccgtacccgg

SEQ ID NO: 88253 - DNA, 644 bp, Homo sapiens
  misc_feature: GYAE6OF01D26SX.33.28.C06.1.454.CMB.1.raw
  modified_base (186)..(186): a, c, t, g, unknown or other
  misc_feature (186)..(186): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccctccctgggacncctcggtcaagctcatctgcactctgagcaggtggcacagccaaactacgccatccgcatggcatcagcagcagccagaggaacggccctggtactgatagaagttacagtgatgacagccaacgaccggaaggggacgactccgtagtacttcggtttacgacgggtccagtcgtcggtcgggctaggacgtcgtacctaccgtccaacctacgtcctacccgaacggtccctaccgtagttccgtaggacggtagtacggtacggtctacggtaactttaacgttacgtcggtaaccgtacggtaccggttggggtaccttacggttagggttacgttcgggttacgggtttaccggggcgggtaaacgggtacccgtacggtacgtaccggtacccgttaccggtacggtacccgacggtacccgtaacggtcccgtccgtcccccggttaccgg

SEQ ID NO: 88254 - DNA, 772 bp, Homo sapiens
  misc_feature: GYAE6OF01BKZ79.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctcgcctctcgccctccgtgggacgccgtcggtcaagctcatctgcctactctgacgcgaggtcgggacaacgacgacaaccgtacgccagtcgcaagtggacatcgagcagcacgacgaaggaacggaaccgggtcccgttacggtacgttagtaagtacggtaaacggttaacgaggtagtagtcggacacggaccgaacgaacgggaacgggggacgtacgtaccgtagtacgtttcggtttacgcggtcgagtcgtcgggtcgggtacgcggacggtccgtacctaccgtccgtaactccgtacccgtaccgtacccgttcccgtaccgtaacgggttcccgaggggtaacggttacgttacggggaacgtacccgtttaaggtaacccgttttaaccgttacggttccgtaaccgggaccgggttaccggtcggggtaacctttacgggtttggggttaacgtttcggggtttacggggtttacccggggagggtaaacccgggttacgaacgggtttccggaaccggttacccggcgggttaacggaacccgtaccggaacccggttaccggtcccggttaccccgtccccggttaacccgg

SEQ ID NO: 88255 - DNA, 708 bp, Homo sapiens
  misc_feature: GYAE6OF01EVFW0.33.28.C06.1.454.CMB.1.raw
  modified_base (187)..(187): a, c, t, g, unknown or other
  misc_feature (187)..(187): n is a, c, g, or t
tcagtacacacactcacgaccggtgctcgatttagagctcacgtattgggtttgggggagctctggggagtctgcaccatggcttggaccccactcctcttcctcaccctcctcctccactgcacaggtctctctcccagcttgtgctgactcaatccgccctctgcctctgccctcccgtgggacncctcggtcaagcctcatctgcactctgacgcaggtggcacagacaactacgccatcgcatggacatcagcagcacgccgaagaggaacgggtcccgtacggttaccttaggacgtaggtaaaggttaacgtaggtagtacgtaggaccgaacggaccaaccgaacgggaaacgggggacggtaactcccgtagtacgtttcgttttaccggacggtcgaacgtcgttcgggtacggggtctggtacgcgtaccgttacctaccgtaacctacgttccctacccgtacgtaccccgttaccgtacggttaccgtaggaacgggtactagggtaacggtccgttaacggtaaccgtttaacgtacgttacgtaaccgacggtaccggtcggggtactacgtttgggtttacgtgggtttacgggttccgggacggtaccgggtaccgtaaggacgttaccggtccggtacggttacggaccgtaaccgtacccggaaggtcccgttcccggccccgttaccgg

SEQ ID NO: 88256 - DNA, 624 bp, Homo sapiens
  misc_feature: GYAE6OF01A0N1Y.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcagtggcatcagcagcagcagaggaacggccctacggtactgataggaagttacagtgatggcacgccacgacggaaggggacgactccgtagtacgttcgtttacgacggtccagtctacggtgggcgtggacgtcgacctaccgtcaccctacttccgtacccacggtaccctacgacgtccgtacggaacggtactacgggacggttccgtagtaaccttagttaccgtcggttaccgaacggtacccggttagggggaccttacggtttagggttagttcgggttacgggtttcgggacggtaacgggacccgtaggtccgtacggtacccggtacgtacggtaccgaccgtacccgaacggtcctcccggtcccccgtcgg

SEQ ID NO: 88257 - DNA, 762 bp, Homo sapiens
  misc_feature: GYAE6OF01DPIQT.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaacgccttcgggagaccctgtccctcacctgcactgtctcgtggtcgctccatccgagcagtagtctttactacgtgggctggactccgaccacgacccccgaggggaacgggcgtgggagtggagttagggaatattacgtagttagtaggtggggagacgagtacctaaccgtaaccgtaacccccgttccctaacgaagtacggtaccgtaacgtccctaaaccctagttaacgttacccttaacggaaccctaaccggttacccaaaacggtaaaccctaccggttttaccctccccgttaacgaaacgtccgttaacgaaccccttcgtcggtaccggaccccgacccggccaacggacccgtacgggtcttacgttaaattactttaacgttagggtcgaccggtaaggaacccgtacggtaaaccggggggaagttaccgggaggtttacgggtaacgggtttacccggggggacccgaaccggggttaaaccccgtcggggttaccctaaccccggggtttcccttacccgtaccgacccgtccccttaccccgggaaaaccccggg

SEQ ID NO: 88258 - DNA, 729 bp, Homo sapiens
  misc_feature: GYAE6OF01C7MAJ.33.28.C06.1.454.CMB.1.raw
tcagtacacacactcacgaccggtgctcgatttagagctcacgtattgggtttgggggagctctggggagtctcgcaccatggcttggaccccactcctcttcctcaccctcctcctccactgcacagggtctctctcccagcttgtgctgactcaatcgccctctgcctctgccctcccgtgggacgcctcggtcaagctcatctgcactctgagcagtggcacagcaactacgccatcgcagtggacatcagcagcagcaagaggaacggccgttacggtacttagacgtaggaaacggttaacgagtacgagtcggacacgacccgaacgaaccgggaagggggacggtacgtacccgtagtacgtttcggtttttacgacgggttccagtcgtacggtcggggctaggacgccggtactacccgtacaccgtactcctaccgaacgtccctaaccgtacggtcgtacgggaacggttacgtacgggacggtaccttaggtaacctttaacgtttacggtacgttacccggaacggtacccggttacggggacttaacggtttacgggtttacggttcgggttttacggggttttccggggaccggggtaacgggtaaccgtaacgggtccggttacccggtaacccggttaccgggtaaggttacccgaaccgggtaaccccggaacgggttccccgtcccgggttacccccccggttaaccggg

SEQ ID NO: 88259 - DNA, 629 bp, Homo sapiens
  misc_feature: GYAE6OF01AJER3.33.28.C06.1.454.CMB.1.raw
tcagtacacacactcacgaccggtgctcgatttagagctcacgtattggggtttgggggagctctggggagtctgcaccatggcttggaccccactcctcttcctcaccctcctcctccactgcacagggtctctctcccagcttgtgctgactcaatcgccctctgcctctgcctccctggggagcctcggtcaagctcatctgcactctgagcagtgggcacagcaactcgccatcgcatggcatcagcagcacgccaggaggaacgggccctcggtacttagatagtaaggttaacgagtgagtcggcacgaccaccgaaccggaagggggacggactccgtaggtacgttcggttttacgacggtccaggtcctacggtcgggctggacgtccgacctacctccacctactcctaccacgtaccctccgtacgtcgtagggacggtactggacggtctacgtacttaagttcgtgtaccgtacggtaccggttgggtaccttacggtttaggttacggttgggtttacgggtttcgggacgggtaacgggtaccgaggtccggtacggtaccgtaccggtaggtaccgaccggacccgaacggtcccgtcccggccccgttacgg

SEQ ID NO: 88260 - DNA, 731 bp, Homo sapiens
  misc_feature: GYAE6OF01EKGSH.33.28.C06.1.454.CMB.1.raw
  modified_base (136)..(136): a, c, t, g, unknown or other
  misc_feature (136)..(136): n is a, c, g, or t
  modified_base (640)..(640): a, c, t, g, unknown or other
  misc_feature (640)..(640): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtgcgctccagntggtcctgtcccagctgcagctgcgaggcgtccggggcccggatgggtagaacgtccgttcggacgtacccgttcgtcccctacacctgcctactcgttctcgtggtcgtctccatcacgacgtagtaacgttcctttacgtacggtcgggtcctacggaccgtcccgaccggaacccggtcccccgggaagggggtacgggtccgtagggacggttggtacgttagggtaacttagttcgttaagtttaggtaagggtgggacacgtacgtaccgttaacctaacccgtaaccccgttaccaacgtaacggtacgtaccgaacgttaccaactacgttacttaccgttaacgacctaaccgtaccaaacgtaccttacgttaccctaccgtagtaactcgttacgacccttcgtacgtcccgacccgtccgacgacggacgtaccgtcttaagttaacgttacgttacgtggtacgaccgaacgtaacggtacgtaccggggngttacgggtacgttaggtacggtcgggaccggaccggtccgttcgtaccccgtaccggtctacccgacgtcccgtacccgtaccgaaccgg

SEQ ID NO: 88261 - DNA, 681 bp, Homo sapiens
  misc_feature: GYAE6OF01B588Y.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatggtcctgtcccagctgcagctgcaggagtccgggcccgggactgggtgaacgccttcggacgtaccctgtccctcacctgccactgtctcgtggtcgactccatcgagcagtaagttctttacgtacgtgggctggactccgccacggcccccgaggggacggcgtggagtggagttggaatatactattagtaggtggacgcgtacgtactaaccgtaaccgtaaccccgtccctacgaacgacgtacgacgtaccaacctactaactccttaagacctaccgtaccaaacgtaacctacgttaccctccgtagaacgtcgtacgtaacccgttcgttacgtaccggacccgaccgacgaacgtacccgacggtccttagtaacttacgttacgtggtacgacgaagaccgtaacggtaaccggggtagtacgggtagttacgggttacggtacggggacccgtaacggggtaaccccgttcggtacccgtaacccggttcctacccgtacgacccgtaccccgtcccgtaaaccccggg

SEQ ID NO: 88262 - DNA, 615 bp, Homo sapiens
  misc_feature: GYAE6OF01EI6QF.33.28.C06.1.454.CMB.1.raw
  modified_base (248)..(248): a, c, t, g, unknown or other
  misc_feature (248)..(248): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtggcacagcaactacgccatcgcatggcatcngcagcagccagagaacggccctcggtacttgataggaaaggttaacagtgagtggcacgccaacgaccggaaggggacggactccgtagacttcgttttcgacggtccagtcgtcggtgggcgtgacgccgtactaccctcaccctactcctccgacgtcctcctacgtcgtaggaggtagtggacggtctagtacttacgttacgtcgtaccgacggtaccggtaggggtaccgtacggttggttacggttgggtttcgggtttccgggacgggtacgggtaaccgtaacggttccgtacgggtccgttaccggttacggtaccgtaccggaacccgaacggtccgtcccgtccccggtacccggg

SEQ ID NO: 88263 - DNA, 817 bp, Homo sapiens
  misc_feature: GYAE6OF01CZBUO.33.28.C06.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
tcagtacacacactcacgaccggtgctcgatttagagctcacgtattggggtttgggggagctctggggagtctgcaccatggcttggaccccactcctcttcctcacccctcctcctccactgcacgagggtctctctcccagtcttgtgctgactcaactccgccctctcgccctctcgccctcccgtgggcgccgtcggtcaacgctacatcngcactcgngacgcgaggtcgggaccaacgacgacctaaaaccgtaccggaccaacttccggactaagtcgggacctaactacgaacggacaacggaccaacggaccccgaaaggaaccgggtaaaccgggggccccttacgggttaaaccgtttaggaacgtaagggtaaaacggttaaacgtaggtacggtaggtacggaacgaaccggacccaaacgggaaaccggggtaaggggggaaccggtacgtaccccgtaagttacggtttccggttttaggaaccgggttaccaacggtcggttcgggtagggtccgtagggacggccgttacctaaccgtacccgaaccttaccgtcctaacccgtaccgtccccttaacgacggttaccgagggtaggtacgtaggacgtacgttacggtaacttaacgttacgtaacgtacggtaaccggtacgggtcgggtaccgttaggttagggttacggttacgggtttcgggttaccggggacgggtaaccggtaaccggacgttcggtaccgtaccggttacgaccgtacgacccggtaaccgtccggtccctccccgggtcccccgttacgg

SEQ ID NO: 88264 - DNA, 752 bp, Homo sapiens
  misc_feature: GYAE6OF01AIYNI.33.28.C06.1.454.CMB.1.raw
tcagtacacacactcacgaccggtgctcgatttagagctcacgtattgggtttgggggagctctggggagtctgcaccatggcttggacccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacggccctcggtacttgatagtaaaggttacaggtgagtggcacgaccacgaaccggaacgggggtacggacgtcccgtagtacttccggtttttacgaccgggtcctaggtcccgttccggttcgggggtccttacgggaaccggtccggtacccttaaccccgttacccgaacccgtaaccttacccgtaccccgtaacccgtccccgtacccgtaacggttccgacgggtaacggtaggtacggtacggtaccttacgtaaccgtttaacgttaccggttaccggtaccgtaacggttacccgggttacggggtacccttacggtttacgggtttagttcggggttttacggggtttccggggaccggggtaaccgggtaaccggaaccgggtcccggttacgggtcccgttaccgggtaaccgggtaccgtacccgggtaccccggaacgggtccccgttccccggtccccccggttacccggg

SEQ ID NO: 88265 - DNA, 632 bp, Homo sapiens
  misc_feature: GYAE6OF01DGWJ9.33.28.C06.1.454.CMB.1.raw
  modified_base (189)..(189): a, c, t, g, unknown or other
  misc_feature (189)..(189): n is a, c, g, or t
  modified_base (301)..(301): a, c, t, g, unknown or other
  misc_feature (301)..(301): n is a, c, g, or t
tcagtacacacactcacgaccggtgctcgatttagagctcacgtattgggtttggggggagctctggggagtctgcaccatggcttggaccccactcctcttcctcaccctcctcctccactgcacagggtctctctcccagcttgtgctgactcaatcgccctctcgcctctgccctcccgtgggacncctcggtcaagctcatctgcactctgagcaggtgggcacagcaacgtacgccatcgcagtggcatcagcagcagccagaggacggccctcggtactgagtagaaggttaacngtgagtggcacgaccaacgaccggaaggggacggactccgtagtacttcgttttcgacgggtcagtcgtcggtcgggcgtgcgaccgtactacctccacctacgtctcccgagtccctcgtaacgtcgtaggagtagtacggagtacttcgtacgtttacttacgtcgttacggaccggtaccgggtggggtaccttacggttaggtttacggttggggtttccgggtttacgggacggggtacggaaccgtacgggtcgttacgggtacccgttcggtacggtacgaaccggtacccggtacgggttccgtcccggtaccccgttccggg

SEQ ID NO: 88266 - DNA, 644 bp, Homo sapiens
  misc_feature: GYAE6OF01EPX5O.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctcccgtgggagcctcggtcaagctcatctgcactctgagcagtgggcacagcaactacgccatcgcatggcatcagcagcacgaccgaggaggaaccgggtcccgtcggtaacttgagtaggtaaacggttaacagtgagtggacacgaccgaacgaccggaagggggaccggactccgtagtacgttcggtttacgacggtcacgtcgtcggtgggctggacgccgtactacctcaacctctcctccgacgtccctacgtaggtcctagggacggtagtggacggtcctagtaacctttagttacgtgtaccgacggtaccgggttcggggacttacggttagggttacgttcgggtttcggggtttacgggaccgggtacggtaaccgtaaggtcccgtacggtacccggttcgttacggtaccgaccgggacccgtaacggtcccgtcccggtcccccgttaccggg

SEQ ID NO: 88267 - DNA, 792 bp, Homo sapiens
  misc_feature: GYAE6OF01C835F.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttccttcctcctgctggtggcggctccagatgggtcctgtcccagctgcagctgcaggacgccgggcccggatggtagaacgtccttcgggacgaccctcgtccctcacctgctacgtgtcctcgtgggtcgcctcatcacgacaagtacgttctttacgtacggtcgggtctaggtactccgaccgaccggcccccggaggggaacggggtcgtaggtaggtacgggtagttaggggaaacttacgttacgttaagtttaacggttagggtacgggacggtacgacggtaccgtaacctaacccgtaaccccggttaccctaacgtaaacggacgttacgaacgtacctaacctactaaacgttaccgttaacgaaccgtaaccgttaaccgaaacgtaacccgttaccgttaccttacccgtacggtaaacgtcgtaccgtaacccttcgtacgtaccggtacccgaccggaccgaacggtaaccggaccggtaccgtttaaggttaactttaaccggtttacgtcgggtacgtaaccggaacgtaaccggtaaccgggttaaaccggggtacggtacgggtacggtttaggtaacggggttacggacccggtaacgggtaacccgtcggtacccgttacccgtcccgttaccacctacccgcccgtcccggaaacccggg

SEQ ID NO: 88268 - DNA, 766 bp, Homo sapiens
  misc_feature: GYAE6OF01A4RSC.33.28.C06.1.454.CMB.1.raw
  modified_base (189)..(189): a, c, t, g, unknown or other
  misc_feature (189)..(189): n is a, c, g, or t
tcagtacacacactcacgaccggtgctcgatttagagctcacgtattgggtttgggggagctctggggagtctgcaccatggcttgggaccccactcctcttcctcaccctcctcctccactgcacagggtctctctcccagcttgtgctgactcaatcgccctctcgcctctcgccctccgtgggacnccgtcggtcaagcctacactctcgccactcgtgacgctaggtcgggaccacgacgaccaaccgtaccgccagttccgactacgtcggactacgtcgacgacgacgaccgacggaccgaacggacggtaccgggtcccgttacggttacgtacggtacggtaacggtaacggtacgtaggtacgtacgtcggacaccggaccgaacggaaccgggaacggggtaccgtaccgtccggtacggttacgtttaccggttacggaccggtaccgtacggtccggtcgggtcggtacgtacggtaccgtccgtacctaccgtaccgtaccgtcgttacccgtaccgtacccgtccgtaccggtacgtaccgtacgggtacggtacgtacggtaccgtacgttaacgttacttacgttaccgtcgtaccggtaccgggtaccggtaccggtaccgttaggttcggttacggttcgggtttaccgggtacgggacgggtaaccggacgtccggttaccggtaccggtaccggtaccgtacggacccgtaccggtaccggaccggtcccgtcccggtcccgtacg

SEQ ID NO: 88269 - DNA, 720 bp, Homo sapiens
  misc_feature: GYAE6OF01CEQO1.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagagtgggtcctgtcccagctgcagctgcgagggaggtccgggacccgggactgggtagaacgtccgttcggacgtacccctcgtcccctcgacctgcctactgtctcgtggtcgcctaccatcagcgtaagtaacgttctttacgtacggtcgggctaggtacctacccaccgaccggacccccggagggggaacgggtcgtagggaggtggtagttagggaattattacgttaagttagtagggtaggacgtacgacgtactaacctaacccgaacccgtcctagaaggtacgtacgagtaccactatacctacgttaacgacctaaccgtaacccaagtaacccttcgtttaccacccgttaagaacctcgttcccgtacttccgtacggtaccgacccgccgaacgtacgaccgacggtacttagttaacgtttactccgtggtacggtacgaacgggtacgtaacgggtaccggggtaggtacggtggtacggttagggtcccgggaacggtaacccgggtcgtaccggtaccttaccggtcccttacctaccgaccgtcccgtaaccggtaacccggg

SEQ ID NO: 88270 - DNA, 679 bp, Homo sapiens
  misc_feature: GYAE6OF01BLOJ7.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcagccagagaacggccctcggtacttgagtgaaggttaacaggtgagtggcacgcccaacgaccggaagggggacggacgtcccgtgtacgttcgttttacgacgggtcctagccgtacggtcggggtactgggacgtccgtaccttacctaccgaccctactcccgtacccgacgtcccctaccgtacgtccgtagggtacggtacgtacggtacggccgttacgttaaccgtttaacgtttacgttacggtaccgtacgggtacccgggttacggggtaccttaacgggtttggtttacgtttgggtttccggggttttaccgggacgggtaacgggtaaccgacggttccgtaccgggttaccccgttacggtacggtaccacgggtaccccgtaacgggtccctcccggtcccccggttaccgg

SEQ ID NO: 88271 - DNA, 684 bp, Homo sapiens
  misc_feature: GYAE6OF01CSTBU.33.28.C06.1.454.CMB.1.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
tcagtacacacactcacgaccggtgctcgatttagagctcacgtattggggtttgggggagctcgtggggagtctgcaccatggcttcggacccactcctctcctcaccctcctcctccactcgcacaggtctctctccagcttgtcgctgactcaatccgccctctgcctctcgcctccgtgggacnccgttcggacaacgctcatctncactcngacgcgaggcggacagacgtcaaacgtacgccatcgnagtggacatcagacagacagacacgagacgcctagacttagatagaagtaacagtagagtcgacagaccaacgaacggaaggggcgtactccgtagtacgttcgtttagacggtccaggtaccttcggcggtcgtacggacgcctacgtacctaccgtactacgttcccacgacgtcccgtaacgaacgtcgtacggaaggtacgtacgggtagtacgtacgtaacttaacgttccgtaaacggcggtaaccggtaccgggtagggaccgttaccggttaagggtttacttcgggtttacggggtttaccggacgggtaacgggtaaccgaacgggtacccgttacggtaaccccggttaccggtaacggtaaaccgtcccggggtaaaacctcccggggtaaccctccccgggtccccgtttaacccggg

SEQ ID NO: 88272 - DNA, 771 bp, Homo sapiens
  misc_feature: GYAE6OF01AFV3Z.33.28.C06.1.454.CMB.1.raw
  modified_base (188)..(188): a, c, t, g, unknown or other
  misc_feature (188)..(188): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctgcctctgccctcccgtgggacnccgtcggtcaagctcatctgcactctgacgcaggtgggccacgagcaactaccgccatcgacagtcggccagtcagcagcgacgaccgaggtacggaacggtccctacggtacgttgagttaggaaacggttaacgaggtagacgtggacacgcccgaacgaaccggaaggggaccggtaacgtcccgtagtacttcggttttacgacgggtaccaggtcgtcgggtagggtctaggacggtcccgtaccgttaccctactaaccgtctaccccgtaccgaacccggtccccgtaccgtacggttaccgtacgggtaacggtaacggtaccgggacggtaccttagggtaacctttaacgtttacgttacggtaaccgacgggttacccgggttacggggtaccttaacggtttacgggtttacggttacggggttttcgggggtttaccggggaccgggtaaccggggtaaacccgtcgggttaaccggtaccgggttacccggttacccggttaaccgggtacccgtaaccggggaccccgtaacggggttcccctccccgggttcccccggttacccggg

SEQ ID NO: 88273 - DNA, 979 bp, Homo sapiens
  misc_feature: GYAE6OF01ASC38.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacgagggtctctctccagtcttgtgctgactcaatccgccctctcgcctctcgccctccgtgggacgtccgtcggtacaacgctcactcgtgctactcgtgagcgaggtcgggacaacgacgacctaaaccgtaccgaccgtaacgttccggacaaggttcgggacctaactccgaacgccgaacggccgaacggaccgaaggggaaacgggaacccgggggtacccccgttaccggggtttaaccgtttaaggtaacgttaaagggttaaaacgggttttaaacgtaagggttaggtaacggttacggggaccgaaccggaccccgaaaccgggaaaacccgggggaaacgggggggggtaaccgggtaaccgtttaccccggttacgggtttacgtttttacccggggttttttacggaacgggggttaccgaaacggtccggtttacgggttacgggggtacggttacggggaaccggtacccggtacccgttaacccgtacccgtaaccgttaccgttacccgtacccgaacccgttaccccgttaccgtaccggtttacggtacgggaaacggggtttagtacggggtaccggtacgttaacggttaacctttaacgtttaacgggttccgttaaccggtaaccgggtacccggggttaggggtacccgtttacgggttttacgggttacgggttttcgggggttttcggggtttaccggggaaccggggtaaccggggtaaccgtaaccggttccgggttaaccggtaccccgggttaccggttaccgggttacccgaaccgggtacccggtaaccgggtccccgttccccggttcccccggttacccgg

SEQ ID NO: 88274 - DNA, 693 bp, Homo sapiens
  misc_feature: GYAE6OF01DZLE7.33.28.C06.1.454.CMB.1.raw
  modified_base (191)..(191): a, c, t, g, unknown or other
  misc_feature (191)..(191): n is a, c, g, or t
tcagtacacacactcacgaccggtgctcgatttagagctcacgtattgggtttggggggagctctggggagtctgcaccatggcttggaccccactcctcttcctcaccctcctcctccactgcacagggtctctctcccagcttgtgctgactcaatccgccctctcgcctctcgccctcccgtgggacnccgtcggtcaagtctcatctgcctactctgacgccgtaggtcgggacacgacgaccaactacgaccagtcgacagtcggactactacgacgcgacgacgacgaccgaaggaacgggaccgggtcccgttacggtacgttagtagtaaggtaaaggtaacgaggtagagtcggacgacgaccgaacgaaccgggaacggggaccgacgtccgtagtacgttcggtttacgacggtcgacgtcgtacggtcgggctacggacggtcctaccgtaccctacgaccgtctacctacccgacgtacctacgtagtacgtagggacgtagcggtacgtctaacgtactttacgtacgtcgtacgtacggtacggtacgggaccttagggtttaggttacgggtttcgggtttacggggttacgggaccggtaagggtaccgtacggtcgtaccgtcccggtagtaaccggtcgaccggaaccgtacggtccctcccggtcccctacgg

SEQ ID NO: 88275 - DNA, 921 bp, Homo sapiens
  misc_feature: GYAE6OF01B18VV.33.28.C06.1.454.CMB.1.raw
  modified_base (218)..(218): a, c, t, g, unknown or other
  misc_feature (218)..(218): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctcgcctctcgccctccgtgggacgcctcggtcaagctcatcctgcactctgancgaggtggacacgacgacaaccgtacgccatccgacagtcggctaactcgacgaccgaacgaccgaacgacccgaaggaaccgggaaccggggtccccgttacgggttaccgttaaggaacgttaacgggtaaaacgggtttaaacgaggttagaagtacgggaccgaaccggacccaaccggaaacccggggaaaccggggggaccggtaccgttaccccggtaggttacgttttacggttttaccggacgggttaccgtaacggtcccgtacgggttcggggacgtacgggtaccggtaccgtacccttaacccgttacccgtaacctaccgttaaccccgtacccgtaacccggtaccccgttacccggtaacgttacccggtaggtaacgggttacggtacgggtaccggtaccgttaccgttaaccgtttaaccgtttacggtacggttaccgtaacccggtacccggggttacgggttaccgttaacggtttacgggttttaacgggtttcgggggttttaccggggttttacgggggaaacggggttaacccgggtaaaacccgggttacggttaacccgggttacccggggttaccccgggttaacccgtttaccggggtaaaccccgtacccgggtacccccgggtaaccgggttcccccggttcccccgggttaccccccggtttaccccggg

SEQ ID NO: 88276 - DNA, 657 bp, Homo sapiens
  misc_feature: GYAE6OF01CY6XU.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctcgcctctcgccctcccgtgggacgccgtcggtcaagcctcatctcgcactctgagcaggtggcacgagaccaactaccgccagtcgcagtggacatcagcagcacgaccgaaggacggaaccggcccgttacggtaccgttagagtaaggtaaacggtaacgtaggtagagtggacacgccgaaccgaacgggaacggggacgtactccgtagtacgtttcgtttcgacggtcgagtccgtacgggtcggcgtgaccgtccgtacctaccctacgacccttaccgtccctacccgccgtacctaccgtaccggtgtacgggtaaggacgtcggacggtacttaacggtactttaacgtcgttcgtacgaccggtacggtgggtaccctaggtttggttacgtcgggtttacgggttcgggacgggtacggactcgcggttacgccggtcgtacgacggtaccgacccggagtcccgtcccgtcccgtaccgg

SEQ ID NO: 88277 - DNA, 700 bp, Homo sapiens
  misc_feature: GYAE6OF01EFT5N.33.28.C06.1.454.CMB.1.raw
  modified_base (169)..(169): a, c, t, g, unknown or other
  misc_feature (169)..(169): n is a, c, g, or t
  modified_base (192)..(192): a, c, t, g, unknown or other
  misc_feature (192)..(192): n is a, c, g, or t
tcagtacacacactcacgaccggtgctcgatttagagctcacgtattggggtttggggggagctctggggagtctgcaccatggcttggacccccactcctcttcctcacccctcctcctccactgcacagggtctctctcccagcttgtgctgactcaatccgccctntgcctctgccctcccgtggggancctgggtcaagctcatcgtgcactctgagcagtgggcacagcaacgtacgccatcgcatggcatcagcagcagccagaggacggccctcggtactgagtaggaaggttaacaggtgagtggacacgaccaacgacggtaagggggacggacttaccctaggtactttccggttttacgacgggttaccaggtcgtcgggtcggggtacctacggtacgtacccggtaccttaacccgtacctaaccgtacgtaccttacccgacgtacccgtacccgtaggttaccggttaggaacgggtatacgggacggtacctaggttaaccttagttacgacgttacgaacggtaccggttaggggtacctaacgtttgggttacgttcggtttacggggtttaccggggaccgggttaaacgggaaccgtaacgggtctaacccgggtaccgttacccggtaacgaccggtaaccggacccggaaccgggtccgtcccgtccccccggtacgg

SEQ ID NO: 88278 - DNA, 684 bp, Homo sapiens
  misc_feature: GYAE6OF01CJIVJ.33.28.C06.1.454.CMB.1.raw
  modified_base (247)..(247): a, c, t, g, unknown or other
  misc_feature (247)..(247): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctcgcctctcgccctcccgtgggacgcctcggtcaagctcatctgcactctgagcaggtggcacagaccaactcgccatcganagtcggcatcacgcgagacacgaccgaggacggaacgggccctacggttacttagacgtaggtaaacggttaacaggtagagtcgggacacggaccaacgaaccgggaaggggaccggtactccgtagtacgttcgttttcgacggtacacgtcgtcgtgggctggcgtcgtacctacctacgacctactcctaccgaccgtcctaccgtagtcgtacggtaggtagtacgggacgtcgtacgtacgttaactttacgtaccggtacgtaccggtaccgggtcgggtacttacgggtttacgggtttggttacgggttccggggtttaccgggacgggtaacgggtaccgtaacggttcggtaccggtccccgttacgggtacgtaaccggtccgaacccggtacgggtacccttccccgggtacccgttaccccgg

SEQ ID NO: 88279 - DNA, 690 bp, Homo sapiens
  misc_feature: GYAE6OF01C3GPG.33.28.C06.1.454.CMB.1.raw
  modified_base (172)..(172): a, c, t, g, unknown or other
  misc_feature (172)..(172): n is a, c, g, or t
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
tcagtacacacactcacgaccggtgctcgatttagagctcacgtattggggtttgggggagctcgtggggagtctgcaccatggcttaggaccccactcctcttcctcacccctcctcctccactgcacgaggtctctctcccagtcttgtgctagactcaatccgcccctntgccctctcgccctccggagggactccgtcggtacaacgtcctacattcgcactacctgngaacgtcgtaggcggaccacgagacctaaacnccgaccagtccgatagtggaactgtacacgacaaggctacgacgtaaggaacggtaaccggccttacggtatagagtaggtaaacgtacgngtgacgtcganacgccgaagtacgggaggtacgtctccgtaggtactttcgttagacgggtccnggtcctgggtcgacgtgacctcgacctaccnccgaacnctacacgcggtccctagtagttacgnggtaanaggtacgtacgtacttacgtaagtacttcgaaggcccgaaggtccggtaggtaccttaggttcggttagttcgggtttaaccgggtacggaacggggtaacgtaaccgtaaccgggttcggttaccggtaccggttacgtaccgggtaacgtaaccccggtaacccgtaaccggtcccggtcccccgttcccggtaaaccg

SEQ ID NO: 88280 - DNA, 750 bp, Homo sapiens
  misc_feature: GYAE6OF01C6Y39.33.28.C06.1.454.CMB.1.raw
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (383)..(383): a, c, t, g, unknown or other
  misc_feature (383)..(383): n is a, c, g, or t
  modified_base (593)..(593): a, c, t, g, unknown or other
  misc_feature (593)..(593): n is a, c, g, or t
tcagtacacacactcacgaccggtgctcgatttagagctcacgtattggggtttgggggagctctgggggagtctgcaccatggcttggaccccactcctcttccctcacccctcctccctccactgcacgagggtctctctcccagtcttgtgctgactcaatccgccctctcgccctctcgccctccgtgggcctccgtcggtacaacgcctacactcgcgcctaactcgtagacgcgtagggtcggaccacgagtaacctaaccgtccnccatccggacaagtcgacctanacgacgacgacggactacgaacgaaagggacgggtaaccccgggtccgtttaacgggtacttaggaaggttaaacggtaacggtaaacngggtagtaggccggacaaccggacccgaaaccggtaacggggggaaggggtacgtcttacccggtagtttaaccggtttcggtttcgaaacgggtcctaggtccggtcgggtacgggcacggtacgacccggttaccaacctactacctcgttacccacgtcccgtaccttgacgttccggaggtagtgtagcgttcgattaactttcgngtacggtacgaccggttcgtagggtactttagttttacggggtttaggccgggtttttacgggaccggggacgtaacggaaccccgagtttcccgggaccgtaaacccggttgtaaccgacgtacccgaccggtacgtcccccgccggttcctacgg

SEQ ID NO: 88281 - DNA, 686 bp, Homo sapiens
  misc_feature: GYAE6OF01CWOLW.33.28.C06.1.454.CMB.1.raw
  modified_base (217)..(217): a, c, t, g, unknown or other
  misc_feature (217)..(217): n is a, c, g, or t
  modified_base (543)..(543): a, c, t, g, unknown or other
  misc_feature (543)..(543): n is a, c, g, or t
tcagtacacacactcacgaccggtgctcgatttagagctcacgtattggggtttgggggagctctggggagtctgcaccatggcttggacccactcctcttcctcaccctcctcctccactcgcacgagggtctctctccagtcttgtgctgactacaactccgcctctcgcctctcgccctccgtagggcgtccgtcggtacacgtctcactcgtnactacgtctagacgcgtaggtcggacacgacgaccaacgtaccgacacgtcgactacgcggacacgtacgacgacgacgaccgacggacgaacggaacggtaccgggtccgttacggtactaggtaacgtaaggtaaacggtaacgtaggtacgtagcggacgaacggaccgaacggaacggggtaacgggacgtcgtacgtacgttacgttacggttacggacggtcgcgtcgtcggcggtcgtagacgcgtacctacaccactactcacgcctcctaggtcgtagacggcgtacggtacgtagtaccttgtaactttgtacggngaaccggttcgacgggtgttacttgggtttacgtacgggttcgggttcgggaaccgggcggtaaacgtacgcgggttcctacgggttaaccgcgttaccggacgcccgggtaaccgtccgggaccttcccgggtcccgttacg

SEQ ID NO: 88282 - DNA, 624 bp, Homo sapiens
  misc_feature: GYAE6OF01DXOCC.33.28.C06.1.454.CMB.1.raw
  modified_base (188)..(188): a, c, t, g, unknown or other
  misc_feature (188)..(188): n is a, c, g, or t
  modified_base (309)..(309): a, c, t, g, unknown or other
  misc_feature (309)..(309): n is a, c, g, or t
tcagtacacacactcacgaccggtgctcgatttagagctcacgtattgggtttgggggagctctggggagtctgcaccatggcttggacccactcctcttcctcaccctcctcctccactgcacagggtctctctcccagcttgtgctgactcaactccgccctctgcctctcgccctccgtgggacncctcggtacaagcctcagttctagcactctgacgcaggtcgggacacagtaccaactaccgccatcgacatggcatcagcagcacgcaaggacgacgccgtagtactagataggaagtacngtgatgcacgcaacgacggaggggacgctccgtgtagttcgtttcgacggtcaggtctcgggagggtctgacggcctacgtacctacaccgtctcctacccgtacgacctccgagtccgagggtacggtactaggacggtacgttacgtaacttagttacgtacggtacgtaccggtaacgggtcgggtacttacggttaggtttacggttcggggtttacggtttcgggaaaccgggtaggaaccgacgttcggtacggtcccggtacgtaccggtaccgaccggtacccgtaaggcccgtcccgcccgttacg

SEQ ID NO: 88283 - DNA, 756 bp, Homo sapiens
  misc_feature: GYAE6OF01BIWH7.33.28.C06.1.454.CMB.1.raw
  modified_base (671)..(671): a, c, t, g, unknown or other
  misc_feature (671)..(671): n is a, c, g, or t
tcagtacacacactcacgaccggtgctcgatttagagctcacgtattgggtttggggatgctttctgagagtcatggatctcatgtgcaagaaactgaagcacctgttggttcttcctcctgctggtggcgctccagatgggtcctgtcccagctgcagctggcgagggacggtccgggccggacgttgggagaacgtccgttcggaccgtacccgttcggtccctcaccgttggcctacgttggttcctcgttcgggtacgccttccactcgaacgtacgtaagttaacgtttccgttttaacgtacggtcggggtcttacgggacgtcccggtaccaccggaccccggaaggggggtacggtcggtagggaggttacgggtaagttagggaattacgttcgtttaagttacgtagggttagggactacgtacgtaccttaaccggtaacctaaccccgtcgaagtaaacggcgtacggaacgtccgaacctagttacgttaaccgtaacgaccgaaccgtaccgtaaacgtcccgtaacgtttccctaccgtaggacttcgtaccgtacctttcgcgtacccgacgccgacgagacccgtaacggtcttaggtaactttagtacggacgtacgacggtaaacgccgtaacggtaccgggaggtacggtnttacggggttacggtaccggggaccttacgggtaaccgtcgtaacccgcccgttacgcctacgtaccgcccttaccggaaaccgg

SEQ ID NO: 88284 - DNA, 840 bp, Homo sapiens
  misc_feature: GYAE6OF01C3UTM.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttccttcctcctgctgggtggcggctcccagatcgggtcctcgtcccagctgcagctgacaggaggtccggggcccggtatgggtgaacgccgtttcggacgtacccctcgtccctcaccgtgaccacgtagtccttcgtggtacgaccttaccaagtaccgtaaggtaactttacctacgtggacgtcgtaggaccgtccggaccgaccggcccccggaggggacggggacgttcgggaggttacgggtagtttaggtttacgtttcgttaccgttttaccgaacgtaggtacggtaacctaaacctaacccgtaaccgtaacccctaacccccttaccctacgaaacgtacgtacgtaccgtaccaaccgactactacgacgtacgaccgaccgtaccgaaacgtaacccgttacgttccctaccgtacgtacttaccctacgttaccgttcgttaccgtccgtacccgtcgtaccgggtacccgtaccgtacccgggtacccttacgttaacgttcggttaggtacccgtaccggaagggttcccgtacccggttaacggtacggtacggttaccggggtttcggggtttaacggtttccccggttttaagtttaccgggtaaacccggtttcgggggtacccggggtacccggtaacccggggttcccgttaccccggttgggttaaccccccgttcgttacccccgttccgttcccgtacccccgg

SEQ ID NO: 88285 - DNA, 990 bp, Homo sapiens
  misc_feature: GYAE6OF01BY7BO.33.28.C06.1.454.CMB.1.raw
  modified_base (165)..(165): a, c, t, g, unknown or other
  misc_feature (165)..(165): n is a, c, g, or t
  modified_base (238)..(238): a, c, t, g, unknown or other
  misc_feature (238)..(238): n is a, c, g, or t
tcagtacacacactcacgaccggtgctcgatttagagctcacgtattgggtttggggggagctctgggggagtctgcaccatggcttggacccactctcttcctcaccctctcctccactgcacgaggtctctctcccagtcttgtgctgactcaatccgccctntcgcctctcgtccctccgtggacgccgtcggtacagctcactctgccactctaggacgcgtaggtcggaccanacgaccaaacgtccggacctagtccgagtacgtcggactaactcgacgacgacgacgacgaacgaaggaacgggacccggtacccgttacggtaacgttggtaacggttaaggtaaaacgggttaactaacggtaggtacggtagggaccgaaccggacccgaaaccgggaaacggggaaaccggggggaccggttaaccgttacccggttaggttaacccggttttcgggttttaaccgggtaccgggttaccggtacggttacccggttaccggggttccggggttaccgtacgggtaccggtcccgggtttaaccccttaacccgttaacccggtaacccgttaccgttaaccccgtaccccggtacccggttacccgttaccccgttacgggtaacccggtaacgggggttaacgggtacggttaacggggtaccggtttaacgttaacgtttaaccggtttaaccgttttaccggtttaaccgggtaacggttaaccccggggttaacccgggttccgggggttaaaccgttttacggggtttttacgggttttaacgggtttccgggggtttttaccggggggtttaaaccggggaccggggttaaaccggggtacccggtaacggtttacccgggttacccgggttaaccccgggttaccgggttaccccggtaaacccgggtaccccgggtaacccggttaacccgggtccccgggttccccccgtcccggggtttaaccccgg

SEQ ID NO: 88286 - DNA, 923 bp, Homo sapiens
  misc_feature: GYAE6OF01AME7A.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacgagggtctctctcccagtcttgtgctgactcaatccgccctctcgccttctccgtcccgtcccggtggggacctcccgttacggtacgaaacgccttacctattccgtcgacctacgtttccgtggaacgtccgtaaggggtcggacccaaccaaacgggtaccctaaacccggttaccgaccctaagttcccggaacctaaggtcggtaccctaacgttacccggaaacggtccgaacggtacccgaacggtaaccccggaaagggtaaccggggaaaccccgggggttccccggtttaccgggttaaccgtttaccggtaaggtaaacggggttaaaacggttaacgtagggtacggtacggtacggacctaaccggaccccgaaacgggaaacccgggggaaccgggggtaaccggtacccggttaccgttaccggtttacgtttacccgggttttacgggaccgggtaccgtaccggtcggttaccggggtacgggtacgttacggaccggtacccggtacccttacccgtaaccgacccgttcgtaccccgtaccgttcccgcccgtacgtaccggtatacgggtagtaggtcggccgttacaccgttaacggttactttaccggcgttaaccggcgggtacgtacggttccggttagtttacggtcggtttaacgggtttccggggtcggaaaccgggtacggtaaccggtcgtaacccgggtccggttacgttccgtaccgggaccgtccggaacccggtacttccccgggtcccggtccgttacccccgg

SEQ ID NO: 88287 - DNA, 899 bp, Homo sapiens
  misc_feature: GYAE6OF01DSB2H.33.28.C06.1.454.CMB.1.raw
  modified_base (148)..(148): a, c, t, g, unknown or other
  misc_feature (148)..(148): n is a, c, g, or t
  modified_base (167)..(167): a, c, t, g, unknown or other
  misc_feature (167)..(167): n is a, c, g, or t
tcagtacacacactcacgaccggtgctcgatttagagctcacgtattgggtttgggggagctctgggggagtctgcaccatggcttggaccccactcctcttcctcacccctcctcctccactgcacagggtctctctcccagcttgngctgactcaatccgccctntcgcctcgtcgccctcccgtagggcgtccgtcggtacaacgcctcatctcgcctacttctggacgcgagggtcgggacaacgacgaccaaaccgtaccgcccacgtcgacaagtcggactagtccgagaccagaccgaacggaccgaaggtaacgggaaccgggtcccgttaacgggtaccttaggaagttaaggtaaacggtttaacgaggtagacgtacggaccaacggaacccgaaccgggtaaccggggaaacgggggtaccggtaccttcccgtaggtttacgtttccggttttaccggacggttacgacggttccggtcgggtacgggtacgtcgggtaccgtaccggtacccttaacccgtaccgtacccgtaaccgttccccgtaaccgttccccgtacccgttaccggttaacgtacccggtagggttaaccggtaacgggtaccgggtacggttacttacccggttaaacgtttaaccttaccgggtacttacccggggaacggggttacccggggttacggggttaccgttaacggtttttcggggttttacggggtttcggggtttttacccgggttttaaccggggaccggggtaaccgggttaaacggaccggttccgggttacccggttaacccggttacccggttaacccgggtaccgtaccccgggtaaccccggtacgggttccccgtacccccgggtcccccggttaacccgg

SEQ ID NO: 88288 - DNA, 767 bp, Homo sapiens
  misc_feature: GYAE6OF01C12KH.33.28.C06.1.454.CMB.1.raw
  modified_base (743)..(743): a, c, t, g, unknown or other
  misc_feature (743)..(743): n is a, c, g, or t
tcagtacacacactcacgaccggtgctcgatttagagctcacgtattgggtttggggatgctttctgagagtcatggatctcatgtgcaaagaaactgaagcacctgtggtttccttcctcctgctggtggcggctcccagatgggtcctgtcccagctgcagctgcgaggaggtccggggcccgggtagtgggtacgaacggtcccgttacgggaaccgtaccccttcggtcccctaccgaccgttcggacctacttcggttcctcgtcgggtcggccttccagtcagactaagtaacgttctttaccgtacggtcggggtctaggactcccgccgaaccggcccccggaggggacggggtccgtgggtaaggtcggtaggttaggtaatacgttacttaagttaggtaggtgggagactacggtacctaaccgtacccgtaaccccgtcctacgaaacggtacggtacgaacgtccaacctagtaccttaccgttaacgaacctaaccgtaccgaaacggtaacccgtaccgtttacccgtaccgacggtaacccgtcgtaccgtaacccttcgtaccggttacccgcccggtaccggacaaccggacccgtacggtacgttacgttaacttaacgttagtcggtacgacgtacgaacgtagggtaaccgggtgtacgggtaggtcgtaacgggtccggggacgtaaccggggtaccgtccggtcgtacccgtctacccgngtaacccgtcccgaccggacccgg

SEQ ID NO: 88289 - DNA, 772 bp, Homo sapiens
  misc_feature: GYAE6OF01BFO5Y.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctcgcctcccgtggggacgccgtcggtacaagctcatcgtcgacctactcgtagacgcgtaggtcgggacacgacggaccaaaccgtaccgcctacgtccgactagtcggacatacgacgcgaagcacgaccgaacggaacgggaaccggtcccgttacggttacgttacggtaagtacgggtaaacggttaacgaggtaggtacgtacgggacgaccgtaccgaacggaaccggggaacgggggaccggtaccgtaccgtaggttaccggtttaccggtttacggaccggttaccgtacggtcgttaccgggtcgggtacgtcggtaaccggtccgtaccttaccctaccgtaacctacgttacccgtcccgacgtacccgttacgtcggttacgacgggtacggtagtcggtaacgtcgttaacgtacctttaagttcgacggtaccgtacggtacgggttacgggtaccttgggttacggtttaggttcgggttttcggggtaccgggacgggtaaccggtaacgtcggttccgtacgggtacccggttagtacccggtacggaccggtacccgaggtcccgttcccgtcccggttaccg

SEQ ID NO: 88290 - DNA, 835 bp, Homo sapiens
  misc_feature: GYAE6OF01CPC9J.33.28.C06.1.454.CMB.1.raw
  modified_base (277)..(277): a, c, t, g, unknown or other
  misc_feature (277)..(277): n is a, c, g, or t
tcagtacacacactcacgaccggtgctcgatttagagctcacgtattgggtttggggatgctttctgagagtcatggatctcatgtgacaaagaaactgaagcaccttgttggttccttcctcctgcgtggtggccggtcctcccagagttcgggtcctcgtcccagctgacagctggcgagggacggtccggggcccggtagtggtacgaacgtccgttacggacgtaccctcgtccctcactcgctacgtgtctcgtggtcgctacagtcacganagtaacgttctttacgtcggtgggcgtcgacgtcccgaccgaccggcccccgggaagggggtacgggtcgtacggggtaggttacgggttaacgttaaggggtaactttacgtttaacgtttaagtttaaggtaggggtaacggggtaaccggacgtaacccggtaacccgttaacccgtaaacccggtaaaccccccgttaccccgtaagaaaccgggtaacgtaccggtaaccgtacctaaacccgtagtttaaaccgttacccgttaacggtaacccgtaaccgtaacccgaaaccggttacccgtacggttttaccccaccggtaagaccttccgtacgtccttcgtacggacccgaccgaccggacacggaccgtccgtattacgttaactaacgttggtagtcggacgtaacgtaaccggtaacggggtaccgggttacgaggggttacgtacgggttacgggggtaccgggaacccgggttaaccggtcccggtcggtaaccctcccggttacctacccgggtacaccctcccggtaccgtaaaccccggg

SEQ ID NO: 88291 - DNA, 720 bp, Homo sapiens
  misc_feature: GYAE6OF01BJ9ZW.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctgcctctgccctcccgtgggacgccgtcggtcaacgctcatcctgccactctgagcaggtgggcacgagaccaactaccgccatcgcatggcatccagcaggcacgccaaggagaacggccctacggtacttgatacggaaggttaacagtcgagtggcagccacgaaccggaaggggcggactccgtagtacttcgtttacgaggtccagtcgtcggtcgggctcggacgaccgtacctacccgtaccgtaccgcttcccgtacccgtaccgtaccctaccgtacgtccgtaggtacggtacgtacggtacggtccgttacgttaacctttaacgtttacgtcggttaaccgaccggttacccgggtacgggttaccttaacgggtttcgggtttaacggtttggggtttccggggtttaccggggacggggtaaaccgggttaacccgtaacgggttcccgttaccgggggtaacccgttaccgggttacggtacccgtaccggaccccggtaaccgggtcccgttaaccccggtccccccgttaaccccggg

SEQ ID NO: 88292 - DNA, 883 bp, Homo sapiens
  misc_feature: GYAE6OF01DATWS.33.28.C06.1.454.CMB.1.raw
  modified_base (459)..(459): a, c, t, g, unknown or other
  misc_feature (459)..(459): n is a, c, g, or t
  modified_base (827)..(827): a, c, t, g, unknown or other
  misc_feature (827)..(827): n is a, c, g, or t
tcagtacacacactcacgaccggtgctcgatttagagctcacgtattggggtttgggggagctctggggagtctgcaccatggcttggaccccactcctcttcctcaccctcctcctccactgccacgtacgggtctctcctcccagtccttgtcgcttgactacaactccgtccctctcgtcctcgtccgcccgttcccggtggggaccggtcccgttacggtacaaacgtccttacgactcgtcgacctacgtcgtgacggtacgtacgggacggaccacgaacgacctaaaccgtaccgaccacgtccggacgtaaggttccggaacttaacgaccgaacgaccgaacgacgaaccgggtaaccggaaacgggtaaaccggggtaccccggggttacccggtttaaccgggttaacgttacgggtaagttaaaacggggttaaacggttaaacggnggttaacggtacggtacggaccgtaaccggaccgtaaacccgggaacgggggtaacggggaccgttaccgtacccggttaagtttccggtttacggttacggtacccgggtactcgggttccgtcggggtacggtcggaacgtccgtccgttaaccgtacctaaccgtcctaccgttactaacccgccgtttacccgacggttcgttaacggacggtacggtacgtacgggtaccgttacggtaacgttacgtttcgttaacggtacccgtagggtaccccgggtttaacggtcgggtaaccttcggggtttttaacggtcggttttacgggggttacgggttacgggacggtaccgtagggtaccgnggtacctaccgggtacgtcgactaccggtaccggtactcccggccgttccggtccg

SEQ ID NO: 88293 - DNA, 726 bp, Homo sapiens
  misc_feature: GYAE6OF01EIE28.33.28.C06.1.454.CMB.1.raw
  modified_base (650)..(650): a, c, t, g, unknown or other
  misc_feature (650)..(650): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggcctcccagatgggtcctgtcccagctgcagctgcagggacggtccggggccgggactgggtagaacgtcccgtttacgggacgtaccccgtcgtccccctcaccgttgcctacttgtcctcgtgggtcggtcctccctcgaagttaccttaacgtacgtaggaacttggtacttccggaccaccgaccccggaagggacgggaccgtggtagttggtacgtttcgtacccttaagttactttacctaattttaacgtagtacgtttcggtaaccctacctaacttccgaccctaacccccgtcctaacgtaaggacgtaccgtaactacccaacgtactacggtacgtacggtacggacctaaccgtacccgaaacgtaacccgttagttaccccgtacccgtacgtaaccgttacggtaacggttacgtcggtaccgacccggccgacggaccgaccgtacctagtcgtttacttcgtcgtggacgtaggtcgggttcggttcgaccgtcgaggacgnggtccgtacgtacgtacgggtctaccgatcccgacgtaggccggggtacgagggtaccttcggcggtcctacccgg

SEQ ID NO: 88294 - DNA, 725 bp, Homo sapiens
  misc_feature: GYAE6OF01BAK3F.33.28.C06.1.454.CMB.1.raw
  modified_base (185)..(185): a, c, t, g, unknown or other
  misc_feature (185)..(185): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagtcttgtgctgactcaatcgccctctgcctctacctccgtgggcncctcggtacaacgctcatctgcactcgtagagcgaggtcggcacgagacaaccgtcgccagtccgacagtcggacatacgagacgacgcacggaccaggacggaaccgggtcccgtacggtacgtttgaagtaaggtaaagttaacgaggtagacgtggacacgaaccgaacggaaccgggaacgggggaacgccgttccgtagtacgtttcggtttacgcgggtacctggcgttcggtcggggcgtaggaccgtccgaccgttaccgtaccctacaccctccaccgacccgtcccttaccggtacgtacggttaggaacgtcggtacggacggttaccgtacgttaaccgttaaccgtttagggttactaacccggaacggtccggttcggggaccgtttaagtttcgggttaaggtttcggtttacggggttccggacgggtaccggtaaacgtaccggttccgtccgggttaaccggttcccggaagttaccggaccgtcggtaacccggtccgccccggtttacccgccgttaccg

SEQ ID NO: 88295 - DNA, 758 bp, Homo sapiens
  misc_feature: GYAE6OF01C5X6H.33.28.C06.1.454.CMB.1.raw
  modified_base (256)..(256): a, c, t, g, unknown or other
  misc_feature (256)..(256): n is a, c, g, or t
  modified_base (518)..(518): a, c, t, g, unknown or other
  misc_feature (518)..(518): n is a, c, g, or t
tcagtacacacactcacgaccggtgctcgatttagagctcacgtattggggtttgggggagctctgggggagtctgcaccatggcttggaccccactcctcttcctcaccctcctcctccactgcacagggtctctctcccagcttgtgctgactcaatcgccctctcgcctctgccctcccgtgggacgccgtcggtacaagtctcatctgctactctgacgcaggtggcactagacctaacgtacgccatccgntacgtggacactcgacgacgagcacgaccgaaggaacggaccgggtcccgtaggttacgttagaacgttaggtaaacggttaacaggtaggatacggtacacggtacccgaaccggtaaaccgggaacgggggtaaccggtactacccggttaggtaacgttttccggttttacgggaaccgggttcccgtaaggtcccggtacgggttcggggaaccgttcgggaaccggtccggttaccctaccccgttaccaacccgtnttaccccggacgtaccccgtccgttacgacgttcggagggtaagtcggtaacggtcgggtacttacgtaactttaaccgttcgtaccggtactaaccgggtccgggtcgggtaacttcgggtttagtttgttacggggttttcggttcggggaccgggtacgggtaccgtacgtccgttcgggtacccgtaggttacgaaccggtccgaaccggtacggcccgtcccggccccgttacgg

SEQ ID NO: 88296 - DNA, 786 bp, Homo sapiens
  misc_feature: GYAE6OF01DSWPM.33.28.C06.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (237)..(237): a, c, t, g, unknown or other
  misc_feature (237)..(237): n is a, c, g, or t
  modified_base (733)..(733): a, c, t, g, unknown or other
  misc_feature (733)..(733): n is a, c, g, or t
tcagtacacacactcacgaccggtgctcgatttagagctcacgtattggggtttgggggagctctggggagtctgcaccatggcttggaccccactcctcttcctcaccccttcctccctccactgcacagggtctcctctcccagccttgtgctgactcaatccnccctncgccttctcggccctcccgtgggacgcccgtacggtacaacgcctctattccgtgacctacttcgnggtaacgcgaggtcggaccaacaccggctaaacctacggacctagtccgacgtagtacggacctgtaccgagaccgacggcaacgaccgaggtaaccgggaaccggtccgttacggtacgttagtacgtaaggttaaacggtacaggtaggtagtcgaacgaccgaccggaaacggaacccggggaaagggggtaccggtaccgtacccggtttaggttaaccgttttaccgggttttcggaaaccgggttcccgtaagggtcccggtttacgggtaccggggtacggttacggaaccccggtcgttaaccccttaccgtcccgtaaacccggttactaccccggtaccctacccgttacccgtaccgtaacggtttcgtagggacggtactacgggacgttactaacgttaacttaccgtaggtcgtacgtacccggtacggtcggttacgtagttacggtaggtttcggttacgggtcgacgggacgtaacgtntaccgtcgttaccgacgttcgacgtccaccgtagtccccgtgcccgttacccg

SEQ ID NO: 88297 - DNA, 1057 bp, Homo sapiens
  misc_feature: GYAE6OF01E33A5.33.28.C06.1.454.CMB.1.raw
tcagtacacacactcacgaccggtgctcgatttagagctcacgtattgggtttggggatgctttctgagagtcatggatctcatgtgcaaagaaactgaagcacctgttggttcttcctcctgctggtggcggctcccagatgggtcctgtcccagctgcagctgcaggacgtccgggcccgggatggtagaacgtcccgtttcgggacgaccccttgtcccctcacctgccacgtgtcttcgtggtcgcctccgatacgagacgaagtactttacctttaccgtcggtgggtactcggtacctcccggaccgaccccggaccccgggaaggggacgggtcgtgggtacgtggtaacgttaagggtaactttacttacgtttaaagtttaggtacgggtacgggacgtaccgtaaccgtaaccttaacccgttaaacccccggtacccccgtttacccgtaaggaaacggttacggtaccgttaaaccgtaccctaaacgttaacttaaccgtttaccccgtaaacggtaaacccctaaacccggttaaaccccgtaaaacccgtaacccggtttaccgtttcccccgttaaccggtaaaggtaaccccgttcccgttaaacccggtccccgttttacgggttacccgggacccggtaaccccccggaccggtacccggtaaaccggtacccggttacccgggttaaccttttaaacgggttttacttttaaacccgggtttacggtaccggggttaacggaacccgggtaaaaccggttaaacccgggtttaaaccgggggggtaaaccccggggggttgggttttaaccgggggttaaacggggtttaacccgggggtttttaaccggggggttaacccccccggggggggtaaacccggttaaaaacccccccgggggggttaccccggttttaccgggttaaaaccccccggtttaaaccccgggtttcccccccctttaaccccgggtaaccccgggacccccggttttaaaccccccccctaaccccccggggggtaaaaccccccggggg

SEQ ID NO: 88298 - DNA, 814 bp, Homo sapiens
  misc_feature: GYAE6OF01CH9Z6.33.28.C06.1.454.CMB.1.raw
  modified_base (394)..(394): a, c, t, g, unknown or other
  misc_feature (394)..(394): n is a, c, g, or t
tcagtacacacactcacgaccggtgctcgatttagagctcacgtattgggtttggggatgctttctgagagtcatggatctcatgtgcaagaactgaagcacctgtgttcttcctctgctggtgcgctcccagatcgggtcctgtcccagctgcagctgcgagggcggtccgggcccggatgggtagaacgtccgtttcgggacgtacccttcggtcccctcaccgttgcctacgttcgttctcgtagggtcgcctacgagtcaggctaagtacgtttccttacgtacggtcgggtctacggacctcccgaccgaccggaccccggaagggggtacgggtccgtagggacggttaggtagttagggtaactacgttacttaagttagtacgggngggtactacgtacgacttaaccgtaccgtaccccgtacgtaacgaacggtacgtacgtacgtaccacgtactacttacgtacgacctaccgtaccaagtaccttacgttccctacgagtacgtccgtacgtaccgttgtaccggtacccgaccgtaccgtacgaaccggtaccgtaaccggttacgttaacgttaacttttaaccggttccggtagggtaacccggtaacggaaaccgggttaacccggtaaaccgggggttaacggggtcggttaacccggggtagggtttccgggttaaccgggggtttacccgggaaccgggtaaaccccgggttccggttaacggtacccccgttacccggttccgtaaccccgtacccggtacccgtacccggttaaccccggaaacccccgggg

SEQ ID NO: 88299 - DNA, 941 bp, Homo sapiens
  misc_feature: GYAE6OF01DJVLL.33.28.C06.1.454.CMB.1.raw
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagtcttgtgctgactcaatccgccctntcgcctctcgccctccgtgggacncctcggtcaagtctcatcgtncctactcgnggacgcgtaggtcgggaccaanacgacctaaaccgtccggacccagttcccgataaggttcggacctagtaccgaagaccgacgaccgaacggtaccgaaacgggtaacgggtaaccgggtcccccgtttacggggttaaccgttagggtaaaccggttaagggttaaaaaccggttaacgtagggtaggtaacgtccggggacaaaccggacccgaaaaccggtaaccggggaacgggggtaaccggtaccgttaccgttacgggttaaccgtttaccggtttttacgggaccggggtttaccgtacggttccggttacggggtcggggtacgttaccgggtaaacggtcccggttaacccgttaacccctaccggtaaccctaccgggtttacccccacccgtaaccggttccccgtaacgtaacgggttccgttacgggaaaggttcgtacgggtacgttacccgttacggttaacctttaaccggttcgttaaccgggtaccgttaaccgggttaccgggtaccggggttacgttaaccggttttacggggtttacgggttacggggttttccggggttaaccgggggtaccgggttaacccggggtaaaccgtacgggttaccccggttaacgggtaccccggttaccggtacggttacccgtaacccggtaccccggtaaggttccccggtaccccgttcccccgttaacccggg

SEQ ID NO: 88300 - DNA, 708 bp, Homo sapiens
  misc_feature: GYAE6OF01CF8XI.33.28.C06.1.454.CMB.1.raw
  modified_base (147)..(147): a, c, t, g, unknown or other
  misc_feature (147)..(147): n is a, c, g, or t
  modified_base (165)..(165): a, c, t, g, unknown or other
  misc_feature (165)..(165): n is a, c, g, or t
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
  modified_base (355)..(355): a, c, t, g, unknown or other
  misc_feature (355)..(355): n is a, c, g, or t
tcagtacacacactcacgaccggtgctcgatttagagctcacgtattgggtttgggggagctctggggagtctgcaccagtggcttggaccccactcctcttcctcaccctcctcctcactgcacagggtctctctcccagcttgtnctgactcaatccgccctntgcctctgccctcccgtgggacgcccgtcggtcaacgtcctcacgttcngcctacctcgtggacgctaaggtcggaacacgagacctaaactaccgcctagtccgtcatggactancaacgacaaggcaacggccgaacgtaacggaaacgggcccgtacggtactttcggataggaaagtaactaggtnacgcggacacgaccacgaacggaagggggacgacgtccagtacgttcgtttcgaggtccaggcgtcgtagggtcctaggacgccgtaccttacccgcaaaccgtctccgttacccgaaggtcccctactaacggttccagaacggcgttaggacggtcgttagacttaacgttctgggtaccacggaccgggtacggtacgtacgtttacgggttagttcgggtttaggggtttacccgggaccgggtaaccggtaaccggacgtaccgggtccggttaaccccgttacgttaaccgggtccgtaaccccggacccaacgggtccccttcccggtaccccccggtttacccgg

SEQ ID NO: 88301 - DNA, 823 bp, Homo sapiens
  misc_feature: GYAE6OF01BSX04.33.28.C06.1.454.CMB.1.raw
  modified_base (164)..(164): a, c, t, g, unknown or other
  misc_feature (164)..(164): n is a, c, g, or t
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
tcagtacacacactcacgaccggtgctcgatttagagctcacgtattgggtttgggggagctctggggagtctgcaccatggcttggaccccactcctcttcctcaccctcctcctccactgcacaggtctctctcccagcttgtgctgactcaatccgccctntcgcctctcgccctccgtgggacnccgtcggtcaagcctcatcncgcactcgtgagcgaggtcggcacacgacctaactacgcctagtcgacagtcggacaacgtcgaagcacgaccgacgaccgaaggacggaaccgggtccccgttacggttacgttagaacggttaacggtaaacggttaacgaaggtggaacgtcggacgaacggacccaaccggaacggggaacgggggacggtacttcccgtaggttacgttttaccggttttacggacgggttaccacgggttccgtcgggtacgggtacgtacgggacggtaccgttaccgttaccctacccgaaccttactccccgttaacccgaccgttcccgtacgttaccgtcggtacggaacggtaggttcgacgttcgtaaccgtagttaccgttacgtcggtaaccggtacggttaccgggtacgggtaccgttaacgggtttacgggtttacggttcggggttttaccggggttacggggtaccgggtaaaccgggtaccggtttaaccgggtcccggttacccggggttacccgtttaccggtaaacggggaccccgttaaccgggtacccccgggtaaaccgggttcccccggtccccccggtttccccgggttaccccgg

SEQ ID NO: 88302 - DNA, 686 bp, Homo sapiens
  misc_feature: GYAE6OF01EUBMV.33.28.C06.1.454.CMB.1.raw
  modified_base (216)..(216): a, c, t, g, unknown or other
  misc_feature (216)..(216): n is a, c, g, or t
tcagtacacacactcacgaccggtgctcgatttagagctcacgtattgggtttggggggagctctggggagtctgcaccatggcttggaccccactcctcttcctcaccctcctcctccactgcacagggtctctctcccagcttgtgctgactcaatcgccctctgcctctcgccctcccgtggggacgcctcggtccaagctcatctgcactcngagcaggtcgggcaacgagacaacgtaccgcctatcgcagtcggcatcagcagacacgaccaaggacggaaccgggtcccgtcggttacttcggtaagtacggtaacggttaacgaggtagaggtcggacgacgaccgaacgaaccgggaacgggggacgtacgtaccgtagtacgtttcggtttcgggacggtaccggcgtacgtcgggtacgggtcgtggacgtccgactaaccgtcaacctctcctaccgcgcctacgtggttcgagggagtgtcggacgttgaccgttaacttacgttacgtcgtacggacccgttacgggtagggtcctttaacggttgggttttacgtgggtttccggggtttacgggaccgggtaacgtaccgaaggtccggttacccggtcgtacggtacccgacggtacccgtaacccgggacccgtcggttacccccggccgttaccggg

SEQ ID NO: 88303 - DNA, 878 bp, Homo sapiens
  misc_feature: GYAE6OF01DDO9Q.33.28.C06.1.454.CMB.1.raw
tcagtacacacactcacgaccggtgctcgatttagagctcacgtattggggtttgggggagctcgtggggagtctgcaccatggcttggaccccactccctcttccctcacccctcctcctccactgacacgagggtctctcgtcccagcttgtgctgaccttcaatccgccctgtacgcctctcggccctccgtagggaccgtccgttcgggacaacgtcgtaccatcgtcgacctacgttccgtagaacgccgaagggtcggaccaaacgtaccttaaacgaaaccggttacgacccgtagttccgaaccgtaggtacggaccgtattaccgacgacgaacgccgaacgaccgtaggaagtaaccgggtccgtagtactgaatacggtaattaacgagtagagtacggactacgaccgtaacggaacgggtaacggggaccgtaactccggtttaagtaccggtttacggttttaaccggacgttaacgtccggtacgttaccgggtagggttaacgcgggtaacgtaccctaaccgtttaaccgtacccaaacggtccgtacccgtaaccgtacccgtacctaacggtaacgttacggtaacgaggttccgaaaggtaccgtacgttaaacggtcttaaggttaacgtaccggtaaaccgggtccggttaaacccgggtcgggttaaccgttaaccggttacgggttttaacgggtcgggttttagggttaccccggggaaaggttaacccggggtaaacggtaacccgggttaaccgtaccccggggttacccgacccgggtttaaaaccgcccggttaaccgaaacccccgggttaacggtccccgttacccccccggttcggttaaccccgg

SEQ ID NO: 88304 - DNA, 737 bp, Homo sapiens
  misc_feature: GYAE6OF01CEFGI.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctcgcctctgccctcccgtggggacgcccgtcggtcaacgctcatctgcactctgagcaggtggcacagacaactcgccatcggcagtggcatcagcagcacgccagaacggaacgggccctacggttcttaggagtaggtaaaggttaacaggtgactggcacgaccaacgaaccgggaagggggaccggtactaccgtgtactttccggttttcgacgggttccacggtcgtcggtaggggcgttaggacgtccgtaccttaacccgtcctaaccgtaccttcccgtacccgacgtccccgtacgtacgttccgtaggaacgggtctacgggaacggtcgtaacgtactttaacgtttccgtacgtacggaaccggttaccggtacgggggtaacttacgggtttacgggtttagttttcggggttaccggggtttttacgggaccgggggtaaccggggtaacgtaaaccgggttcccggttacggtaacccccgggttaccgttaggggaccctaacccgggtacccgggtaaccggtcccgttacccgggtcccccctttaaccgggg

SEQ ID NO: 88305 - DNA, 171 bp, Homo sapiens
  misc_feature: GYAE6OF02GVP5I.33.28.C06.1.454.CMB.1.raw
  modified_base (171)..(171): a, c, t, g, unknown or other
  misc_feature (171)..(171): n is a, c, g, or t
tcagtacacacactcacgaccggtgctcgatttagagctcacgtattgggtttggggaagaggaagactgacggtccccaggagttcaggtgctgggcacagcggccctgggctgcctggtcaaggactacttccagtgtgtgtactgagcgggctggcaaggcgcatagn

SEQ ID NO: 88306 - DNA, 496 bp, Homo sapiens
  misc_feature: GYAE6OF02GFAVG.33.28.C06.1.454.CMB.1.raw
  modified_base (393)..(393): a, c, t, g, unknown or other
  misc_feature (393)..(393): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctggtacttgatgaaggttaacagtgatggcagccacaccgaagggggacggatccctgattcgttttcagggtcagctctggggctggagcgctacctcaccatctccagcctcagtctgagangagctgactattactgtcagaccgtgggcacgtggttatggttggtttcggcggtagggaccaaggctcgaccgtctaggcacgccaaggcctcgcccctcgg

SEQ ID NO: 88307 - DNA, 173 bp, Homo sapiens
  misc_feature: GYAE6OF02HLYII.33.28.C06.1.454.CMB.1.raw
  modified_base (172)..(173): a, c, t, g, unknown or other
  misc_feature (172)..(173): n is a, c, g, or t
tcagtacacacactcacgaccggtgctcgatttagagctcacgtattgggtttgggggaagaggaagactgacggtcccccaggagttcaggtgctgggcacagcggccctgggctgcctggtcaaggactacttccagtggtgtactgagcgggctggcaaggcgcatagnn

SEQ ID NO: 88308 - DNA, 537 bp, Homo sapiens
  misc_feature: GYAE6OF02H2L4H.33.28.C06.1.454.CMB.1.raw
tcagtacacacactcacgaccggtgctcgatttagagctcacgtattgggtttgggggagctctggggagtctgcaccatggcttggacccactcctcttcctcaccctcctcctccactgcacagggtctctctccagcttgtgctgactcaatcgccctctgcctctgcctccctgggacgcctcggtcaagcctcatctgcactctgagcagtggcacagcaactacgcatcgcatggcatcagcagcagccagagaaggccctcggtacttgatgaaaggttaacagtgatggcagccaacacgaaaggggacggatcctgatcgttttacagggtccagctcgtggggctgagcgctaccgtcaccatcgtaccagcctacctagtctggaaggatcggaagctagaccttaaagttctgtacacggaccgtgggactacgttggttaatggttggttcgggcgggaaggtaccgaagtcgacggtaccgttccgaggtcgacgtcccgaagggtctaccggccctaccggg

SEQ ID NO: 88309 - DNA, 517 bp, Homo sapiens
  misc_feature: GYAE6OF02IPWGW.33.28.C06.1.454.CMB.1.raw
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacggatcccgtgattcgttttcagggtccagctcgtggggctgagcgctaccncaccatcnccagcctccagtcngaggatggaggctgactattactgtcagccgtgggctacgttggttatggttggtttcggcgggtagggaccaaggtccgtggtacccgtcgtaggtcacggcccgaaggtctccgccccgtcgg

SEQ ID NO: 88310 - DNA, 524 bp, Homo sapiens
  misc_feature: GYAE6OF02GA829.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtgctccatcagcagaagtctttactactgggctggatccaccagcccccagggaagggctggagtggattgggaatatctattatagtgggagcagctactacaacccgtcctcaagagtcgagtcaccatatcctagacacgtccaagaaccagttcctccctgaacgctgacctctgtcgaccgccgcacgacacggctgtatattactgtgcgagacagtaaccgggagtcggagtgtagttggggacctaggggaaccctggtcaccggtctcccgtcacgtcctccaaccg

SEQ ID NO: 88311 - DNA, 504 bp, Homo sapiens
  misc_feature: GYAE6OF02GHX60.33.28.C06.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctcgtctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaaggggacggatccctgatcgttttcagggtccagctcgtggggctgagcgctacctcaccatctccagcctccagtcngaggntgagctgactattactgtcagaccgtgggcacgtggttatgtggtttcgggcggacgggaccaaggcgtggaccgtccgtaggtcgacgcccgaaggctcgcccctccgg

SEQ ID NO: 88312 - DNA, 529 bp, Homo sapiens
  misc_feature: GYAE6OF02G05TY.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagtctcggtcaagctcatctgcactctgagcagtgggcacagcaactacgccatcgcatggcatcagcagcagccagagaagggccctcggtacttgatgaaggttaacagtgatggcagccacaccgaagggggacggatcccgtgattcggttttcgagggtccagtctcgtggggctggagcgctacctcaccatctccacgcctccagtctgaggtagtgaggtctagtactattactgtcagaccgtgggctacgttggttagtggttgggtttcgggcggacgggacgtaggtcgtcggaccgtccgtaggtcgacgacccgaggcctccggccccgtcgg

SEQ ID NO: 88313 - DNA, 630 bp, Homo sapiens
  misc_feature: GYAE6OF02IVV9I.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccaacgaccgaaagggggacgggactcccgtagtacttcgttttacagggtccaggtctcgtggggctgacgcgtctaccgtccaccatcctccacgtcctccgagtcctaggaggtatcggacggcttaggtaaccttatttaaccgtgttaccgacggtacccgtggggtactaaccgtttgggtttaacttgggtttcggggttttaccggggtaccgggtaacggggtacccgtaaaggtcccgttacgggtaaccccggttcccggtaacgggtaccacggaaccccgtaaggggtcccttacccgggccccccgttaccggg

SEQ ID NO: 88314 - DNA, 552 bp, Homo sapiens
  misc_feature: GYAE6OF02HUHKI.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtgctccatcagcagaagtctttactactggggctggatccgccagcccccagggaagggctggagtggagttgggaatatctattatagtggagcagctactacaacccgtcctacaagagtcgagtcacatatccttagactacgtaccaagaacctagttcctccctgaacgctacgaccttctgtcgacccgccgcagacacggctgtatattactgtgcgagacagtaaccggggagtcggagttggtagttcgggggaccctaggggaaccccttgggtaccacccggttctcccgtacgacgtccctacccaacccgg

SEQ ID NO: 88315 - DNA, 708 bp, Homo sapiens
  misc_feature: GYAE6OF02IQEB0.33.28.C06.1.454.CMB.1.raw
  modified_base (254)..(254): a, c, t, g, unknown or other
  misc_feature (254)..(254): n is a, c, g, or t
tcagtacacacactcacgaccggtgctcgatttagagctcacgtattgggtttgggggagctctggggagtctgcaccatggctcggacccactcctcttcctcaccctcctcctccactgcacgagggtctctctccagcttgtgctgactcaatccgccctctcgcctctcgccctcccgtgggcgcctcggtacaacgctcatctgcactctgagcgaggtgggcacgagactaactaccgccatcgctanggacatcagcagcagaccagagacggcctcggtatgagtagtaaaggtaacagtgagtcggacacgaccaacgaacggaaagggggacggactacccgtagtacgttcggttttacgacgggtccgagtcgtcggtggggcgtacgagccgactaccgcaaccgactcctaccaacggtccctacgacgtcgtaggaacggagttggacggtcctacggtaactaacgtttacgtacgtaccgaacggtaccgggtacggggtacccttaaggtttgggttaaacgttcgggggttttaccgggttttaccggggggacccggggttaacggggaacccgtaaacggggtccgttaacccggggtaaccccggttaccggtttaacgggtacccgtaaccggggtaaacccgtaaccggggttcccgtaccccgggttccccccggttaacggg

SEQ ID NO: 88316 - DNA, 531 bp, Homo sapiens
  misc_feature: GYAE6OF02F68FD.33.28.C06.1.454.CMB.1.raw
  modified_base (397)..(397): a, c, t, g, unknown or other
  misc_feature (397)..(397): n is a, c, g, or t
  modified_base (466)..(466): a, c, t, g, unknown or other
  misc_feature (466)..(466): n is a, c, g, or t
tcagtacacacactcacgaccggtgctcgatttagagctcacgtattgggtttggggagtgctttctgagagtcatgggatctcatgtgcaagaaactcgaagcacctcgtggttcttcctcctgctggtggcggctcccagatgggtcctgtcccagctgcagctgccaggagtcgggcccgggactggtgaagccttcggagaccctgtccctcacctgcactgtctctggtgctccatcagcagaagtctttactactggggctggatccgcagcccccaggagggctggagtggattgggaatatctattactagtgggagcgagctactacaacccgtccctcaagagtcgagtcgaaccatactccttagacacgtccaagaaccagttcnccctgaacgctgacctctgtgaccgcgcagacacggctgtatattactgtgcgagacagtaaccggggntcggagtggtagttgggccagggaaccctggtaccaccgtctccgtcgagtccctcctaacccgg

SEQ ID NO: 88317 - DNA, 497 bp, Homo sapiens
  misc_feature: GYAE6OF02GGUJP.33.28.C06.1.454.CMB.1.raw
  modified_base (389)..(389): a, c, t, g, unknown or other
  misc_feature (389)..(389): n is a, c, g, or t
  modified_base (443)..(443): a, c, t, g, unknown or other
  misc_feature (443)..(443): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacgaccgaagggggacggatccctgatcgttttcagggtcagctcgtggggctgagcgctacctcaccatctccagcctcagtcngagatgagctgactatactgcagcgtgggctacgtggttatggttggtttcggnggaggaccgaagtctaggaccgtcgtaggtcaggcccgaggcctcgcccctcgg

SEQ ID NO: 88318 - DNA, 574 bp, Homo sapiens
  misc_feature: GYAE6OF02IQYKI.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacgaccgaagggggacggactcccgtgattcgttttcgagggtccagtctcgtgggctggagcgctacctcaccatcctccagtccctccagtctggagatggaggctgactattacgtgtacagaccgtggggactacgttggttattgggttcgggttttacgggacgggtacggggtaacccgaaggtccgtacgggtaccccgttaccgtaagggttaccaacgggtccccgtaaacgggtcccgttccggccccccgttaccggg

SEQ ID NO: 88319 - DNA, 548 bp, Homo sapiens
  misc_feature: GYAE6OF02H6B3Z.33.28.C06.1.454.CMB.1.raw
  modified_base (400)..(400): a, c, t, g, unknown or other
  misc_feature (400)..(400): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtattgatgaagttaacagtgatggcagccacaccggaaggggacggactcccgtgtattcgttttcgaggtccagctcgtgggctggagcgctaccgtcaccatcctccagtcctctacgtctgaggntgaggctgaatattactgtacagtaccgtgggactacgttggtattggttgggttttccggcgggtaacgggaccgtaaggccgtggtaacccgttcgtacgggtccgtacggaccccgtaagggtcctcccggccccccgttccggg

SEQ ID NO: 88320 - DNA, 504 bp, Homo sapiens
  misc_feature: GYAE6OF02H3QA7.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtacttgatagaaggttaacagtgatggcagccacgaccggaaggggacggatcccgtgtatcgttttcgagggtcagctcgtggggctggagcgctaccgtcaccgtatcctaccacgcctccagtctgaggatgagctgactatctgtcagtcctgggactacgttggtatggttggtttcggacggaggacagtcgtgaccgtcgtaggcacgccgaagctcgccctcgg

SEQ ID NO: 88321 - DNA, 617 bp, Homo sapiens
  misc_feature: GYAE6OF02HPMCM.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgagtaggaaaggttaacagtgagtggacagccacgaccggaagggggacggactcccgtgtattcgttttcgaggtccagtctcgtggggctgacgcgcctacctcaccattcctccacgtcctaccgagttcgtaggacggtagtggacggtcctagtacttaagtttacgtcgtacgacggtaccgtcggggaccttacggttgggttaagtcgggtttgggtttccgggacgggtacggggtaaccctaaacgggtccgttacggtacccggttaccgttacgggtaccgtaccggaccccgtaacgggtccgtacccggtcccccgttaccggg

SEQ ID NO: 88322 - DNA, 620 bp, Homo sapiens
  misc_feature: GYAE6OF02GH0J9.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtacttgatagaaggttaacagtgatggcagccacgaccgaagggggacggactcccgtgacttcgttttcgagggttccagccgtcggtcgggtcgtaggcgccgtcctacctaccgacgtacctccgtacgaccgtccctacgtacgttcgtacggtagtagtacggacgtcgtacgtacttacgttacgtacgtacgacgtaccgggtcggaccgttaggttacgttagttgggtttcgggttaccgggtacgggtacggtaaccggtacgtacggtaccggtacccggttacggtaccggtacgaccggtaaccggtacggtccgtaccccgtcccggtacccgg

SEQ ID NO: 88323 - DNA, 601 bp, Homo sapiens
  misc_feature: GYAE6OF02GGOQY.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagacgggccctcggtactgatgaaggttaacagtgatggcagccacgaccgaagggggacggatcccgtgtagttcgttttacgacgggtcagcgtcgtggggctgacgcgtctacctcgacctacgtcctacccgacgtccctaccgacgtccgtggacggtagtggacggtccgttagtaacctttaagtttaccgttcggtaccgtacggtacccggttcggggtactaccggttggtttacgttgggtttcggggttttcgggacgggtacggtaccgaaggtccgtacggtacccgtcgtacggtcacggacccgtaggcctccggtcccccgtcgg

SEQ ID NO: 88324 - DNA, 542 bp, Homo sapiens
  misc_feature: GYAE6OF02GSHLH.33.28.C06.1.454.CMB.1.raw
  modified_base (392)..(392): a, c, t, g, unknown or other
  misc_feature (392)..(392): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacggccctcggtacttgatgaaggttaacagtgatggcagccacaccgaaggggacggatcccgtgattcgttttcgaggtccagctcgtgggctgacgcgctacctcaccatcctccacgcctcagtcngaggatgaggctagattatactgtacagtaccgtgggctacgttggttagtggttgggtttcgggcgggtaggaccgtaaggtccgttacggacccgttccgtaggtccgaacggtcccgaacgggtccgtacccggcccccgttaccgg

SEQ ID NO: 88325 - DNA, 547 bp, Homo sapiens
  misc_feature: GYAE6OF02GEPFF.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatagaaggttaacagtgatggcagccacgaccgaagggggacggatcccgtgtattcgttttcgagggtccagctcgtggggctggacgcgtctaccctcacctactcctccacgtccctccacgtctggaggataggacggcttagaattattactgtacacgtcgtgggctagttggttatggttggtttcgggcggtacgggaccgaaggtcgtacggtacccgtcgtaggtcacggacccgacggccgtccggccccgtccgg

SEQ ID NO: 88326 - DNA, 536 bp, Homo sapiens
  misc_feature: GYAE6OF02JCDA4.33.28.C06.1.454.CMB.1.raw
  modified_base (395)..(395): a, c, t, g, unknown or other
  misc_feature (395)..(395): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggtaacagtgatggcagccacacgaaggggacggatcccgtgacttcgttttcgagggtccagtctcgtggggctggacgcgctacctcaccatcctcacgcctcagtcngaggatgagctgactattacgtgtacagaccgtgggctagttggttagttggttacgggtttcgggcggtacgggtaccgaacggtcgtacggaccgttcgtacggtccacggacccgaaggccctccggcccctaccggg

SEQ ID NO: 88327 - DNA, 564 bp, Homo sapiens
  misc_feature: GYAE6OF02JQW38.33.28.C06.1.454.CMB.1.raw
  modified_base (184)..(184): a, c, t, g, unknown or other
  misc_feature (184)..(184): n is a, c, g, or t
  modified_base (393)..(393): a, c, t, g, unknown or other
  misc_feature (393)..(393): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagcagtggcacagcaactacgccatcgcatggcatcagcagcagccagagaacgggccctacggtacttgatgaaggttaacagtgatggcagccacgaccgaaggggacggactccgtagacttcgttttcgagggtccagtctcgtacggggctagacggcgtcctacctcaccgattccnccacgtcctccgtagtcgtagaggactaggacggcttagtacttattaccgtgtcgacgtacgtgggtcctaagttggttaaggttgttcgggttcgggacggacgggtaccgaacgtcgtacggaccgtccgtaggacgacggtaccgaggaccctccggccccgtacgg

SEQ ID NO: 88328 - DNA, 671 bp, Homo sapiens
  misc_feature: GYAE6OF02FJ6ZB.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctggtacttgatgaaggttaacagtgagtggcagccaacgaccggaagggggaccgggactcccgtagtacgttcggtttttaccgaggggttcccacggtcgtccggttgggggccgtaggacgccggtacctaccccgtacacccgtaacttcccgtacccgacgtccccgtaccgtacgtccgttaggaacggttagtcggaacggtccgttacgtaacgttactttacgtcgtaccgtacggacccggttggggaccctaggttcgggtttagtcgggtttcgggttttccgggacgggtacgggtaaccgtaacggtccgtacgggtaccccgttaccgtagggttacccgtaacggtaccccgtaacgggcccgttacccggtccccccgttaccggg

SEQ ID NO: 88329 - DNA, 559 bp, Homo sapiens
  misc_feature: GYAE6OF02FMDOA.33.28.C06.1.454.CMB.1.raw
  modified_base (189)..(189): a, c, t, g, unknown or other
  misc_feature (189)..(189): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagtacacacactcacgaccggtgctcgatttagagctcacgtattgggtttgggggagctcctggggagtctgcaccatggtcttggaccccactcctcttcctcaccctcctcctccactgcacagggtctctcttcccagcttgtgtctgactcaattcgccctctgcctctgcctccctgggancctcggtcaagcgtcgatctgcactcgtgagcagtgggcacagcaactacgccatcgcatggcatcagcagcagccagaggacgggccctcggtacttggactggaaggttaacgagtggagtggcagtccactaccgaagggggacggactcccgtgtattcgtttttacgagggtccagctcgtgggctaggacgcgctacctcaccactctaccacgccctcagtaccngagntgagctgactattactgtcagaccgtgggctacgttggttactggttgggtttcgggacgggagggacctaagggtcgtacggtaccgtacgtacggtcgacggacccgaggccgtccggtcccccgttccggg

SEQ ID NO: 88330 - DNA, 607 bp, Homo sapiens
  misc_feature: GYAE6OF02I5TF3.33.28.C06.1.454.CMB.1.raw
  modified_base (328)..(328): a, c, t, g, unknown or other
  misc_feature (328)..(328): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtggctccatcagcagaagtctttactactggggctggatcccgccacgcccccgagggaacggggctggagtggattgggaatatctattatagtgggancagctactaccaacccgtccctacaagagtcgagtcaaccatactccttagacacgtccaagaacctagtcctccctgaagctcgacctctgtcgaccgccgcgacgaccaccggctggtaacttactttacgtgtagcgaagtaacctaacggttaaacccgggggattaccggggagttggttaacggtttcggggggacctaaacgggggtaaccccgttagggtaccgtacccggttccgttcccgtccgaaccggtcccctacccgtaacccgg

SEQ ID NO: 88331 - DNA, 516 bp, Homo sapiens
  misc_feature: GYAE6OF02HEBFL.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacacgaagggggacggatcccgtgatcgttttcgagggtccagctcgtggggctgagcgctacctcaccatctccagcctccagtcgtgaggatgaggctgactattacgtgtacagaccgtgggctacgttggttatggttggtttcgggcggtagggaccaaggctaggacccgtcgtaggtcacggcccgaaggcctcggccccctcgg

SEQ ID NO: 88332 - DNA, 610 bp, Homo sapiens
  misc_feature: GYAE6OF02H147M.33.28.C06.1.454.CMB.1.raw
tcagtacacacactcacgaccggtgctcgatttagagctcacgtattgggtttgggggagctctgggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatagaaggttaacagtgatggcagccaacgaccggaagggggacggactcccgtgtacttcggttttacgagggtccagcgtcgtggggctggacgccgctacctccacctacttcctaccacgcctaccagtccgtaggaggactggacgtctacgtacttagttacgtgtacgacggtaccggtggggacctacgttgggttagttgggttcgggttttaccgggacgggtacgggtaaccgaaggtcccgttacgggtacccgttaccggtagggtaccgaccggtaccccgtaacgggtcccgtcccggtaccccccgttccggg

SEQ ID NO: 88333 - DNA, 598 bp, Homo sapiens
  misc_feature: GYAE6OF02GUE7R.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtactgatgaaggttaacagtgatggcagccacaccgaaggggacggatccctgacttcgttttcgaggtccagctcgtgggctgacgcgctacctcaccactctccacgtcctaccagtcgtgacggtatggacggtctacgtacttacttacgtcgtaccgtacggtaccgtggggtacctacgttgggtttagttgggtttcggggttttccgggacgggtaacgggtaccgtaagggtccgttacgggtacccggttaccgttaacggtcccgaacggtaccccggtaaacgggtcccttaccccggtcccccgttcccggg

SEQ ID NO: 88334 - DNA, 537 bp, Homo sapiens
  misc_feature: GYAE6OF02GQVCO.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtggctccatcagcagagtctttactactgggctggatccgccacgcccccaggggaacggggctgggagtggagttgggaatatctattatagtgggagcagctactacaaccccgtcctacaagagtcgagtcacctatactccttagacacgtaccaagaacctagttcctaccctgaacgctcgaccttctgtcgaccgccgacgagacacggctgtatattctgtcgcgagacagtaaccgggagtcgagtagtagtgggaccgagggtaccctggtaccacgtctcctacgcgcctaccaccgg

SEQ ID NO: 88335 - DNA, 522 bp, Homo sapiens
  misc_feature: GYAE6OF02H6701.33.28.C06.1.454.CMB.1.raw
  modified_base (399)..(399): a, c, t, g, unknown or other
  misc_feature (399)..(399): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgacatggcatcagcagcagccagagaaggccctcggtacttgatgaaggttaacagtgatggcagccaacgaccgaaggggacggatcccgtgtacttcgttttcagggtcagcgtcgtggggctgagcgtctactcacatctccagcctcacgtctgaggntgagctagactattactgtacagtaccgtgggctacgtggtatgttgggtttcggacggtacgggaccaggtcgtcgaccgttcgtacggtcacggccccgaaggctacccggtcccctcggg

SEQ ID NO: 88336 - DNA, 561 bp, Homo sapiens
  misc_feature: GYAE6OF02GQHHR.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtggctccatcagcagaagtctttactacgtggggctggactcccgccacgcccccgagggaacggggctggaggtggagttgggaatatctattagtagtggagcagctactaccaacccgtcctacaagagtcgagtcaccatactccttagaccacgtaccaagaaccagttcctaccctagaagcctcgacctcgtgtcgacccgccgcgacgaccacgggctagtatacttactgtcgacgagactataacgtcggggagtcgggtagtggtaggtcggggaccgaagggtacccgtggtccacgtcctacccgtcacgtccctacccg

SEQ ID NO: 88337 - DNA, 634 bp, Homo sapiens
  misc_feature: GYAE6OF02H7P5I.33.28.C06.1.454.CMB.1.raw
  modified_base (329)..(329): a, c, t, g, unknown or other
  misc_feature (329)..(329): n is a, c, g, or t
  modified_base (419)..(419): a, c, t, g, unknown or other
  misc_feature (419)..(419): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggatggtgaagccttcggagaccctgtccctcacctgcactgtctctggtcgctccatcagcagaacgttctttacacgtggggctggactccgccacgccccgagggagggctggagtggagtgggaatatcttaattagtaggtgggancgagactactaaccaaccccgttcctacgaagtcgtacgacgtaccacctatactccttagacctacgtaccaaacgacctacgtttccncctagaactctcgtacccttgtgtaccgacccgtccgacgtacgacgacgtcttagttaattacttacgtggtcgaaccggaagtaaccgtaaggtaaccgggggagttacgggaggttggttaacgggtcggggaacccggtaacggggtaaccccgtttcggaccctacccggttcctcccgttacgaccgtaccccctacgtaaaccccggg

SEQ ID NO: 88338 - DNA, 576 bp, Homo sapiens
  misc_feature: GYAE6OF02ITV2H.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccggactggtgaagccttcggagaccctgtccctcacctgcactgtctctggtgcctccatcagcagagtctttactacgtgggctggatccgccacgccccgagggacgggctggagtggagttgggaatatctattagtaggtgggagcgagtctacctaccgaaccccgtccctacgaagacgtacgagtccacctatactcttaagaccacgtaccaacgaaccctagttcctccctagacgtcgtcgacctcgtcgtcgacccgccgacagacacggctagtatacttacgtgtgcgacgtacgacgtaaccgggagtcggagtgttaggtcgggaccgtacgggtaacccgtggtaccgaccgttccgtccgtcgaccgtccctacctaacccgg

SEQ ID NO: 88339 - DNA, 593 bp, Homo sapiens
  misc_feature: GYAE6OF02HV8C8.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcaggtggcacagcaactacgccatcgcatggcatcagcagcagccagacgaacgggccctcggtactgagtagaaggttaacagtgagtgcagccaacgacggaaggggacggactcccgtgtacttcgttttcgacggtccagtcgtcgtgggctggacgccgctacctcacctctcctaccacgtcctccgagtcgaggaggtagtcggaacgtcgtatacttattacgtcgttacgacgtaccgggtgggacctaggttggttacgttgggttcgggtttacgggcgggtacggaaccgtacggtccgtacggtacccggttaccgttacggtaccgtaccggacccgtaacggtcccgtcccggaccccttccggg

SEQ ID NO: 88340 - DNA, 679 bp, Homo sapiens
  misc_feature: GYAE6OF02IQA5F.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctcgccctcccgtgggacgcctcggtacaagctcatctgccactctgagcaggtcgggacacagcaacgtacgccatcgcagtcggacatcgagcaggcagaccgaaggaacggaacggggtccctcggtacttgaagtaggaaacgttaacgaggtgagtcggacgacgccgaacgaaccggaagggggacggactcccgtgtacgttcgtttcgacggtcgagtcgtacggtgggctggacgtcgtacctaccgtcgaccgtacgtccgtaccgacgtccctacgacgttccgtagtaacgggatacgggacgtaccgtagtaaccttactacgttcggtacgacggtaccggtaggtaccgttaagttggttacgttggggttcggtttacgggaccgggtacggggtaactaacgggtccgtacgggttacccggttaccgttaacgggtacctaacccgggtacccgtaacgggttccccgtacccgggttcccccgttaccggg

SEQ ID NO: 88341 - DNA, 656 bp, Homo sapiens
  misc_feature: GYAE6OF02F1W8I.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagacggcctcggtactgatgaagttacagtgatggacacgccacgacgaagggggacggactcccgtgtacttcgttttacgacgggtccaggtcctcgtgggggctaggacgccgtactaccctcacccgtactccgtaccacgtccctacgacgtccgtaggaacggtatacggacggtcttaggaacctttagttacgtcgtacgacggtacccgtggggacctacggtttaggtttaacgttcggggtttacgggttttaccggggacggggtaaccgggtaacccgtaagggtcccgttacggggtacccccggttaaccggttacggggttacccaaccggggtaacccccgtaagggtccccgttacccgggacccccccgtttaccggg

SEQ ID NO: 88342 - DNA, 628 bp, Homo sapiens
  misc_feature: GYAE6OF02HO4ZP.33.28.C06.1.454.CMB.1.raw
  modified_base (229)..(229): a, c, t, g, unknown or other
  misc_feature (229)..(229): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggngctccatcagcagaagttctttactacgtggggctggactccgccacgcccccgaggggaacgggctgggagtgggagttgggaatatctattagtaggtgggagcgagctactaccacccgtcctacaagagtacgagtcacctatataccttagactaccgtaccaaagaacctacgttaccctacccgtagaacgtcctacggtacccttcgtgtccgacccgtcccgcgaacgaccgaccggtcttaggttaattactttacgtagtcgacgaagtaacgaacggtaaaccggggggagtcggtagttcggttagggttacggggcccgtaagggggtaaccccgtgggttccaccggttcctccctcgtaaccgtcccgtacccgtaacccggg

SEQ ID NO: 88343 - DNA, 578 bp, Homo sapiens
  misc_feature: GYAE6OF02GTL7P.33.28.C06.1.454.CMB.1.raw
  modified_base (440)..(440): a, c, t, g, unknown or other
  misc_feature (440)..(440): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcggggcccgggactggtgaagccttcggagaccctgtccctcacctgcactgtctctggtggctccatcagcagaagtctttactacgtggggctggatcccaccacgcccccgagggagggcgtggagtggattgggaatatctattagtagtgggagcagctactaccaacccgtcctcaagagtcgagtcaccatactccttagacacgtaccaagaacctagttcctacccgtagaacgtctacgtacctctcgtcgacccgccgngacgacgacggctagtatacttacgtgtcgacgagacgagtaaccggggagtcggagttgtaggtcgggaccgtacggggtaacccgtggttacccaccggttcctcccgtcgtaccgtccccgtacccgtaacccgg

SEQ ID NO: 88344 - DNA, 544 bp, Homo sapiens
  misc_feature: GYAE6OF02GWEKI.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctacggtacttgatagtaaggttaacagtgagtggcagccacgaccgaagggggacggactccgtgtagttcgttttacgagggtccagtcgtcgtgggctggacgcgctacctcaccatcctcacgcctcacgtcgtgagtagtggagctcgacttattactgtacagaccgtgggctacgttggttagtggttggtttcgggcggtaggaccgaacggcgtcggacccgttccgtaggtacgacggcccgaacggcgttcccgccccgtacgg

SEQ ID NO: 88345 - DNA, 682 bp, Homo sapiens
  misc_feature: GYAE6OF02IO0M3.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacagacaactacgccatcgcatggcatcagcagcagccagagaacgggccctcggtacttgatggaaaggttaacaggtgagtggacagaccaacgaaccggaaagggggacggactcccgtagtacgtttcggttttacgacgggtccaggtcgtcggtggggctggacgccgtaccttacccgtccaacctacttccgtacccgaccgtccctaccgtacggttaccgtaggaacgggtacgtggaacggtccgttaggtaacctttaagttaccgttcggtaccgacggtaccggtcggggtacctacggtttcgggttagttcgggtttacgggttttacggggacggggtaacgggtaccgtaacggtccggttacggtaacccggttaccgtaacgggttacccgaacggtaccccgtaaacgggtcccgtaccccgggtacccccgttaccggg

SEQ ID NO: 88346 - DNA, 662 bp, Homo sapiens
  misc_feature: GYAE6OF02GMTQG.33.28.C06.1.454.CMB.1.raw
  modified_base (327)..(327): a, c, t, g, unknown or other
  misc_feature (327)..(327): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactgggtgaagccttcggagaccctgtccctcacctgcactgtctcgtgtgctccatcagcagaagtctttactactggggctggactccgccagcccccgagggaagggctgggagtggattgggaatagtctattatagtgggancagctactaccaacccgtccctagaacgacgtcgaacgtcaaccgaattactccttaagaccacgtaccaaacgtaaccacgtttccctaccctagtaaacgctacggtaacccttctacggttcgacccgcccgcaacggaaccacggtaccttaggtaacttaacttacctggttcgacgtaagtaacctaaacgggtaacccgggggaacgttccggggagttacggtttaacgggttcgggggaacccgtaacgggggtaacccccgttgggttaccccgaaccggtttccctacccgtaccgtacgtaccccgttacccgaaaccccggg

SEQ ID NO: 88347 - DNA, 714 bp, Homo sapiens
  misc_feature: GYAE6OF02JERXW.33.28.C06.1.454.CMB.1.raw
tcagtacacacactcacgaccggtgctcgatttagagctcacgtattgggtttgggggagctcgtggggagtctggcaccatcggcttggaccccaacgtcctcttcctcaccctcctcctccactgcacagggtctctctcccagcttgtgctgactcaatcgcctctgtcctctgcctcctgggagcctcggtcaagctcatctgcacgtctggacggcaggtgggccacgacgccgaacgtaccgccagtccgcagtggcatccagccgagtctacgcctaggacgaacgggccctaggtacttgacgtggtaacggttaacaggtgagtggacgacggtccaacggacggaagggggacggactcccgtagtacttcgttttacgacgggtccaggtacgtcggtggggtactggacgtccgacctaaccgtccgaaccctacgtcccgtacccgacgtccctacccgtacggttccgtaggaacgggtaagtacggtaacggtccgtacgtaaccgttacgtttaccgtacggttaccgtaacggtaccgtacggggtacctaccggtttaggttaacgttgggttaccggggttttccgggacgggtaccgggtaaccgtacggtaccgttacggtaacccgggttccgtaacgggtcggaaccggtacccggtacgggtcccgttacccggtacccccgttaacggg

SEQ ID NO: 88348 - DNA, 826 bp, Homo sapiens
  misc_feature: GYAE6OF02ID16Q.33.28.C06.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctgcctctgccctcccgtgggacgcctcggtcaacgctcatctgcactcngagcaggtggcanagccaactaccgccagtcgcagtggcatcagcagcacgaccaggacggaaaccgggtcccgttacggtacgttaggagtaggtaaggttaacgaggtaggagtggcgacgaccaacgaaccgggaacgggggaccggacgtcccgtaggttacgtttccggttttacgacgggttaccacggtccgttacggtcgggggtccgttacgggaaccggtccggtacccgttacccgtacccgtaaccccgtaaccgttcccgtaccccgtaccgtccccttacccgtacggttaccggttaccgggtaagggtaaccggttagggtaaccgggtaccgtttaacggtaaccgtttaaacggttttacccgttacggttacccggtaaccggtaaccggggttccgggggtacctttaacgggttttcgggtttaacggtttcggggttttaccggggtttttaccgggggaccgggggtaaccgggtaaccggtaaaccggtcccggttaaccgggtaccccggtttacccggtaacgggttacccgtaacccggtacccggtaaccgggtcccggttacccccggtcccccggttaccgg

SEQ ID NO: 88349 - DNA, 711 bp, Homo sapiens
  misc_feature: GYAE6OF02I75QO.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctcccgtgggacgcctcggtcaagcctcatctgcactctgagcaggtgggcacagcaactacgccatcgcagtcggacatcgagcacgcagccagaggaacggtccctacggtacttggataggaaaggttaacagtgagtcggacacgccaacgacgaagggggacgactcccgtagtacgttcgttttacgacggttccaggtccgtcgtcggggactaggacggtcgtaccgtaccgtcctaaccgtaccttcctacccgaccgtcccgttaccgacggttcgtacggtaacggtacgtacggacggttaccgttacgtaactttacggttaaccgtggttaaccgtacgggtaacccggttggggtaaccttacggtttacgggtttaacggtttcgggttcgggttttaaccggggacgggtaacgggtaaccgtaacgggttcccgttacggtaaccccggttaacggtttaacggacccggtaaccggtacccggtaacgggtcccgttaccccgggccccgttaaccggg

SEQ ID NO: 88350 - DNA, 591 bp, Homo sapiens
  misc_feature: GYAE6OF02F00O7.33.28.C06.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (482)..(482): a, c, t, g, unknown or other
  misc_feature (482)..(482): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcggggcccgggactggtgaagccgttggacgaccctgtcccctnaccctgccactntctctgggtcgcctccatcagcagaagttcttactacgtgggctggatccgccacgcccccgagggaaggggctggagtggagttagggaatagtctaattagtaggtgggagcagctaactaccaacccgtcctacaacgacgtcggacgtccaaccattacttacccgttagacctaccgtacccaaagtaaccctacgtttcctacccgtagaaacgtctacgtacctcgtacgtcgacccgccgcaagaccncggactgtatacttatgtgacgagacacggtaaccgggtagcggagttagtacggtgggaccgagggtaccctggacctaccgtctcccacacgtcccacctaacccgg

SEQ ID NO: 88351 - DNA, 733 bp, Homo sapiens
  misc_feature: GYAE6OF02IZKYK.33.28.C06.1.454.CMB.1.raw
  modified_base (227)..(227): a, c, t, g, unknown or other
  misc_feature (227)..(227): n is a, c, g, or t
  modified_base (628)..(628): a, c, t, g, unknown or other
  misc_feature (628)..(628): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggcctcccagatgggtcctgtcccagctgcagctgcaggagtcgggcccggatggtgagccgttcggacgaccctgtccctcacctgcactgtctcgnggtcgctcatcagcagtagttctttactacgtgggactggactccgccacgccccgagggacgggctgggagttgggagttggggaattagtacttaagttagtaggttgggacgtcgagtaccttaaccgtaacccgtaaccccgtcctacgaaacggtacggtacgaaacgtccaaaccgtacttaactacccgttaaacgaccctaaaccggttacccaaaacggtaaccctcggtttaacccctcccgttaggtaaacctcgttaccgtaacccttcgtccggttacggacccgtacccggactaaccggaccgtaaccgtcgtttaagttaccgtttaagttaccgtacgggtcggaacgtacgaacgtaacgggttaaccggggagttaccgggngttacgggtacgggttccgggggaaccgtaaccgggtacccgttacggggtaccctacccggttcctaccggttacccgacccgtaccccgtaacggaaccccgg

SEQ ID NO: 88352 - DNA, 733 bp, Homo sapiens
  misc_feature: GYAE6OF02GFSU8.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtccgggcccgggatggtgaagccttggacgaccctgtccctcacctgcactgtctcgtggtgcctccatcagcagaagttcctttactactggggctggatccgccacgcccccgagggacgggctggacggtggagttgggaatatacttattagtagtagggagtacgagactaaccgtacctaaccccgtcccgtacaaggacgtacgacgtaccgacctaattaactccgttaagaacctaccgttacccaaaacgtaacccgtagtttaccctcccgtaagtaacgtctacggtaccctcgtacggttaccgacccgtacccgacctaacggaaccgaccggtacgttacgttaacttaacgtttaccttgggttaccgtacggtaaccgaaacgtttaaacgggtaaacccgggggtacgttaaccggggtaggtttacggtttaacgggttcggggggtaacccaaacgggggtaacccccgttacggggttccctaaccccggttccttaaccccggttcgaacccggttacccctaccccggtaaaacccccggg

SEQ ID NO: 88353 - DNA, 590 bp, Homo sapiens
  misc_feature: GYAE6OF02HOE1F.33.28.C06.1.454.CMB.1.raw
  modified_base (568)..(568): a, c, t, g, unknown or other
  misc_feature (568)..(568): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggatggtgaacgccttcggagaccctgtccctcacctgcactgtctctggtgctccatcagcagaagtctttacacgtgggctggactccgccacgcccccgaagggagggcctagggagtcggagttgggaatagtacgtagttagtaggtggacgctagtcctaactaaccgaacccgtccctacaaggtagtacggacgtcgaactatactaccttaagacctaccgttaccaaacgtaaccctacggttccctaccgtagtaacgctacgacccttcgtcgtacgacccgccgacacgacgacggctagtatacgttctgtgacgagacgaagtaaccgggtgacgtaggtgtacgtgggcctaagggacctggtaccgcgttccncgtacacgtcctaccgtaccgg

SEQ ID NO: 88354 - DNA, 621 bp, Homo sapiens
  misc_feature: GYAE6OF02GWF49.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacggccctaggtactgataggaaggttaacagtgagtggcagaccacgacgaagggggacggactccgtgtacgttcggttttcgacgggtccagtcgtcgtggggctggacgccgtcctaccctcaccctatccctaccgaccgtccctaccgacgttccgtaggaacggtagtcgggtaacgtccgttacgtaactttacgttacgtagtaccacggtaccgtaggggtacctacggttggttagttgggtttacgggtttcgggacgggtacggtaccgaaggtccgttacggtaccgttacgttaacgggtaccgaccggtaacggtcccgtaccggtcccccgttggtacccg

SEQ ID NO: 88355 - DNA, 678 bp, Homo sapiens
  misc_feature: GYAE6OF02FI0WT.33.28.C06.1.454.CMB.1.raw
tcagtacacacactcacgaccggtgctcgatttagagctcacgtattgggtttggggatgctttctgagagtcatggatctcatgtgcaagaaactgaagcacctgtgttcttcctcctgctgtggcggttctcccagatggtcctgtcccagctgcagctgcaggagtcgggcccgggactggtgaacgcccttcggagaccccctgtcccctcacccttgccactgtcctctggtcggctccgatcagcagagtcttactacgtgggcttggactccgcccacgccccccgagtacggggctggagtggtagttggaatatctagttataggtgggagcgagtcctaaccgtacctaaccccgtcccgtacgaacggtacgtcgacgttccaaccgtacttactaccttacgacctaccgtaccaaacgtacccacgtttcctaccccgtagaacgtccgtacgtacccgtccgtacggtccgacccgcccgtacgaccgtaccgtaccggtcgttagttacttacgttacgtagtacgacgtaacgtacgtaacggtaaccggggtagtaccgggtagttacggttacggttaccggggacccgaacggggtaaccccgttgggtaaccctacccggtccgtacccgtccgacgtaccccgtacccgaaccccgg

SEQ ID NO: 88356 - DNA, 635 bp, Homo sapiens
  misc_feature: GYAE6OF02IK6YN.33.28.C06.1.454.CMB.1.raw
  modified_base (403)..(403): a, c, t, g, unknown or other
  misc_feature (403)..(403): n is a, c, g, or t
tcagtacacacactcacgaccggtgctcgatttagagctcacgtattggggtttgggggagctctggggagtctgcaccatggcttggaccccactcctcttcctcaccctcctcctccactgcacagggtctctctcccagcttgtgctgactcaatcgccctctgcctctgccctccctgggacgcctcggtcaagctcatctgcactctgagcaggtgggcacacgcaactacgccatcgcatggcatcagcagcagccagagaacggtccctcggtacttgagtaggaaggttaacagtgagtcggacgacgaccaacgaaccgggaacgggggacggtactccgtgtacgtttccgtttacgcggtcagtcgtcggtcgggctggacgcgtacctacnccactctcacgacgtctcacgtcgaggaggtactggcgtctacgtaacttattcgtacgtacgtcgtaccggtacgggtacttacggtttaggtttacggttcggggttttacgggtttaccggggacgggtaaccgggtaacccgcggtaccggttaccgggtacccgttcggtaacgggtccgaaccggtcccggtaacggcccggttccccgtacccccggttacccgg

SEQ ID NO: 88357 - DNA, 646 bp, Homo sapiens
  misc_feature: GYAE6OF02HJOOK.33.28.C06.1.454.CMB.1.raw
  modified_base (336)..(336): a, c, t, g, unknown or other
  misc_feature (336)..(336): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtgctccatccagcagaagttctttactacgtggggctggactccgccacgcccccgaggggaacgggcgtggagtggacgttgggaatatcttattagtaggtgggancgagtctaaccgtaccaaccccggtccctacaacgtagtacgtagtaccacaatactaccgttagaccacgtaccaagaacctagttcctacccgtagaacgtctacgccttcgtcgtcggacccgcgacacgacaccggtcttagtaacttacgttacgtggtcgacgtaacgaacggtaacggtaaccgggggtattaccggggagttacggttacgggttcgggggaccctaacgggggtaaccccttcgggtacccgtacccggtttcccgacccgttcgacccggtccctacccggtaaccccgg

SEQ ID NO: 88358 - DNA, 611 bp, Homo sapiens
  misc_feature: GYAE6OF02F6OM2.33.28.C06.1.454.CMB.1.raw
  modified_base (214)..(214): a, c, t, g, unknown or other
  misc_feature (214)..(214): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccctcccgtgggagcctcggtcaagctcatctgcactctgancagtgggcacagcaactacgccatcgcatggcatcagcagcagccagacgacggccctcggtactgataggtaaggttaacagtgagtggcacgaccacgacggaacggggacggactccgtgacttcgtttcgaggtcacggtcgtcggtgggtcgtaggacggtccgtacgtaccctcaaccgtcgtcctcccgaccgtcctcccgtagtccgtaggacggttagcggaggtcctagtaccttagttaccgtgtacgacggtaccggttgggacttacggttggttagttcgggtttacgggttcgggacgggaacgggtacgacgggtccgttacgggtacccgttaccgtcggtaccggacgcccggaaggtcccgtccggaccccgttccgg

SEQ ID NO: 88359 - DNA, 181 bp, Homo sapiens
  misc_feature: GYAE6OF02GTI4N.33.28.C06.1.454.CMB.1.raw
  modified_base (174)..(181): a, c, t, g, unknown or other
  misc_feature (174)..(181): n is a, c, g, or t
tcagtacacacactcacgaccggtgctcgatttagagctcacgtattgggtttgggggaagaggaagactgacggtccccccaggagttcaggtgctgggcacagcggccctgggctgcctggtcaaggactacttccagtgtgtgtactgagcgggctggcaaggcgcatagnnnnnnnn

SEQ ID NO: 88360 - DNA, 776 bp, Homo sapiens
  misc_feature: GYAE6OF02HTGER.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccctcccgtggggagccgtcggtcaagctcactctgcactctgagcgaggtgggcaacgacgaccaaaccgtaccgaccacgtcgacagtcggcatacgagacagacaccgccgaaggaacgggaacgggccccgttacggtacgttagaagtacggaaaggttaaccgagtaggtagtggacacggaccgaacggaaccggaaaggggggacggtacgtacccgtaggtaactttcggtttttacgaacgggttacctaggccgttacgggtcggggtcgtacggacgtcccggtaccgtaccgtacccaaccgtaccttacccgtacccgacgtcccgttaacccgaggttaccggttcggaagggtacgtcggtaggtccgttacgtaacttaacgtttacggtaccgtacgaaccgggtaccggttacgggccttaaccgtttagggtttacggttggggttttcggggttttaccgggacggggtaaacccggtaccggtaacggtccggttaaccgggacccgttaaccgggttaccgggtacccgaccgggtaaccccgaccggggtacccggttccccgtacccccggttaccggg

SEQ ID NO: 88361 - DNA, 615 bp, Homo sapiens
  misc_feature: GYAE6OF02IAPST.33.28.C06.1.454.CMB.1.raw
tcagtacacacactcacgaccggtgctcgatttagagctcacgtattgggtttggggggagctctggggagtctacaccatggcttggaccccactcctcttcctcaccctcctcctccactgcacagggtctctctccagcttgtgctgactcaatcgccctctgcctctcgcctccctgggacgcctcggtcaagctcatctgccactctgacgcgaggtcgggcacgagacaactacgccatcgcagtggcatcagcagcagacaggagacggtcctgtacttgagtaggtaacggtaacagtgagtggcacgcacgacggaagggggacgtactaccgtgtacgtttcggtttacgacgggtacacgcgttcgggtcggtcgtcggacggccgtaccgtaccctacacctactccgtaccacgtccctacgtacgtcgtaggacggtcgtacggacggtcgtacgtacttactacgtacgtacgacgtcggtcgggtctacgtttaggttagttggttcgggtttacgggacgggtacggacgtacggcgtaccggtacgtccggtacggtacgacggaccgacggtcccgtccggtaccccgtgtacccg

SEQ ID NO: 88362 - DNA, 858 bp, Homo sapiens
  misc_feature: GYAE6OF02I8MD2.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctcgcctctcgccctcccgtgggacgcctcggtcaagcctcatcgtgcctactcgtgacgcgaggtcgggactacgacgacctaaaccgtaccgaccctaagtccgactaagtcgggaccacttacgaacgaccgaacggaccacggacccgaagggaaccggtaaaccgggggtccccgtttaccgggtacgtttcggaaggttaggtaaacgggttaacaggtgtacgtcggaccgacgacccgaaccggaaccggggaaacggggggtaccggtaaccgttcccgtacggttacgtttaccggtttttacggtacgggtacccgtaacggtccgttacggggtcggggtccgtaggaccgtccggtaccttacccgtacctacccgtacgttcccgtaccgtaccgttacccgtaccgtacggttaccgtacgggacgggttacgtacgggtacggttaccgtacgttaacgtacgtttacgtacggttaccggtaccgggtaaccggttcggggtaccttacggtttacggttacgggtttacgggtttacggggtttccgggaacggggtttaccgggaaccggtacggttacccgggtaccggttaacccgggttaccggtaacgggtaccgtaacccgggtccccggttaaggtccccggttacccccggtacccggttaccccggg

SEQ ID NO: 88363 - DNA, 751 bp, Homo sapiens
  misc_feature: GYAE6OF02I44A4.33.28.C06.1.454.CMB.1.raw
tcagtacacacactcacgaccggtgctcgatttagagctcacgtattgggtttgggatgctttctgagagtcatggatctcatgtgcaagaaactgaagcacctgtggttcttcctcctgctggtggcggctcccagatgggtcctgtcccagctgcagctgcaggacggtccgggcccggatggtgaagtcccgttcggacgaccctcgtccctcacctgcactgtctcgtggtcgctccatcagcagtacgtcttacgtacgtcgggctggactcccgccgacgccccggagggaacgggtcgtgggaggtggtagttagggaaatacgtacgttaagttagtaggtacgggagacgtacgtctaaaccgtaacccgtaaccccggtaccttaacgaacggtacgtaccggtaacgttacctaaccgtaattaccttaccgttaaacgacccgtaaccgtaaccgtaaaccgtaaaccgttaccgtttacccgtacccgtaacgtaacgtccgttacgtacccgttaccgtcggtaccggacccgccgtaccgtaacgaacccggaccggtacttacgttaacttacgttacgtcgtacgacggtaacgtaaacgtacggtaaaccggggagttccgggtagttcgggttacggttaccggggaacccggttaacggggtaacccgttccggttaacccgtaccgttccgttacccgtacggacccgtacccgtacccgtaaccccggg

SEQ ID NO: 88364 - DNA, 667 bp, Homo sapiens
  misc_feature: GYAE6OF02ICKT1.33.28.C06.1.454.CMB.1.raw
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctcgccctcccgtgggacgcctcggtcaagcctcatctgcactctgacgcgaggtggcacgagaccaactaccgccatccgcatggacatcagcagcacgccgagacggaacggtcctcggtacttgagtaggaagttacgngtgagngcacgaccacgaaccggaaggggacgactccgtgtacttcggtttacgacggtcacgtcgtcgtggggtctggacgccgtacctacctacctaaccctacttcctacccgtacgtccctaccgtacgttcgtagggaacggtacgtacggacggtacgttactaacgttacgttacgtacgtacgaccggtaccggttacggggtaccttaacgggtttgggttacggtttgggtttacggggtttaccgggacgggtaaccgggtaccggtaacggtccgttaccggtacccggttaccgtacggtccgaaccggtacccgtacggtccgtaccccgtcccgtacccgg

SEQ ID NO: 88365 - DNA, 624 bp, Homo sapiens
  misc_feature: GYAE6OF02GWNVD.33.28.C06.1.454.CMB.1.raw
  modified_base (315)..(315): a, c, t, g, unknown or other
  misc_feature (315)..(315): n is a, c, g, or t
  modified_base (409)..(409): a, c, t, g, unknown or other
  misc_feature (409)..(409): n is a, c, g, or t
  modified_base (498)..(498): a, c, t, g, unknown or other
  misc_feature (498)..(498): n is a, c, g, or t
tcagtacacacactcacgaccggtgctcgatttagagctcacgtattggggtttgggggagctctggggagtctgcaccatggcttggacccccactcctcttcctcacccctcctcctccactgcacagggtctctctcccagcttgtgctgactcaatcgccctctgccctctgccctcccgtgggacgccctcggtcaagctcatctgcactctgagcaggtggcacagcaactacgccatcgcagtggcatcagcagcagaccagagacgggccctcggtacttgataggaaggttaacagtgagtggacngacccaacgacggaaaggggggaccggactacccgtagtagttccgttttacgagggtccaggtctacggtggggcgtggacgcgtacctaccnccacctactacctccgacgtccctacctacggtctaggaggtcgtagggacgtccgtagtaccttaattcgtcgtaccgacggtacggngggtaccttagttagggtttctgggtttaccgggttcgggacgggtacggaaccgtagggtccgtacggtcccgttacggtcggtaccgccggaccgttacggacctccccgggtacccctccggg

SEQ ID NO: 88366 - DNA, 778 bp, Homo sapiens
  misc_feature: GYAE6OF02JZY9A.33.28.C06.1.454.CMB.1.raw
  modified_base (136)..(136): a, c, t, g, unknown or other
  misc_feature (136)..(136): n is a, c, g, or t
  modified_base (153)..(153): a, c, t, g, unknown or other
  misc_feature (153)..(153): n is a, c, g, or t
  modified_base (658)..(658): a, c, t, g, unknown or other
  misc_feature (658)..(658): n is a, c, g, or t
  modified_base (675)..(675): a, c, t, g, unknown or other
  misc_feature (675)..(675): n is a, c, g, or t
  modified_base (760)..(760): a, c, t, g, unknown or other
  misc_feature (760)..(760): n is a, c, g, or t
tcagtacacacactcacgaccggtgctcgatttagagctcacgtattgggtttggggatgctttctgagagtcatggatctcatgtgcaagaaactgaagcacctgtggttcttcctctgctggtggcgctccagntgggtcctcgtcccagntgcagctgcgaggacggtccgggcccgggtatgggtcgaacgtccgttcgggactacccctgtcccctcgacctgactctgtcctcgtggtaccgcctccatcgagcgtagtaacgttcctttacgtacggtcgggtactaggtacctccccggacccgaccggacccccgggaaggggtaacggggtcgtaggggtacggttagggtaacgtttaacggggtaactttacgttaccggtttaaagttttacgggtaagggttacggggtacggtaaccgtacgggttaaccttaaaccccggtaacccgtaaaccccccggttcctaacgggtaaacggtacggtaacccggtacgtaaccctaaccgtaaactttacccggtaaccgttaacgacccgtaacccgttaaaccgtaaccgtaacccggttccggtttacccctaccgtaagaccgtaccgtacgtacctcgtacgtacccgccgtacgccgtaagccgtacgtnttacgtacttagtacgngtacggacaggtaaccgacgggtaacgggtgtacgtggttacgtacgggtcgacggtacggtccgtcgtacgtccgcctaccgtnaccgtcccacgtacccgg

SEQ ID NO: 88367 - DNA, 866 bp, Homo sapiens
  misc_feature: GYAE6OF02IKAWJ.33.28.C06.1.454.CMB.1.raw
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
tcagtacacacactcacgaccggtgctcgatttagagctcacgtattggggtttgggggagctctggggagtctgcaccatggcttggaccccactcctcttcctcaccctcctcctccactgcacagggtctctctcccagccttgtgctgactcaatcgccctntgcctctgccctcccgtggggacnccttcggtcaagccttcatctgccacttctaggacgcgaggtcgggaccaacgacgaccaaaccgtaccggccaagtccggacagttcgggacctacgtaccgacgcacggccgaacgacccgaagggaacggaaccggggtcccccttacgggtttaaccgttacggaagttaacgggtaaaaggtttaaaccgaaggttcggaaacgttcgggaccaaccggaacccgtaaccgggaaacccgggtaaacgggggggaacccggggtaccttacccccgggttaaggtttaccggttttacccggttttttaccggaaccggggtttacccgtacgggtcccggttacggggttacgggggtcgttacgggtaaccggtcccggtacccttaccccgtaccgaaccccttacgtccccgtacccgtaccggttccccttaccgtaggttacccgtagggaacggttaacgttgggacggttcctaacgttaacgtacgtttaacgtcggtaacggtaccggtaccgggtcgggtacttacggtttgggtttacgttacgggtttcgggtttccggggacgggtacgggtaccgtaaggtccgtaccgggtaccgtaccggttacggtaccgtaccgggacccgtaccggtcccgtacccggtccccgttaccgg

SEQ ID NO: 88368 - DNA, 715 bp, Homo sapiens
  misc_feature: GYAE6OF02IFVT6.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtcgggcacgagcaactacgccattcgacatcggcatcagcagcagcagagaacggcctggtacttgagtagaacggtacagtgatggacagaccacgacggaggggacggactcccgtgtacttcgttttcgacgggtacctacgtcgttcgtcggggtcctacggtacgtccgtccgtaaccgttccaacccgtacttaccctacccgacgtcccgttacccgtacggttcccttagggtaacgggtacgttagggtacgggtaccgttacggtaaccttaacgtttacgtaccgttaccgtaacggtcccgggttacgggtaccttaccgggttaacggtttacgttcgggttttagggttttacccgggaccggggtaacgggttaacccggtaaggtcccggttacgggttaaccccggttaccggttaccggttaccgacccgggttaacccggtaacgggttacccgtccccggtaccccccggttacccggg

SEQ ID NO: 88369 - DNA, 761 bp, Homo sapiens
  misc_feature: GYAE6OF02GSSFU.33.28.C06.1.454.CMB.1.raw
  modified_base (250)..(250): a, c, t, g, unknown or other
  misc_feature (250)..(250): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccctccctgggagcctcggtcaagctcatctgcactctgagcagtggcacagcaactacgccatcgcagtggcatcancagcagccagagaacgggccctaggtacttgacgtaggaaacggttaacagttgagtcggcgacgaccaacgaaccggaacgggggaccggtactcccgtagtacgttcgttttacgacggtaccgtagtccgtacggtcggggcgtcggacggtccgtaccctacccgtaccgtaaccctaacgttcccgtacccgacggttacccctacccggttaacggttaccggtaacgggaacgggtaacgtcgggtaccgggtccgttaaacggttacctttaaccgtttacgttaccggtaccgtaacggggtacccggttacgggggtaccgttacggttttagggtttacgttttcggggtttcggggtttacccggggacgggttaccgggtaacccgtaaccgggttcccggtaaccggttaccccgggttaaccggttaccgggttacccgacccggtacccggtaaaccgggtccccggtttccccggacccccggtttaccccggg

SEQ ID NO: 88370 - DNA, 586 bp, Homo sapiens
  misc_feature: GYAE6OF02HY141.33.28.C06.1.454.CMB.1.raw
  modified_base (185)..(185): a, c, t, g, unknown or other
  misc_feature (185)..(185): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggacncctcggtacaagcctcatctgcactctgagcaggtggcacagcaactcgccatcgcatggcatcagcagcacgccagacggacggcctcggtacttgagtaggaaggttaacagtgagtggcagccaacgaccggaaggggcgactccgtagtacttcggtttcgacggtcagtctcggtgggctgacgccgtacctacctcacctactccgtccacgtcccttaccgaggttccgtaggacggtacgtggtacggcttacgaacgttacgttacgtacgtaccgacggtaccggtcgggtactacgttcggttagttcggttcgggttcggacggtacggaccaggtcgtacgtaccggtcgtacgtcgacggtacccgtaaggccctccggcccgtacg

SEQ ID NO: 88371 - DNA, 723 bp, Homo sapiens
  misc_feature: GYAE6OF02JTJ2M.33.28.C06.1.454.CMB.1.raw
  modified_base (209)..(209): a, c, t, g, unknown or other
  misc_feature (209)..(209): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccgagatgggtcctgtcccagctgcagctgcaggagtcgggcccggatggtgaagccttggagaccctgtccctnacctgcactgtctcgtggtgctccatccagcagagtcttacacgtgggctggactccgccaacggcccccgaggggaacgggcgtgggacggtggagttagggaattagtacttattagtaggtgggaagcgaagtcctaactaccgaaaccccgtcctacgaaacggtacgtacggacgtaccaacgtattaactaccgttacgaaccgtaaccgttacccaaaccgtaaccctaacggtttccccgtacccgtagtaaaccgtcctaaccgcccttaccgttacggtaccggtaacccgtaccggaccaaccggtaccgaccggtaccgttacgttaacgttaactttaaccgtcggttacgacccggtaaagtaccgtaaacggtaaccgggggacttacgggtacgttacgggttaacggttacggggacccggtaacgggtaacccgttcggttaaccggtaacccgttccgtaccctaccggtccgtacccgtacccccgaaacccgg

SEQ ID NO: 88372 - DNA, 765 bp, Homo sapiens
  misc_feature: GYAE6OF02I7W7I.33.28.C06.1.454.CMB.1.raw
  modified_base (239)..(239): a, c, t, g, unknown or other
  misc_feature (239)..(239): n is a, c, g, or t
  modified_base (623)..(623): a, c, t, g, unknown or other
  misc_feature (623)..(623): n is a, c, g, or t
  modified_base (704)..(704): a, c, t, g, unknown or other
  misc_feature (704)..(704): n is a, c, g, or t
  modified_base (714)..(714): a, c, t, g, unknown or other
  misc_feature (714)..(714): n is a, c, g, or t
tcagtacacacactcacgaccggtgctcgatttagagctcacgtattggggtttgggggagctctggggagtctgcaccatggcttggaccccactcctcttcctcaccctcctcctccactgcacgagggtctctctcccagcttgtcgctgactcaacgtcgccctctgccttctcgcccttcccgtgggggactccgttcgggtcaacgtctcgactctcgactacttctaggacncgtacgggtcgggaccaacgacggacctaaacctacgcctatccgcgaagtcggacactaccgacgtaccgaggacctacggacccgaagggtaaccggaccggggtacccgttacgggttaacgtacggttaacggtaacggttaaagggttaaactaagggtacgtaacgggtacggaccacgggaacccgaaaccgggaaaccgggggtaaccgggggaacgggttaccttacccggtacgggtttaaacgtttccgtttttacggaaccgggtacgtacgggtccgttacgggtcggggtcgtagtacggtccgtactaccctacgtactaccgtccctacgccgtccctacgacgttcggaggtacgtgtcggtacgtntacggtactacgttcgacgttcacggtaggtccggacttacggtttgtggttcggttacggttacgggacgtacggtaccngggttaaccncgttaccggtccgtacgtcgacgtacccgtcgtaccgttccgccgttacgg

SEQ ID NO: 88373 - DNA, 746 bp, Homo sapiens
  misc_feature: GYAE6OF02HR12G.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctcgcctctgccctcccgtggggacgcctcggtcaagcctcatctgccactctgagcaggtgggacacagaccaaacgtacgccatcgcaagtggcactcacgacagcagccgaggaacggaacggtccctcggtacttagagtagaaacggttaacaggtgagtcggacacgaccgaacgaaccgggaaacgggggaccggactacccgtagttacgtttcggttttacgaagggtccaggtacgtcggtcggggcgtacggacggtccgtacctacctacctaccctaagttccctaccgacggtaccctaccgtacggttccgtaaggtaagggtacgttacggacgggttacttaacggttaacttttaaacgtttacgttacgggtaaccgaaaccgggtacccggtacgggggtactttaaccggggtttgggtttaaggttcggggttttacgggggtttaccggggacggggtaaccgggtaccgtaaggtacccgttacgggtaacccggttaccgtacgggtaccgtaaccggaacccggaacgggtcccgttaccccggtccccgttaccgg

SEQ ID NO: 88374 - DNA, 680 bp, Homo sapiens
  misc_feature: GYAE6OF02HDV5I.33.28.C06.1.454.CMB.1.raw
tcagtacacacactcacgaccggtgctcgatttagagctcacgtattggggtttgggggagctctggggagtctgcaccatggcttggaccccactcctcttcctcaccctcctcctccactgcacagggtctctctcccagcttgtgctgactcaatcgccctctcgcctctcgccctccctggggacgcccgtcggtcaacgctcatctgcactctgacgcaggtgggcacgacgacaactaccgccactcgcagtcggcatcagcagcagcgagaggacggcctggtactgagtagaaggtacaggtgagtcggacacgccaacgaaccgggaagggggacggactccgtggtacttacggttttacgacgggtacacgtcgtcggtcgggtacgtggacgtccgacctacccgtcctaccgtacttccgtacccgtactcccgtaccgtacgttcggtaggaaggtaacgtcgggtacggttcgtacgttaaccgttaacgttcgtacgttaccggacgggtaccgggtacggggtacctaaggtttacgggtttaggttacgggtttcggggtttacgggacggggtaacggtaccggaacggtcgtaccgggtaaccgttccggtacggtaccgaccggtaccggaacgtcccggttcccggtccccgttacgg

SEQ ID NO: 88375 - DNA, 683 bp, Homo sapiens
  misc_feature: GYAE6OF02IBVYB.33.28.C06.1.454.CMB.1.raw
  modified_base (292)..(292): a, c, t, g, unknown or other
  misc_feature (292)..(292): n is a, c, g, or t
  modified_base (328)..(328): a, c, t, g, unknown or other
  misc_feature (328)..(328): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctcccgtgggacgccgtcggtcaagctcatctgcactctgagcagtgggcacagacaactacgccatcgcagtggcatcagcagcagcagagaacggcctggtactgatgaaggttacngtgatggcagccacgacgaagggggacgactcccgngtattcgtttacgacggtcacgtctcgtggggctaggcgtcggtcctacccgtcgtaacccgtacgtacctcccgaacggtccctaccgtaaggttccgtaacggcggtaaacgttcggacgggtactttaggtaaccctttaagtttccgtcggttaacggccggtaaccgggttcggggtacttaacgttcggggttttaacgtggggttttaccggggtttaccgggacgggggtaaccgggtacccgaaagggttcccgtaacgggttaacccccgggttcgtaacgggttcccgaaacgggtcccccgttaacggggtcccgttacccccgggtacccccctttacgggg

SEQ ID NO: 88376 - DNA, 705 bp, Homo sapiens
  misc_feature: GYAE6OF02JXMY4.33.28.C06.1.454.CMB.1.raw
  modified_base (272)..(272): a, c, t, g, unknown or other
  misc_feature (272)..(272): n is a, c, g, or t
tcagtacacacactcacgaccggtgctcgatttagagctcacgtattgggtttggggatgctttctgagagtcatggatctcatgtgcaagaaactgaagcactgtgttcttctctgctggtggcggctcccagagtgggtcctgtcccagctgcagctgcgaggacggtccgggcccggactggtagacgtccgttcggagaccctcgtccctcactgcctactgtctcgtagtcgcttcatcagcagtaacttctttaacgacgttgggntcggacctccgccgaccgccccggagggacgggcgtagggcgtaggtagtacggtaattgtacgttaagttagtaggtgggaactacgtacgtctaaccgtaacccgtaccccgtacccgttcgaaacggtacggtacccgagtaacccgaaccgtaattacggttaccctaaggaccaaccggttacaaaaccggtcctacgtttccaacccgtagtaacgcttacaccgttctacgtaccggtaacccgccgtacgaacggacgacggtaccgttatacttacgtcgtggacgacgtaaacgtaccgtaacgggttaaccgggtaacgtgggtaagttcggttaggttccggggaacccgttagggttaaccctcgggtacccgtaccgttaccgtaccgtaccgtacccgttcccgtaaccggtacccgg

SEQ ID NO: 88377 - DNA, 648 bp, Homo sapiens
  misc_feature: GYAE6OF02GKDNA.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctgcctctcgcctcccgtgggacgcctcggtcaagctcatctgcactctgagctaggtggcacagacaactaccgccatcgcagtggcatcagcagcacgccaaggacggaacggccctacggtactgagtaggaaggttaacgagtgagtggcagccgaacgaccggaagggggaccgtacgtccgtgtacttcgttttacgacggtccgagtcgtcggtgggtctaggcgcgtacctaccgtacacctcgtacctcccgacgtccctaccgtacgtcgtaggaggtactggacggtctacgtacgtttactacgttcggtaactacgggaccggttgggtaccttacggttcggtttacggttcgggtttaccgggtttacgggcggggtaacggtaacccgtaggtaccggtaccggtacccggttacgtacggtaccgaccggtacccgaacggtcccgtacccggtccccgttacccgg

SEQ ID NO: 88378 - DNA, 850 bp, Homo sapiens
  misc_feature: GYAE6OF02H6VG4.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggcctcccagagtgggtcctcgtcccagctgcagctgcgaggacggtccgggcccgggacgtggtagaacgtccgttcggacgtaccctcgtccctcacctgcctacgtgtctcgtggtcgctcatcagacagtacgttctttacgtacggtgggtctggacctcccgaccgaccgaccccggaaggggacgggcgtaggacggttaggtagttagggaattatacgttaagttaagtagggagggacgcgtacgtacctaaccgtaacccgtaacccccgttaccgtacgtaacggtacggtacgaacgttacccaaccttaattaaccgtttaccgttaaacgaccgtaaccccgttaaccgtaaaaccggtaaccctttacggtttaccccgtaacccgtaacggtaaaccgttccgttaccgtaaccccgtttcggtacggttacccggaccccggtacccggaaccgtaaacgggacccgtaacgggttaccttagtttaaaccgtttacgttacggtacggtacggaaccggtaaacgtaaccggtaaacggggttaaaccggggtacgggttaacggtacgggtttaacggttacggggttaccgggggaacccgttaaaccggggtaaccccgtttccgggtaacccgttacccggttaccgttacccgttaacccggtacccgttacccccgtaacccggtaaaccccgggg

SEQ ID NO: 88379 - DNA, 740 bp, Homo sapiens
  misc_feature: GYAE6OF02GNKS7.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccctcccgtgggacgcctcggtcaagctcatctgcactctgagcagtgggcacagcaactcgccatcgcatggcatcagcagcagccagaacggaacggtccctagggtacttaggaactaggtaaaggttaaccaggtacgtagtaggacgaacgacccaaccggaaccggaaaggggggtaccggtaactacccgtagtacgtttcggttttacggacggtacaacggtcgttcggtgggtactggaccgtcgtctacccgtccaacgtaccttccgtcccgtacgtacccgtaccgacgttccggtaggaacggttaagtcgggtaacggtacctaggtaaccgtttaaagttccggttaacgtccggtaacgggtacccgggtcgggggtacctttaacggttaacgggtttaacggttcggtttcggggtttaccgggtacgggtaaccgggtaaaccggtaacgggtaccgttacccgggtaacccggttaacggttaccggaaccgtaacccggacccgggtaacggtaccccggtttccccggacccccggtttaccggg

SEQ ID NO: 88380 - DNA, 758 bp, Homo sapiens
  misc_feature: GYAE6OF02HN5RJ.33.28.C06.1.454.CMB.1.raw
  modified_base (132)..(132): a, c, t, g, unknown or other
  misc_feature (132)..(132): n is a, c, g, or t
  modified_base (243)..(243): a, c, t, g, unknown or other
  misc_feature (243)..(243): n is a, c, g, or t
tcagtacacacactcacgaccggtgctcgatttagagctcacgtattgggtttggggatgctttctgagagtcatggatctcatgtgcaagaaactgaagcactgtgttctcctctgctggtgcgctccagntggtcctgtcccagctgacagctgcgaggcggtccgggcccggtagtggtagacgtccgttggacgtaccctcgtccctcgacctgacctctcgtctcgtggtcgcctcancgagacagtacgtctttacgacgtgggctaggtcctccggacccacggacccccggtaaggggtacggggtcgtacgggtaggtacggaaggttagggtaattacgtaccgttagttaacgggtagggtagggtacgacgtaacggtaccttaacctaacccggtaccccgtaccttaacgaacggtccgtaacggtactaaccgtactaagttacttaccggttaacgaaccgtaaccgtaccaaccgtaaccgttacgtttacccctcggtaacgtacgcttacggttacctgtaccggtaccgacccggtcaccgtacgaacccttaccgggacttaagttaacccgttagtttccgtagggtccgtacggtaaaccgacgggtaaacggttaacggggtacgttgggtacggttggttaaccgggtccggggaacggtacccgggtaccggttacccgtaccgtaccgttaccgtaccctaccgggcccgtaccgtaccccggaaacccgg

SEQ ID NO: 88381 - DNA, 655 bp, Homo sapiens
  misc_feature: GYAE6OF02GMLVW.33.28.C06.1.454.CMB.1.raw
  modified_base (187)..(187): a, c, t, g, unknown or other
  misc_feature (187)..(187): n is a, c, g, or t
  modified_base (253)..(253): a, c, t, g, unknown or other
  misc_feature (253)..(253): n is a, c, g, or t
tcagtacacacactcacgaccggtgctcgatttagagctcacgtattgggtttgggggagctctggggagtctgcaccatggcttggaccccactcctcttcctcacccctcctcctccactgcacagggtctctctcccagcttgtgctgactcaatcgccctctgcctctgccctccctgggacncctcggtcaagcctcatctgccactctgagcaggtggcacagcaacgtcgcatcgcagtggcatcngacagcacgccagaggaacggccctggtacttgagtgaaggttacagtgagtcgacgacgaccacgaccggaagggggaccgactcccgtagtacttcgtttacgacggtaccagtcgtcggtcgggctaggacgccgtctaccgtaccactctcctccgacgtcccgtaccgtacgttccgacgggtagtacgtacgggacggtacgttaacgtaatttaccgttacgtacggtaccgaaccgggtcggtacgggacgtttaccgttggttaactttcggggtttacgggtcgggtacggggaaccgggtacgaacggttccggtacccggtaccggttaccgtacggtcccggaacgggtaccccgtaacgggtcccgttccccggtccccgttaccggg

SEQ ID NO: 88382 - DNA, 776 bp, Homo sapiens
  misc_feature: GYAE6OF02IFU2E.33.28.C06.1.454.CMB.1.raw
  modified_base (187)..(187): a, c, t, g, unknown or other
  misc_feature (187)..(187): n is a, c, g, or t
  modified_base (269)..(269): a, c, t, g, unknown or other
  misc_feature (269)..(269): n is a, c, g, or t
tcagtacacacactcacgaccggtgctcgatttagagctcacgtattgggtttgggggagctctggggagtctgcaccatggcttggaccccatcctcttcctcaccctcctcctccactgcacaggtctctctccagtcttgtgctgactcaagtccgccctctgcctctcgccctccgtgggacncccgttcggacaagccttcacttcgtgcctacttcgagagcgaggtgggaccaacgagtccaaacgtaccgccaagtccganagtcggctacgtcgagccgaagaccgagaccgaggaacgggaacgggtcccgttacggtacttgaagtaggtaaaacgttacgaggtagtacggtgaccgaacgaccgaaccggaaccgggaaaggggggtaccggaaccgttcccgttaggttacgttacggttttacggaacggtaccgtacgtcgttacgggtgggtacgacggtacggtccgtaccgtaaccgtcctaaccgtaccgttcctcccgaaccgttcccgtaccggtaaccggtcgtacgggttaacggagttaacgggccgtacgttaacgtaacgttaccgttagttacggtacgtaccgtaccgggtacgggtaccgttaccgggttaaggtttcggttacgggtttcgggtttaccggggacgggttaacgggacccgtaaacgggccgttaccggtaaccgttccggttaacggtcggaacccgtaccgtaaccggtcccgtacccgtaccccgttcccgg

SEQ ID NO: 88383 - DNA, 706 bp, Homo sapiens
  misc_feature: GYAE6OF02I33ZK.33.28.C06.1.454.CMB.1.raw
  modified_base (254)..(254): a, c, t, g, unknown or other
  misc_feature (254)..(254): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtccggggcccgggacgtggtgaacgtccgttcgggaacgaccccttcgttcccctcacctgcactgtctctggtgcctccatcancaagacgttctttacgacgtgggctaggactcccgaccaccggccccgaaggggacggcgtgggagtggagttggaatntctaattagnggtaggacngatctacctaaccgaaccccgtactacgaacgagtaccgaagtacctaactatactaccgttaagaccacgtaccaacgtaaccgtacgttacctacccgtagaacgtcctaacgtccgtacttacggcgtacccgacgacgtaacgaccgtacggaccgttagtaactacgtttacgaggtacgacgtaacgtaaccgtaaacggttaaccggggacgttacgggtacggttaacggtttaacggggtccgggggaaccccgtaaggggggtaaaccccgttggggtaacccttacccgggtttaccgtccccgttcgaaccccggttaccccgttaaccccggaaccccggg

SEQ ID NO: 88384 - DNA, 718 bp, Homo sapiens
  misc_feature: GYAE6OF02H6UBU.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctcgcctcccgtgggacgcctcggtcaagctcatctgcactctgagcaggtggcagagccaactacgccatcgcagtcggacatcagacagcgacgccgagaacggaacgggccctcggtacgttgagtaggaaggtttaacaggtgagtggcagccaacgacggaacggggacgacgtcccgtagtacgttcgttttacgacggttccagtccgtacgtcggggtctacggacgtccgtaccgtaacccgtcgaccctaacttccgacccgtacgtcccgtaccgtacgtacgtacggaacggttacgtacggaacggttcgttacgtaacttaacgtttccgtagtaaccgtacgggttacccggtcggggtaccttaaacgggtttgggtttacggttacgggttttcggggtttacccggggacggggttaacggggtaacccgtacgggttacccggttaccggtaaccccggtttacccggtacggttacggacccggtacccggaaccggtcccgttacccccgggtcccccgttacccggg

SEQ ID NO: 88385 - DNA, 553 bp, Homo sapiens
  misc_feature: GYAE6OF02FW1S4.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagcagagaacgggccctcggtacttgataggaaggttaacagtgatggcagccacgaccgaagggggacggatcccgtgacttcgttttacgagggtccagtctcgtgggctggacgcgctacctcaccatcctccacgccctccgagtccgtaggaggtagtggaggtctagacttattactgtcagtaccgtggggctagttggttagttggttcgggtttcggcgggtacggaccgtaaggtcgtcggtaccgttccgtaacggtccacggtacccgacggcctccgccccgtccgg

SEQ ID NO: 88386 - DNA, 804 bp, Homo sapiens
  misc_feature: GYAE6OF02GE7AC.33.28.C06.1.454.CMB.1.raw
  modified_base (538)..(538): a, c, t, g, unknown or other
  misc_feature (538)..(538): n is a, c, g, or t
tcagtacacacactcacgaccggtgctcgatttagagctcacgtattggggtttggggggagctctggggagtctgcaccatggcttggaccccactcctcttcctcaccctcctcctccactgcacagggtctctctcccagcttgtgctgactcaatccgccctctcgcctctcgtcccttcccgtggggacgtcccgtcgggtaccaaacgtcctcctacttccgtcgcctactccgtaggacggcggtacggtgggaccaacggacgtaccaaccgtacgcctagtcgctagcggactacgacgacgacacgacgacggaccgaaggaaccggtaaccgggtcccgttacgggttaacgttaggaacgtacgggtaaacgttaaccggaggttcggagtcggaccgaacgacccgaaacggaccggggtaacggggtccggtacgtccgttaggttaccgtttacggtttaccggacggtacgtacgtccgttcgggtgggtcgacgaccggtcgtaccgtaccgtaccgaccnccgtaccgtaccgtaccgtaccgtaccgtacgtacgtacggtaggtacgtggtaaaaaaaaaaacggtcgttacgtacttacgttacgttacgtacggtacggtaccggtacgggtacgtacggtttacggttcggtttacgggtttcgggttacgggtacgggtacggtacggtaccggtaccggttaccggtacccggtaccggtaccggtaccggtaccggtacccggtacccggtacccggtaccccggtcccggttacccg

SEQ ID NO: 88387 - DNA, 786 bp, Homo sapiens
  misc_feature: GYAE6OF02G9K4U.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctgcctctcgccctcccgtgggacgcctcggtcaagctacatctgctactcgtgagcgaggtcggcacgacgaccaacgtacgccatcgcagtgcacgtcgagacgagcacgaccgaggaacggtaacgggcccgttacggtacgttaggtacgtaaggtaaacggttaacgtaggtacggtaagtcgggaccgacgacccgaacccggaaccggggaacggggggtaccggtaaccttcccggtacgtttacggtttccggttttaccgtacgggtccgtaacggttccggtaggtcggggtacgtcggacgggtccgtaccgtacctcccaacctcgttaccctccgaccgtccctacgacggtcgtagggacggtgttacgggaacgtcgttaaccgtacgtttaacttacgttccgggtaacctacccggggtacccgggttacgggaccctttaacggggtttggttttaaccggttcggggtttttaccggggtttaccgggacgggggtttaacgacccgggttaaggttcccgtacggggttaccccgttacggtacccggtacgtaccccgggtaccggacggtcccccgttacccggtcccccgttaccggg

SEQ ID NO: 88388 - DNA, 845 bp, Homo sapiens
  misc_feature: GYAE6OF02JPOD8.33.28.C06.1.454.CMB.1.raw
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
tcagtacacacactcacgaccggtgctcgatttagagctcacgtattgggtttgggggagctctggggagtctgcaccatggcttggaccccactcctcttcctcaccctcctcctccactgcacaggtctctctcccagcttgtgctgactcaatccgccctctcgcctctgccctcccgtgggacgtcctcggtcaaggccttcatctgccnctcgtganctaggcggcacngcctaaccgtcgcatcgcacgtgacntcgacgcacgcacgcaggaggaacggtcccttcggtactgactagtaacggttacaggttcgagtcggccacgccaacggtaccggaaggggacgactccgtgttaaccgttcgttttacgaccgggtacgtacgtccggttcgtcgggggtaccgtacggacgggtaccctacgttaacccgttccgaacccgttaccgttttacccacccgggtaaccgtcccggtttaccgaaacggtttcccgtaaggggtaaccgggttacgttccccggggtaagggttacccggtaaacgttttaacccgttaaaccggtttttaaccccggtcggtttacccggaaacggggttttcccgggggtaacggggtaccttttaaaccggggggtttggttttttaacccgggtgggggttttttaaccgggttcccggggggttaccggggttaaacccggaaaccggtccggggttacgtttaacccgggggttaccccgttaaccgggtcccgggaacgggttttaaccccgggaccggttaaccccggggttaccgtttcccccgggtccccccggttttacgggg

SEQ ID NO: 88389 - DNA, 844 bp, Homo sapiens
  misc_feature: GYAE6OF02ILUXM.33.28.C06.1.454.CMB.1.raw
tcagtacacacactcacgaccggtgctcgatttagagctcacgtattggggtttgggggagctctggggagtctgcaccatggcttggaccccactcctcttcctcaccctcctcctccactgcacagggtctctctcccagtcttgtgctgactcaatccgccctctgcctctcgccctcccgtgggacgtcctcggtacaagcctcatctgcactctgagctagggtggacacagcgaactacgcatcgcagtcggacatacacgtacacgacgacgaccaagggacggtaaccgggtccccttacgggttaaccttggtaacgttaagggaaacggtttaaacgaggtaggtaagtcgggacgacggtacccaaccggaaccggggaaacgggggtaccggacgttaccccggtaggttaccgtttaccggtttttacggacgggtcccgtaacgtcggttaccgggtcggggtacgtcggtaacgtcccggtacccttaacccgtacgtaaccctcttaccccgtacccgacgtacccctacgtacgttccgtaaggaacgggtacgtaacgggtacggtcctaacggttaacctacgtttaaccgtcggtaacccgtaaccggtaccgggtcgggttaccttaaacgggtttcgggtttaaaggttccggggtttttaccggggttaacggggtaccggggtaacgggggtaacccgtaacggggttaccctttaaccggggtaaccccggtttaaccgtaaacccgggggttcccaaaccggggtaccccgggttaacggtaccccggttacccccgggttacccccggtttaaccgg

SEQ ID NO: 88390 - DNA, 646 bp, Homo sapiens
  misc_feature: GYAE6OF02G53S2.33.28.C06.1.454.CMB.1.raw
  modified_base (241)..(241): a, c, t, g, unknown or other
  misc_feature (241)..(241): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccaggactggtgaagccttcacacgaccctgtccctcacctgcactgtctctggtgctcatccacngtgttatcactactggacgctggactcccgccagccgacccgagggaacggccgtgggaggtggagtttcgggaactacgttacgttaacgttaccgggtgggacacctacccgtttacctaacccgtaaccccgttcccctaataacgttacggtaccgtacgtaccaacctacttcctacctaagttaccgaacctacgtactaaacgaacccgtacttccctcccgtaggtaacgtttcgaaccttcgttacgtacgtacgtcggacccggtaccggaccgacggttccgttagttacgtttacgtgtcggccgtactaacgttacgtaacgtacttacgttacggcggtactacgtaactccaactactaccgacgttagttcgtttctttagattaccgg

SEQ ID NO: 88391 - DNA, 768 bp, Homo sapiens
  misc_feature: GYAE6OF02F6ZB1.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtcgctgactcaatccgcccctctcgcctctcgcccttccccgtaggggacgcccgttcgggtccaagtctcattctgcactctagagcaggtcgggcaacgagtaccaaccgtacgcccaagtccgactaagtggcctactcagaccgaacgccgacgacccgaagaacgggaaaccgggcccccgttacgggttaaccgttaggaacgttacgggtaaaacggtttaaaccgtaggttaggtacggttggaacacgacccgaacccgaaccggggaaaccggggggaccggtaacgttaccccgttagtaccgttttaccggttttacggtaccgggtacctacggtcgttaccggtcggggtcgtacggtccggtaccggtaccctttacccgtaccctaccgtaccttcccgtacccgaccgtccccgtacgtacgtccgtacggtagtacgtagacggtacctagtacgttaattaccgtagtaccgtacggtaccggtcggacgttacgttggttacgttgggtttacgggttcggacgggacggtacgtacggtcgtaccggtacccgttcgtaacggtctaccggcccgaaccggtccgtcccgtcccgttaccgg

SEQ ID NO: 88392 - DNA, 489 bp, Homo sapiens
  misc_feature: GYAE6OF02ICCLP.33.28.C06.1.454.CMB.1.raw
  modified_base (146)..(146): a, c, t, g, unknown or other
  misc_feature (146)..(146): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (391)..(392): a, c, t, g, unknown or other
  misc_feature (391)..(392): n is a, c, g, or t
  modified_base (400)..(400): a, c, t, g, unknown or other
  misc_feature (400)..(400): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgngctgactcaatcgccctctgcctctcgccctcccgtggggagcctcggtacaagctcatctgcactctgagcagtggcacagcaaactcgccatcgcatggcatcagcagcagccagagaagggccctggacttgatgaagttaacagtgatggnagccanacgaaggggaggancctgattcgttttcaggtcagctcgtgggctgagcgnacgtcacatcncncncncacncngagngngngnngatatatnacgagacgcggcgagtgtagtgtcgttcggtgacggacggaacgacgacgtaccgtacgtacgacgacgacgacgtcgtccgtccgtcg

SEQ ID NO: 88393 - DNA, 607 bp, Homo sapiens
  misc_feature: GYAE6OF02GIQRI.33.28.C06.1.454.CMB.1.raw
  modified_base (140)..(140): a, c, t, g, unknown or other
  misc_feature (140)..(140): n is a, c, g, or t
  modified_base (188)..(188): a, c, t, g, unknown or other
  misc_feature (188)..(188): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
tcagtacacacactacacgaccggtgctcgatttagagctcacgtattgggtttggggatgcgtttctgagagtcatggatctcatgtgcaagaaactgaagcacctgtggttcttctcctgctggtggcggctcccagntgggtcctgtcccagctgcagctgcaggagtcgggcccggtactggtnaagccttcggacgaccctgtccctcaccctgccactgtctcgtggtcgctccatcagcaggacgttctttactacgtgggctggactccgccacgccccgagggacggctggngtgagttggatatctatatcgtggancagtctactaccacccgtcctacgaagtcgtcgagtcacctatactccttagaccgtacgtaccaacgaacctacgtttcctacctagaactcgtacgaccttcgtcgtccgacccgcgacacgaccgacggtctagttactacgttaccgtggtcgccgactaacgttacgacgtacgttacgttacggtacggtacccgtaattacccgttaccaacccttacgttacccgaacgttaccgttacgtttctttttaacggactttcggttacccgggg

SEQ ID NO: 88394 - DNA, 628 bp, Homo sapiens
  misc_feature: GYAE6OF02GHIUA.33.28.C06.1.454.CMB.1.raw
  modified_base (263)..(263): a, c, t, g, unknown or other
  misc_feature (263)..(263): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtggctccatcagcagagtcttactactggggctgntccgccagtccccccgagggaacggggctacgggagtggagttggggtaactatactattaagtaggtcgggaggcaggtactaactacgaaccccgtccctacaacggagtcgacgtcaccatactcctagaccacgtacccaagaacctacgttcctaccgtacgaagtctacgaccctcgttcgtcggtaacccgccgtacacgacaccgctagttatacgttacgtcgtgaccgtagtaacaggtaaaccggggtgtaccgggtagtcggtacggtcggggaccgtaacggggtacccccgttaggtcccgtaacccggttccgttaccccgtggtaccgtccccgtaccgtaaccccggg

SEQ ID NO: 88395 - DNA, 689 bp, Homo sapiens
  misc_feature: GYAE6OF02JL3KO.33.28.C06.1.454.CMB.1.raw
  modified_base (319)..(319): a, c, t, g, unknown or other
  misc_feature (319)..(319): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagtccttgtgctgactcaatccgccctctgcctctcgccctcccgtggggactccctcggtacaacgcctcactctcgccactcctagagccaggtcgggcacacgaccaactacgaccatcgcagtcggcatcagcagcagccagagacggtcctggtactagagtcggaaaggttacnggtagacgtaggacctacgcccgaacgtaaccggggtaggggacgacttcccgagtacgttaccgtttcggacgggttaccacggtcgtacggggcgggtactacgtaccgggcctccgtacccgtaccgtaccgtaacgttcccgaccgaccgtccgtaccgtacggtacccgttggaacgggttcgtacggacggttaccgtacggtaaccttacgttaccgtacggtacgtaacccggccgtaaccggggttccaagggtttccggttagttacggttcgggtttaccgggcgttaaccggacgttaccggcgttccggtaccgtacgtcggacgtaccgacgtacggtccctccgtacccggtccg

SEQ ID NO: 88396 - DNA, 759 bp, Homo sapiens
  misc_feature: GYAE6OF02F0892.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgcctctgcctctgcctccctgggagcctcggtcaagctcatctgccactcgtgggcaggtgggccacagcaaactacgccatcgcatcggcatcagacgacgaccacgccgaggaaggaacggggcccctcggtacttacggagttaggtaaaggttaacaggtacggatacggacgacgccaaccgaacgggaaacggggggaccggtacgtacccgtagtacgttacgttttacgacgggtccaggtctacggtcggggtcgtacggacggccgtaccgtaacctaccgaaccctacgttccaccgacgcccgttacctaacggtctagggaggtacgtacggacggttacgttacgtacctttaactttaacgtaccggttacgtaccggtaccgggtcggggtaccgttaaccggtttaggttttacggtggtttttacgggggtttaccgggtaaccggggttacggggaaacccgttacgggtaaccggttaccgggttaaccccggttaccgggttaacggtttacccggaacccgggttacccggaaaccgggtcccgtttaccccgggtacccccggttaccgttaccccgg

SEQ ID NO: 88397 - DNA, 743 bp, Homo sapiens
  misc_feature: GYAE6OF02HG26R.33.28.C06.1.454.CMB.1.raw
  modified_base (190)..(190): a, c, t, g, unknown or other
  misc_feature (190)..(190): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctgcctctcgccctcccgtggggacncctcggtacaacgcctcatcgtgactactcgtgacgcgaggtggacaactagaccaacgtaccgaccatcgacacgtcggacagtcgacgcacgcgacgccgaaggaacggaaccgggtcccgtacggttaccttaggtaacgtacggtaaacggttaacgtacggtagacgttacggacgaaccgaccgaaccggaaaccggggaacggggtaaccgggtacttacccggtagtaacgtttccggttttacgacgggtaccgcggtcgtcggtgggtacgtcggacgtcgtacctaccgtcgaacgtacttccgtaccgcgtaccgttacgacggttcgtaggacggtagtacggacgtacgtaacgtacttaaccgtcgtacgtacgtacggaccgttacgggtcgttacggttcggttacgttcgggttacgggtaccgggtacggaaccgggtacgtaaccggtccgtaaccgggtcccggttaacggttaccggtaccggaaccggtaaccgtaccggtccccggttacccggtcccggttaacccgg

SEQ ID NO: 88398 - DNA, 756 bp, Homo sapiens
  misc_feature: GYAE6OF02F43KQ.33.28.C06.1.454.CMB.1.raw
  modified_base (343)..(343): a, c, t, g, unknown or other
  misc_feature (343)..(343): n is a, c, g, or t
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcaggagtcgggcccggactggtgaagccttcggacgtaccctgtccctcacctgctactgtctcgtggtcgctccatcagcagagtctttactacgtgggctggactccgccacgcccccgaggggacgggcgttggacggtggtacgttagggaatagtacttagttagtaggtgggancgagtctaacctaccaacccgtcctacgaacgtagtacgacgtacaccgtatactaccgttaagaccaccgttaccgaaacgtaaaccgtaccgtttacgtacccctaggtaaccgtaccgttcgaacccgttcgttacggtaccggtaccccggccggttaccgaaccggaccgtaacccgggtgtttaacggttaaacttaaccgtttaacggtttcggtaccggtaccggtaaacgtaaccgtaaacgggttaacccggggttacgggttacgggttacgttacggggtttagggttacccggggtaacccggtaaccggggtaaaccccggttacgggttaaccgttaaccccgggtttcttaaccccggttaccgtacccggttccccgtaacccccgtaacccgggg

SEQ ID NO: 88399 - DNA, 744 bp, Homo sapiens
  misc_feature: GYAE6OF02G3K6U.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctgggtggcggcctccagatgggtcctgtcccagctgcagctgcagggcgtccgggcccggatgggtgaacgtccgttcgggacgtaccccttcgtcccctcacccgttgcctaccgtgtcctcgtggtcgtcctcctatcgacgctaaggtacgttcctttaccgtacggtcgggtactcggacctcccggacccaccgggaccccccggaagggggtacgggtcgtacggggtaggttacgggtaggttagggtaacttacgtacttaagttaggtagggtgggacgtacgtacgtacctacctaacccgtaacccgtcctacgaagtcggtacgactaccactattactaccgtacgacctactaccgaacgaccttaccgttcctacccgtagtacgtcctcgtaacctcgtacgtccgtaacccgcgtacgacgacgtaccggtcttacgttaattaccgttacgtcgtaccggtacgtaaccgtaacggtaaaccgggtaaaccggggtcgtaccgggtaggttacggtacgggaccggggtaaccggtaacccgggtacccgttcggtaccccgtccggttcctacccgtacgcccgttacccgaccgtacccggg

SEQ ID NO: 88400 - DNA, 859 bp, Homo sapiens
  misc_feature: GYAE6OF02GKVV8.33.28.C06.1.454.CMB.1.raw
  modified_base (408)..(408): a, c, t, g, unknown or other
  misc_feature (408)..(408): n is a, c, g, or t
tcagtacacacactcacgaccggtgctcgatttagagctcacgtattggggtttgggggagctcgtggggagtctgcaccatggcttcggaccccactcctcttcctcaccctcctcctccactgcacagggtctctctccagtcttgtgctgactcaatccgccctcgtcgccttcgtcgccctcccgtggggaccgccgttcggtacaacgtctactacttctcgacctactcgtaggacgcgtaggtcgggacaacgacgacctaaaccgtccgaccctagtccggacacggttcggcctaacgtacgacgtacgaacgaccgaacggacgaagggtaacgggaacccggggttccccgttacggttaacgttggaacgttaacggggtaaaacggtttaacggnggttagacggtacggtaccgaacgaccgtaaaccggggaaacggggtaaccgggggtacggtaccttacccggtagttaaccggttttcggttttacgggaacggtccgtaggtccggtacgggtacgggtacgtcgggtaccgtccgtaccgtaacccgtacctaaccgtcgttcccgtaccgaccgttaccccgttacggtaccggttacggagggtaacgttaacgggtcgggtaccgtactttaacggtaaacctttttccgtaacgttccgggttaaccggaaccggggttaccgttacggggtacgtttaccggggtaagttttcgggtttcgggggttacgggttacggggtacggtaaccgacgggttcccgaggttaacccggtccgttaacggcggtaccgtaccgaccgggttacggtcccgttaccggccccgtttacg

SEQ ID NO: 88401 - DNA, 806 bp, Homo sapiens
  misc_feature: GYAE6OF02JMLQ6.33.28.C06.1.454.CMB.1.raw
tcagtacacacactcacgaccggtgctcgatttagagctcacgtattggggtttgggggaggctctggggagtctgcaccatggcttggacccactcctcttcctcaccctcctcctccactgcacagggtctctctccagcttgtgctgactcaatcgcctctgcctctcgcctccgtgggacgcctcggtacaacgctcactctcgcacttctaggacgcgagtcgggcacacgaccaacgtacgcctagtccgacacgttcggctactacagcacgcgacgaccgagacggaacggtcccgtacgggttacttcgtagtacggtaaacggttaacgacgtacggacgtcgggtaccacgacccgtaacggaaccgggtaaagggggaccggacctaccgtacgtttacgttccggtttttacgaacgggtccacggtcgtacgggtcggtacgtcggacgtccgtacctaccgttaccgaccgtacgttccgtacccgtacgtaccgttaccgtaggtaccgtaggtaacgggtacgttggtaccggttaccggtacgttaaccgtttacggttaacgttcggtaccggaaccgggttaccggtacgggggtaactttaccgggtttaggtttacgggttttaccgggtttacggggttttaccggggaacccggggtacgggttaaaccgtacgggttaccggtttaaccgggtaacccggtttacggttaaccgggttaccggaaccggttacccgggtaaccgggtttacccggtaccccggttacccggttaacccggg

SEQ ID NO: 88402 - DNA, 685 bp, Homo sapiens
  misc_feature: GYAE6OF02FK66U.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtgggcacagcaactcgccatcgcatggcatcagcagcagccagagaacggccctcggtactgactaggtaagttaacagtgagtggacacgaccacgaaccggaacggggggacggactcccgtgtacgttcggttttacgacgggttcccgaggtaccttcggtggggtactacggtacggtcgccttacccgtacacccgtacttcccgccaccgtcccgtaccgtaacgttccgtacgggaaggtacggtcggtaaggtccttaaggtacctttaacgttacgtccggttaaccgaccggtaccggttcggggaccgtttaacgggttcgggttttaaacgttggggttttaccggggtttccggggacggggtacggggtaacccgaacggttccggtaaccggtacccggttcgttaaccgggtccacgggacccgaccggtcctacccggtccccgttaccgg

SEQ ID NO: 88403 - DNA, 637 bp, Homo sapiens
  misc_feature: GYAE6OF02GHL9B.33.28.C06.1.454.CMB.1.raw
  modified_base (184)..(184): a, c, t, g, unknown or other
  misc_feature (184)..(184): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagcagtggcacagcaactacgccatcgcatggcatcagcagcgacgccagaggaacggtcccgtacggtactgataggtaacggttaacagtgagtggacagaccgacgaaccggaacgggggacgtactcccgtagtacgtttcgttttacggacggtcacgtcgtcgtcgggtctggacgccgtctacctaccacctctcctaccgacgtccctcgtacgtcgaggacggagtaggacggctagtactttaacgttacgttacggtacgtaccggtacggtcggggtacttaccggttaggtttaggtttcgggtttcggggtttaccgggcggggtaaccggtaaccgtaacggccgttacggacccggttcgtacggtaccgacggtacccgaacgggtccctacccggtacccccgttacgg

SEQ ID NO: 88404 - DNA, 888 bp, Homo sapiens
  misc_feature: GYAE6OF02HAVEY.33.28.C06.1.454.CMB.1.raw
tcagtacacacactcacgaccggtgctcgatttagagctcacgtattgggtttggggatgctttctgagagtcatggatctcatgtgacaagaaactgaagcacctgtggttcttcctcctgctggtggcggctccagatgggtcctgtcccagctgcagctgcgagggacggtccggggcccgggtacgtgggtacgaacggtcccgtttacggggaaccgtcccgttccggttacccctaccgtacccgttggcctaaccgttccggttccttaccggttgggtccggtacccttaccgatccgaggtacgaacgtttaagttaccgttttacggtacggtggggtaccttacggacccgtcccggacccgtaccgggaccccggaaaggggggtaccgggtcggttaggggtacgggtacggtaggttacgggtaaacttaggttacttaagtttaggtacggtagggtacgacgtacgtaaccttacgaacccgtacccgtaccgtaacgtaacggtacgacgtacgtactaacgtacgttacttaccgtaacgacctaccgtaaccgtaacgtaccgttacgttacccgtacctaacggtacgtaccgtacgttaccgtacgtttacggacccggtacccgaccggtaaccgtaaccggtaaccggttacccggtacgtttaaccgttaacgtttacgtttaccggtcggtaaccgacggttaaacgaaccggtaaacgggttaacgggggtacgttaaccggtacgggttacgggttaaccgggttccggggtaaccggttaccggggtaccgttaccgggttcccggtaccgttccgtcccggtaccggtaacccgtaccccggttaacccgaaccccggg

SEQ ID NO: 88405 - DNA, 660 bp, Homo sapiens
  misc_feature: GYAE6OF02ITPOE.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccacctgcacaggtctctctcccagcttgtgctgactcaatcgccctctgcctctgcctccctgggacgcctcggtcaagctcatctgcactctgagcagtggcacagcaactacgccatcgcagtgcatcgacgcagcacgacaaggaacggaaccggtcccgttacggtacgttaggtacgtacggtaaacggttaacgacggtagacgtcggacgacgaccgaacgaaccgggaacggggaccggtacgtcccgtagtacgttcgtttacgacggtactacgtcgtcggtcgggtctacggacgccgtaccgtaccgtacctaacctactccgtaccgaccgtccgtacgtacgtaccgtaggtacgtacgtacgtacgtactacgttacttacgtacgtacgtaccgtacggtcggtacgtacgttacgtttaggttcggttcgggttacgggttacgggacggtacggtacggtaccgtaccgtaccggtaccgtcggtacgaccgtaccggtaccgtccggtcccgtcccgtccgtcc

SEQ ID NO: 88406 - DNA, 843 bp, Homo sapiens
  misc_feature: GYAE6OF02GGTUD.33.28.C06.1.454.CMB.1.raw
  modified_base (165)..(165): a, c, t, g, unknown or other
  misc_feature (165)..(165): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctntgcctctgccctcccgtggggactccgtcgggtacaagtcctcatcgtgctactctgagcgaggtcggacacgagaccaaccgtaccggccagtccgcagtcggactataccgagaccagaccgaacgaccgaacgggaacgggaaccgggtccccgttacgggttaaccgttaggtaacggtaaggtaaaacgggtttaacgagggttacggtaggtacgggaccgaaccggacccgtaaaacccggaaccggggaaaacgggggggtaccggtaacccgttacccgttagtttaaccgtttccgggtttttaccggacgggttacccggtaggtcccgtcgggttacgggggtcttacggggccgtacccggtaccttaccccgtaccgtaacctaccttcccgtacccgtacggtacccctaccggttacgtacggttacgggaaggttacgtcgggtaccggtccttaagtaccgtttaacgttccggtataaccggtaccggtaacgggttccgggtacgtttacggttaggtttacggttcgggttttacggggtttccgggacggggtaccggtaaccgtacgggtaccggtaccggtaacccggttccggtaaggtaccccggacggttacccggtaccggtcccgttccccggtaccccggttacccgg

SEQ ID NO: 88407 - DNA, 951 bp, Homo sapiens
  misc_feature: GYAE6OF02GTC71.33.28.C06.1.454.CMB.1.raw
tcagtacacacactcacgaccggtgctcgatttagagctcacgtattgggtttggggatgctttctgagagtcatggatctcgatgtgcaagaaactgaagcacctgtggttcttcctcctgctggtggcggctcccagatgggattcctcgtccccgagtccgtgcgagtccgtggcgaagggtacggtcccggggcccgggtaacgtcgggtagaacggtcccgttacgggacgtacccccgttcgttcccctccgaaccgttcggacctaccgttcggttccgttccggttgggtcggcccttaccgattccgtaacggacgtaaacgttaacggttttaccttttaaccggtaccgggttacgggggtccttacgggtaccgtacccccgtaccggaaccccgggcccccggtaagggggtaacgggggtaccggtaggggtacgggttaggtacggttacgggtaaattacgttactttaagtttaacggtagggtacgggacgacgtacggtaaccttaaccgtaacccgtaacccgttacccgtacgaaacggtacgtacggtacggtaccaaccgtaaacgttaccttaccgtaccgtaaccggtaacccgtaaccgtaaaacccgtaaccgtttaccggtttaccctacccggtaaccggtaacgtaccttacccggtacccttaccgggtgttaacccgggaccccgtacccgacgtaaccggtaaccggtaccggttacgttaacggttaacgtttaccgtttaaccggtaggttaccggaacgtaacccgtaaacggtaaccgggttaaccgggggtacgttacggggttaggttaccgggtttaacgggtaaccggggacccggttaaccgggtaacccggttacggtacccggtccggtttccccgaccgtacccggtacccgtcccgtaaccccgg

SEQ ID NO: 88408 - DNA, 922 bp, Homo sapiens
  misc_feature: GYAE6OF02G9RD2.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacgagggtctctctcccagcttgtgctcgactcaactccgtccctctcgccctcgtcgtccctcccgtgggacgcccgtcggtacaacgtcctacacttccgtcgtcctacctctaggacgtacggtaggtcgggaccaacgaacggtaaccctaaaccgttacccggaccgtaacgtccggacgtacggtcggtaccgtacgtacgacggaaccgacgtaccgaaccggaaccggaacgggtaaacgggtaacccggggtacccggttaccgggttaacggttaacggtaacggttaacgggttaaaacgggttaaacggtaggtacggtacggtacggtaccgaaccgaacccgaaaccgggaaaccgggggaaacgggggtaccggtaccgtaccttacggggggggggggggggggggtttactttaccgggtttacggtacggtaccgtacggtaccggttcgggttacgggtcggtacggtaccggtaccggtacccgttaacccgtaccgtaacccgtaccgttacccgtacccgtacccgttacccgttaccgtaccggttacggtacggtacggtacggtacgggtacgtacgtacgttacttacgttacgttacggtaccggtacggtaccggtacggtcggttacggtttaggtttacggttacgggtttcgggttaccggggtaccgggtacggtaccggtacggtaccggtaccggttaccggttaccggtaccggtaccggtaccggtaccggtacccggtacccgtcccggtacccgttcccgg

SEQ ID NO: 88409 - DNA, 809 bp, Homo sapiens
  misc_feature: GYAE6OF02JHOHZ.33.28.C06.1.454.CMB.1.raw
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgcctctgcctctgcctaccgtgggacgcctcggtacacgctcgatctgctactctgagcaggtggcacacgacaaccgtacgccagtcgacagtcggctactcgaacggtcacgtacgacgaccaaggaaccggaacggggtccccgttagggtttaaccgttggtaacgtacgggtaaaggttaacgacggttacggaggtacggtacgaccggtacctaaaccggaaccgggtaacggggggtacccggtaacttcccggtagtaccgtttaccggttttacgaccgggtacctaacggtccggttacggttacggggcgttacgggtaccgtaccgttaccccgttaacccgtacccgtaacccgtacgttaccccgtaccgttaaccggttcccgtaccgtaacgggtttaccgtagggtaaaccgggtacttacggggtacggtacgttaacgggtacctttacggttacgtcggtaccgtacgggtaccggttgggaaccctttagggttacggttaacgtttaggggtttccgggtttaccgggacggggtacggtaaccgtacggttacggttccgtaacccggttacggtcgttaccgtaaccggcccgttaacgggcccgttaccgggtccccgttaccgg

SEQ ID NO: 88410 - DNA, 686 bp, Homo sapiens
  misc_feature: GYAE6OF02I9IQK.33.28.C06.1.454.CMB.1.raw
  modified_base (301)..(301): a, c, t, g, unknown or other
  misc_feature (301)..(301): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctgcctctgccttccctggggagcccttcggtcaagctcatctgcactctgacgcaggtgggcacagcaactcgccatccgcatggcactcagcagcagccagagaacgggccctggtactgataggaagttaacagngagtgcagaccagaccggaaagggggcggactccgtgtaacttcggttttacgagggttccagtcgtcggtcggggctgacggtccgcgtacctacgtacccaacttcccgacctaggtccccttaccgacgttcgacgggtaacggtagtcggaaacggtccgtacggtaacctttacgttaaccgtacggttaccaaaccgggtccgttacggggggtacccttaagggttttcggtttaacggttgggtttaccggggtttttcggggacggggttaacgggaacccggtaagttccggtaacgggttaccccggtccgtttaacgggtacgtaaccccgtacccggtaagggtccctccccgggtaccccgttaacccggg

SEQ ID NO: 88411 - DNA, 1021 bp, Homo sapiens
  misc_feature: GYAE6OF02FEWYA.33.28.C06.1.454.CMB.1.raw
tcagtacacacactcacgaccggtgctcgatttagagctcacgtattgggtttggggatgctttctgagagtcatggatctcatgtgcaagaaactgaagcacctgtgttcttcctcctgctggtggcggctcccagatgggtcctgtcccagctgcagtctgcgacgggaggtcccggggacccggtagttggtacggtaaccgtcccgttcgggacgtaccccttcgtccccctcacccgttgcctacgttcgtccttcgtgggtacgcctccagtcacgacaacgtaacgtacttttactaccggtggggccgttacggtacctccccgtacccgaacccggtacccccccggtaagggggtaacggggtccgttagggacgggttacggtagggttttacggggtaaacttactttaccgtttaaagttttagtaacggggttacggggaacgtaccgtaacgtaacccgtttaaacccgttaaaccccggtaaacccccgttaccccgtaactaaaccggggtaaccggttaaccggtaacccggttacccaaaacccgttaacgtttaaacccgtttacccgttaaaccggtaacctaaccccggtaaccccggtaaaaaccggtaaaccctttaaccgggtttacccttacccccggttaaacggtaaaccggttcccgtaacgtacccccgtttacgttacccgggtacccggttaccccggtaccccgtccgaaaccggtacccgtaacccgggttacgtttaacggtttaaaccgttaacgttttaaccggttccgggttaccggtaacgggttaacgaaccttaaaaccggggttaacccggggggtaacgttacccgggggttaagttacggggttaaccggggtttcccggggtaacccgggtaaacccgggggttaacccccgttcggggtaacccccttaacccgggtttcccgttacccccgttaccggtaccccggtcccctacccccggtaaaacccccgggg

SEQ ID NO: 88412 - DNA, 769 bp, Homo sapiens
  misc_feature: GYAE6OF02F2C7P.33.28.C06.1.454.CMB.1.raw
  modified_base (187)..(187): a, c, t, g, unknown or other
  misc_feature (187)..(187): n is a, c, g, or t
  modified_base (227)..(227): a, c, t, g, unknown or other
  misc_feature (227)..(227): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgccctctgcctctgccctccgtgggacncctcggtacaagctacattccgtgacctactcgtaggacncgaaggtcgggaccacgacggacaaactaccgccaattccggactaagtggacagtcgacgaccagcaagtcccaaggtacggaacgggtccccttacggtacgttagaacgttaaggtaaacggtttaacgaggttaggagtacggactaaccgaccgaaccgaacgggaacgggggaccgtaacgtcccgtaggtaactttccggttttacgaacgggtaccaggtcgtaccggtcggggggtaccttacgggacggtacccgtaccttacccgtttaaccgacccgttaaccgtttacccgtacccgtacccgtacccgtacccgttaacggttccgtacggtaagggtacgttaggaccgggtacttacggtaacttaacggttaactcgtaacgaccggtacggtcgggtacctacggtttacgttacggtttcggttacggggtttccgggacggtaacgggtacgtaacggtcgtaccggtaccggttaccgtagaccgaacggcccgtaaggtcccgtacccgtcccgtaccgg

SEQ ID NO: 88413 - DNA, 710 bp, Homo sapiens
  misc_feature: GYAE6OF02HHVGF.33.28.C06.1.454.CMB.1.raw
  modified_base (168)..(168): a, c, t, g, unknown or other
  misc_feature (168)..(168): n is a, c, g, or t
  modified_base (184)..(184): a, c, t, g, unknown or other
  misc_feature (184)..(184): n is a, c, g, or t
  modified_base (245)..(245): a, c, t, g, unknown or other
  misc_feature (245)..(245): n is a, c, g, or t
  modified_base (671)..(671): a, c, t, g, unknown or other
  misc_feature (671)..(671): n is a, c, g, or t
tcagtacacacactcacgaccggtgctcgatttagagctcacgtattgggtttggggatgctttccgagagtcatggatctcatgtgcaagaaactgaagcacctgtggttcttcctcctgctggtggcggctcccagatgggtcctgtcccagctgcagctgcaggngtcgggcccggatggngaagccttcggacgacccttgtaccctcaccgtgccactcgtctcgtggtcgcctccatcngcagtattctttacgtcgtgggctgactccgccaccgcccccgaggggacgggctggggagtggtagttagggaacttgttacgttatttagtaggtggaagtcagtacctacctaccaacccgtccctaacaacggtcgtcgaacgttacacgtacttaacttaccgttaacgaccaccgttaccaaaaccggtaacctacggtttaccctaccgtagtaaacgtcccttaacgaccccttcgttacggttacccgaccggtcccgaacgtaaccggaccgtaaccggtgtttacgttaacgttaatttaccgttggtacggacgaacggtaacctaagggttaaccgggagttaccgggtgtaggtttacgggcggggtaacccgaacggggttaccctggtaacccctcccggtcgttacccncccggtaacctcccggttacccaacccgggtaaccccgg

SEQ ID NO: 88414 - DNA, 605 bp, Homo sapiens
  misc_feature: GYAE6OF02JOM3P.33.28.C06.1.454.CMB.1.raw
  modified_base (184)..(184): a, c, t, g, unknown or other
  misc_feature (184)..(184): n is a, c, g, or t
  modified_base (248)..(248): a, c, t, g, unknown or other
  misc_feature (248)..(248): n is a, c, g, or t
  modified_base (345)..(345): a, c, t, g, unknown or other
  misc_feature (345)..(345): n is a, c, g, or t
  modified_base (451)..(451): a, c, t, g, unknown or other
  misc_feature (451)..(451): n is a, c, g, or t
tcagtacacacactcacgaccggtgctcgatttagagctcacgtattgggtttgggggagctctggggagtctgcaccatggcttggaccccactcctcttcctcacccctcctcctccactgcacagggtctctctcccagcttgtgctgactcaatcgccctctgcctctgcctcctgggancctcggtacaagctcatctgcactctgagcaggtggcacagcaactacgccatcgcatggcatnagcagcagcagagaacgggccctcggtacttgataggaaaggttaacagtgatggcagcagaccgaaggggacggactaccgtgattccggttttanacgggtccagctcgtaggggctggagccgactactccacctagtcctccgacgtcctacgattccgaggaaggattacggacgggtctaacgtacgtatttaaccnggttaccacggaccgttaggggcctaacgttacggttagtacggttttcgggtttcgggacgggtaacggggtaacctaaggtactacgggtaacccgttacggttaagccggtacggaccccgtacggccggttacccgtaccccgttaccgg

SEQ ID NO: 88415 - DNA, 623 bp, Homo sapiens
  misc_feature: GYAE6OF02I0W52.33.28.C06.1.454.CMB.1.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (306)..(306): a, c, t, g, unknown or other
  misc_feature (306)..(306): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatcgccctctcgcctctgccctaccctgggacncctcggtcaagctcatctgcactcngagcagtggcacagtcaactacgcctagtccactagtcggacatcagcagcagccagacgacggccctaggtacttgatgaacgttacaggtnagtgcagcctaccgaacgaggggacgactccagtacgttcgtttacgacggtcaacgtcgtacgtcgggactaggcgtaccgtactacccgttacacctaacgtccctaccgtacgtccgtacctacggtcgtacggtaggtacgtaggtacgtcttcggttaaacttcgttaacgtcgtaacgacggtaccgtacgggtctaacgttggttaatcgggtttagggtttcgggacggtacggaaccgtacggtccgtacggtaccgtaccggtagtaccggaccgtaccggaacgtcgtacccggtccccgttacgg

SEQ ID NO: 88416 - DNA, 774 bp, Homo sapiens
  misc_feature: GYAE6OF02GX7BE.33.28.C06.1.454.CMB.1.raw
  modified_base (191)..(191): a, c, t, g, unknown or other
  misc_feature (191)..(191): n is a, c, g, or t
  modified_base (626)..(626): a, c, t, g, unknown or other
  misc_feature (626)..(626): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctcccagcttgtgctgactcaatccgcctctcgcctcgtcgccctacccgtgggacncctcggtcaacggctacagtcgtgccacttcgtagacgcgacggtggacacgtacgaccaactaccgaccagtccgacaagtcggactaagtccaaggtccaaggcgacgaacccgtaaggaacggaaaccggggtcccgttacgggttaaccttaggtacgtaaggtaaacggttaaaccgtacggtacgtaagtcggaccgtacgacccgaaccgaaacgggaacgggggaccgtacgttacccgttggtacgtttaccggtttttaccggacgggtaacctacggtctaccgggttagggggtcctagggtaaccgcccgttaacccggtcctaacccgtaaccgactttacccggacccgtaaccggtccttaccgaacggtttccgacggtaacgtagtacggtacgagttaccgaagttaactttacgngtaaccggtaccggtacgtcgggactaaccgtttggttacgtacggtttccgggttacggacgggacgtaaccgtaacggtccgtaccggtaccgttacgttaccgacggacccgacggttaccggacttccccgggaccgtacccgg

SEQ ID NO: 88417 - DNA, 806 bp, Homo sapiens
  misc_feature: GYAE6OF02JUL4G.33.28.C06.1.454.CMB.1.raw
  modified_base (265)..(265): a, c, t, g, unknown or other
  misc_feature (265)..(265): n is a, c, g, or t
tcagtacacacactcacgaccggtgctcgatttagagctcacgtattgggtttggggatgctttctgagagtcatggatctcatgtgcgaagaaactgaagcactgtgtcttcctctgctggtgcggcctccgagtagtggtctgtcccagctgacagtacgtgccgaaggcggtccggggacccgggtagtggtaggacgtccgttcgggaactccccgtgtccccctacgaccgtgacctactcggtactcgtggtcgtaccncctaagtcaagtacgtaagttaacgttccttacggtaccgttcgggcgttacggtaccgtcccgaccgtcccgggaacccgggtaaggggaacgggtcgtacgggaacggttgggttaacgttacgggaacttaagtacgttaacgttaggtaacggtgggacgactaacggttaccgtaactaaaccccggaccgttttacccggaagaacggttagacgaacgttacccgaattaaccgttacgaccttaaacgaccttaacgaacccgtaaacgtaaccgtacgttctaccgtaacgtacgtacgtacctacgtccgtaacggtaccgtacccggtacgaccggaacgtaccggtaccgtagaaccgttttaacgttaaccgttaaccgtaggttacggaaccggtaacggtaacggtaaccgggtaaacgggtaggtaccggtagtacggttacgggaccgggttaaccgtacgggtaaccccgttaggttaccgtacccggtcttacccgtacgtaccgtccgtacccgtaaccgg

SEQ ID NO: 88418 - DNA, 783 bp, Homo sapiens
  misc_feature: GYAE6OF02FMHZD.33.28.C06.1.454.CMB.1.raw
  modified_base (126)..(126): a, c, t, g, unknown or other
  misc_feature (126)..(126): n is a, c, g, or t
tcagtacacacactcacgaccggtgctcgatttagagctcacgtattgggtttgggggagctctggggagtctgcaccatggcttggaccccactcctcttcctcaccctcctcctccactgcacnggtctctctcccagtcttgtgctgactacaatccgccctatcgcctctgtcccttcccgtaggggactccctacgggtactaacgtcctactaactcgttcgaccaaccttctagaccgacgagggttcgggtaccaacgtaacggcctaaaacctaccggacctaactccgtaccaagcggacctactacgcgacgagaccacgacgaggtaacggacggcccgttacgttacgtgtaacgtaggtaaacggtacgtagtgagtacgcacggtacccaacggtaacggaacggggtacgtaccgtaccgtaggttaactttccggtttaaccggaacggttccacggtccgttacggtacggttcgacggtactccggtaccctaccgacaccgtacgtaccgttaccgtaccgtacccgtaccggtacgtccgggtaacgtaccgggttaagtacggtagtacggttaaaccgtactttacggttacgtttacgaacggttaccggaccgggtacggtaaccgtttaacggtccgtttaaggttcggtttacgggttacgggaccgggtaacggaccggtaacgtaccgtaccgggtaccgtaccggtacgaccgttaccggaccggtccgtccggtaccgtacccggtacccgg

SEQ ID NO: 88419 - DNA, 710 bp, Homo sapiens
  misc_feature: GYAE6OF02F2Q4G.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatgggtcctgtcccagctgcagctgcgagggacgtccggggcccggatgggtgacgccttcggacgtacccctgtcccctcacctgcacgttcgtctctggtcgcctccatcagcgaagtacgttcctttacgtcggtgggctaggctccgaccgtaccgccccgagggacgggtcgtaggtaggtggtacgtaggaatacttacgtaattagtaggtacgggacgtactacgtacctaccgtaacccgtaaccccgtacccacgtaaacggacgttaccgtacggtacccaaccgttacgttaacttacccgttaacgaccctaacgtaccctaaacgaaccgtttacgttcccgtaccgtagtaacccgtcttacgtacccttcgtacggtaccgacccggacaccgtacgacgtacggtacctagttaacgtacgttaccgtgtacgacgtacgtaacgacgggtaaacgggcgtacgggtgttaggtacgggtcccgggaccgtaccgggtaacctcggttaacccgtcgtcccggttccaccgtaccgtcccgtacccgtaacccgg

SEQ ID NO: 88420 - DNA, 780 bp, Homo sapiens
  misc_feature: GYAE6OF02I6KWX.33.28.C06.1.454.CMB.1.raw
  modified_base (156)..(156): a, c, t, g, unknown or other
  misc_feature (156)..(156): n is a, c, g, or t
  modified_base (166)..(166): a, c, t, g, unknown or other
  misc_feature (166)..(166): n is a, c, g, or t
  modified_base (225)..(225): a, c, t, g, unknown or other
  misc_feature (225)..(225): n is a, c, g, or t
  modified_base (733)..(733): a, c, t, g, unknown or other
  misc_feature (733)..(733): n is a, c, g, or t
  modified_base (745)..(745): a, c, t, g, unknown or other
  misc_feature (745)..(745): n is a, c, g, or t
tcagtacacacactcacgaccggtgctcgatttagagctcacgtattgggtttgggggagctctggggagtctgcaccagtggcttggaccccactcctcttcctcaccctcctcctcactgcacaggtctctcgtacccagtcttgcgctgactnaatcgccctntcgcctctcggcctaccgtggacgccgttcggactacgcctcgactctacgctacgtcncggagtcgtaggtggcctaagacgacctaacgtaccgctaacgtccgacgacggtcgacgtatccaagccgacgtcgtacgaccgaggacggaccggtaccgtcgtaagtcggtagtaacggtaagttacggagtgacgtcgacgacgtaaccgaaccgtaacgggggaaacggggtacctaccgttaccgtcgggtttaacgtttccggttaaccgggcccggttaacgccgggttaccgttacggggtacggggtccgtaaggtacccgggtaccctaccgttacccgtaacccggtcccgttaccgaaccccgttcccgtaaccgtcccggttaccgtcggtacgtacggacggttacgtacgtagtcctaagtaccgttatacgtcgtaacgtaccggtacggtcgtaacgttagttacgggttagttccgggtacgggtttaccgggacgtacggttaacgtccgggttaaccttacgggtaacccgttcggaacggttaccnccggggtaaacnccccgggttaccttacccgggtacccccttaacgg

SEQ ID NO: 88421 - DNA, 731 bp, Homo sapiens
  misc_feature: GYAE6OF02GJRLJ.33.28.C06.1.454.CMB.1.raw
tcagtacacacactcacgaccggtgctcgatttagagctcacgtattgggtttggggatgctttctgagagtcatggatctcatgtgcaagaaactgaagcacctgtggttcttcctcctgctggtggcggctcccagatggtcctgtcccagctgcagctgcgaggacgtccggggcccgggacgtgggtcgaacgtccgttcgggacgtaccctcggtcccctcaccttgcacttcgtcctcgtcggtcggcctccatcgaggcaagtaagttctttactacgtgggctaggactccgccacgccccgagggacggcgtggagtggagtaggtaatatactagttagtaggtggagacgacgacttactaacccgtacccgtacctacgaacgtagtaccgtacgtaccgaacctagttaccgttaccgtaacgtaccgtaaccgtaaccgaacgaacccgttacggtttaccccttcccggtaacggtaaaccgttccgttaaccgtaacccgtttccggtacgtacccggtaccccgtaccgtacccgtaacgtacccgtacggtaccgtttacgtaaccgtttacgttaaccgggtgtacggtaaccgacgtaacgtaaccgggtaacgggtacgttcgggtagttacggttagggttccggggaccgtaccgggtacccgtggtacccgtaccgttccaccgtccgactccccggacctaaccgg

SEQ ID NO: 88422 - DNA, 792 bp, Homo sapiens
  misc_feature: GYAE6OF02JQ4FH.33.28.C06.1.454.CMB.1.raw
  modified_base (184)..(184): a, c, t, g, unknown or other
  misc_feature (184)..(184): n is a, c, g, or t
tcagtacacacactcacgaccggtgctcgatttagagctcacgtattgggtttgggggagctctggggagtctgcaccatggcttggaccccactcctcttccctcacccctcctcctccactgcacgagggtctctctcccagtcttgtgtctgtactctaacgtccgccctcgtcgccttcnccgtcccgtccgtgggtacgccgttcggtcaacgtcctctacgtcgtcgtacctacgtctagacgcgtagggtcggaccacgaacgacgtaactaccgacctgtaccgatacgtcggactacgacgacgacgcgaccgacgacggaacggtacggtaccgggtaccgttacggttactaacggtacggttaaggtaaaccgtaagtagtaggtactacggaacggacgtaaccggacggaaccgggtaacggggtaccgtaccggtacgttacgtttacgttaccggttaccggtaacgtaccgtgtaccgggtcggtacggtgaccggtcgaccgttaccgtaccttaccgaaccgttactaacccggtccgtacccgtaccgttagtaccggtgtaagggtaacgttaggtacgaaccggttatcggtaaacgttcgttaccgtggttaaccggtccgggtacgggtacgttaccgtaggtttacggtttacgttggggtaccgggtttacgggacgtaaccggtcggtaaacggtctacccgggtaccgttcggtaaccgtaccggtaccgtaccgtacccggtttccacccgttccggtaaccg

SEQ ID NO: 88423 - DNA, 899 bp, Homo sapiens
  misc_feature: GYAE6OF02HSAVW.33.28.C06.1.454.CMB.1.raw
tcagtacacacactcacgaccggtgctcgatttagagctcacgtattgggtttgggggagctcgtggggagtctgcaccatggcttggaccccactcctcttcctcacccgtcctcctccgactgcacgtacgggtctcctctcccgagtcgttgtacgcttgactactaactcccgtccctcgtcgcccttcgtccgtcccttccggtcggggtacttcccgttcggtactaacgtccttctacttcgtcgtacctacttcgtacggaacgtccgtgggcggacacgacgaaccctaacgccaccgtataccggtagtacggtacgtacctaacgttacgacggaccgacggacgaccgacggaacgggaaccgggttacccggtcccggtttaaggtaaccggttaggttaaccggttaacgggttaaaacggttacgtacggttacggtcgggtacgaccgtaacccggaaaccgaaccgggggaaacgggggtaccgggtaacgttcccgttacgttcggttttacggtttaccggttacggtaccggttaccgtcggtacgggtttccggagggtcgtcccggtaaccgttccgttaaccctaccgtacccttaccggtaccgtaccgtacccgtaccggttacctcgggttacgaccgttaagggtcgtaacggttcggtaaccgtttacgacgtttactacggtccttacgggtaccgtaccgggtacgtacgtacgtttaagggtttccgggtacggtttacggggttaccggggttacggacgggttaaccgtccgggttaaacgtcccgggttaacggtacccgttaacggttaccggacccggtaacgtccccggttacgtccccggttaccccgaccggtttcccgg

SEQ ID NO: 88424 - DNA, 714 bp, Homo sapiens
  misc_feature: GYAE6OF02JQHYD.33.28.C06.1.454.CMB.1.raw
  modified_base (127)..(127): a, c, t, g, unknown or other
  misc_feature (127)..(127): n is a, c, g, or t
  modified_base (140)..(140): a, c, t, g, unknown or other
  misc_feature (140)..(140): n is a, c, g, or t
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (451)..(451): a, c, t, g, unknown or other
  misc_feature (451)..(451): n is a, c, g, or t
  modified_base (582)..(582): a, c, t, g, unknown or other
  misc_feature (582)..(582): n is a, c, g, or t
  modified_base (594)..(594): a, c, t, g, unknown or other
  misc_feature (594)..(594): n is a, c, g, or t
  modified_base (608)..(608): a, c, t, g, unknown or other
  misc_feature (608)..(608): n is a, c, g, or t
  modified_base (683)..(683): a, c, t, g, unknown or other
  misc_feature (683)..(683): n is a, c, g, or t
tcagtacacacactcacgaccggtgctcgatttagagctcacgtattgggtttggggagtcgtctggggagtctgcaccatggcttggaccccactcctctcctcaccctcctccgtcactgcacgnggtctctctcccngtcttgtgctgacctnaactccgcctntcgccctctcgcccttcccgaggggtactccgttcgtacaagcctcgacgttccgtcgacctagtcctganccgtaggtcgcaacngtacctacacgcctanccgacgtagtcggcactaacgcgctacgctaacacgagacggaaccgttccgtaaggtcctaggaacttaacggtaaacgttacacggtagtaacttcggaacgaccggtcccgaacggttaaccggggaacggggtaccgaacgtttccccggtaggttttaacgttccggggtttaaacnccggggtcctaacggttggtaaaccggttggcccgttagacgggttccccttaaccgggactccgtaacgcgttaccgccgtaaacgtccgtagtaccgtgtaaaggcgtaacgagtctgttaaactcgtntaacgcggtaanccgtagccgttagnggtttacgtggtagttccggtcgaggttaaccctaggtaccgtacgccgtacgttaccggttagcccggtaaccncggtaacccgtcgtaccggttccctaaccgg

SEQ ID NO: 88425 - DNA, 846 bp, Homo sapiens
  misc_feature: GYAE6OF02HADDW.33.28.C06.1.454.CMB.1.raw
  modified_base (134)..(134): a, c, t, g, unknown or other
  misc_feature (134)..(134): n is a, c, g, or t
tcagtacacacactcacgaccggtgctcgatttagagctcacgtattgggtttggggatgctttctgagagtcatggatctcatgtgcaagaaactgaagcactgtggttctcctctgctggtgcggctccagngtggtcctagtccagctgcagctgcgaggaggtccggcccaggacgtgggtacgaacgtccgttcggagtacccttcggtccctacgaccttggcctacgtcgtcgtcgtcgggtacgcctacctagtacgacgtacgtaacgtaacgtttcgttaacgtacggtcggggtactacggaaccgtccccggaccgaaccggtaccccgggaagggggtaaccggggtctacggggttaaggagggttaacggttaacgggtacttaaacgttacgttaaagttaacggttagggtacgggtacgtaaccgtaccggtaaccttaacccgttaaaccccgtaacccggttaccctaaacggaaacgggtccgtaacgttaacggtacctaaaccgtaacttaacgttacccgttaaaactaccgttaacccgtaaacgaaaccgtttaaaccgtcgtttaccctaccgaaggtaaactctaaccgtaacgttgtaccgtaaccgacccgtcgacgtacgacggtacctgttattgtaacgttgtcgtagtacgaccggaaagtacccgggtacgggtaaggttcgtaaggttttaccgggtacgggttaacccgggaaccggtttaccggggtaaacccgtttcccgggaccggttttaaccccgtcccggttaaccgggtacccgtaaccccggtcggtttaaacccccgggg

SEQ ID NO: 88426 - DNA, 682 bp, Homo sapiens
  misc_feature: GYAE6OF02JDHN3.33.28.C06.1.454.CMB.1.raw
  modified_base (147)..(147): a, c, t, g, unknown or other
  misc_feature (147)..(147): n is a, c, g, or t
  modified_base (191)..(191): a, c, t, g, unknown or other
  misc_feature (191)..(191): n is a, c, g, or t
  modified_base (434)..(434): a, c, t, g, unknown or other
  misc_feature (434)..(434): n is a, c, g, or t
  modified_base (489)..(489): a, c, t, g, unknown or other
  misc_feature (489)..(489): n is a, c, g, or t
tcagtacacacactcacgaccggtgctcgatttagagctcacgtattgggtttgggggagctctggggagtctgcaccatggcttggaccccactcctcttcctcaccctcctcctccactgcacagggtctctctccagtcttgtnctgactcaactccgccctctcgcctctcgccctcccgtgggacnccctcggtacaagcctcacttcgtcgctaccgttcgaggaacgctaagggtcggaccaacgacgaacctaaaccgtccgaccacgtcgactaggtcgactagaccagacgacgacacgaccgaaggaacggaccgggtccctacggtaacttagaagtaaggtaaacggtaacgagtgagtggaacacgaccaacgtacgggaacgggcgactccgttagtacgtttcgttacgacggtacgntccgtaggtcggatcggacgtccgtactaccgtcgaaccgttagcccgtacaccnccgtactagtcgtagacgtagtcgaacggttctaacggtactttacgttaacgtccgtacggtaaccggaccgtcgggtaactacgggtttaacgtcgttagggttccggttggaaccgggacgtaaccggtactcggtaacgtaccgttacgtacggacgtaaccgtccggaaccgcgtccccggtacgtcg

SEQ ID NO: 88427 - DNA, 631 bp, Homo sapiens
  misc_feature: GYAE6OF01D1TRR.13.15.B04.1.454.CMB.1.raw
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacacatatactggtaccagcagaagccagggagccctcccaggtatctcctgtactactactcagactcagagtaagggccagggctctggacgtccccagcccgcttctcgtggactacccaaagatcgctttacaacgaccctaaatacgtagggtaactttttactactacttcctacccggggtactaccccgagttccgtaggaggtatggaggtcttaggacttaacgtttactagttaagtgttaagttttcgggaccctaaggactaaagttggtaagtttgggtacgggtttaaacgtttcggggaccggggaaacggggtaaacccgtaaggaccgttaccgggtaaaccccggttcccggttaaacgggttccgaccggaaacccccgg

SEQ ID NO: 88428 - DNA, 538 bp, Homo sapiens
  misc_feature: GYAE6OF01CHL7O.13.15.B04.1.454.CMB.1.raw
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacaacatatactggtaccagcagaagccagggagccctccaggtatctcctgtactactactcagactcagataagggccagggctctggacgtccccagcccgcttcctctggatccaaagntgcttcagccaatacagggtatttacncatctcggctccagtctgagatgaggctgacttattacgtgtactagtacgttagttcggactaagactaagtcgtagttgggttaggttacggttacgggacgggaacggaccgacggtcgtaccggtacccggtaaccggtcggtacgaacccgg

SEQ ID NO: 88429 - DNA, 506 bp, Homo sapiens
  misc_feature: GYAE6OF01E2HCU.13.15.B04.1.454.CMB.1.raw
  modified_base (425)..(425): a, c, t, g, unknown or other
  misc_feature (425)..(425): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (498)..(498): a, c, t, g, unknown or other
  misc_feature (498)..(498): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacaacatatactggtaccagcagaagccagggacgcccctccaggtatctcctgtactactactcagactcagataagggccagggctcgtggacgtccccagcccgcttctcgtggactcccgaaaagtctcgcttcacgaccaatacgagggtattttactcactccgtccgggctccagtctgagtagtgngtctgactattactgtatgtattgacagcatgtatgtggtntgggnggaggaccagcgtcgaccgtcgcgtcnggtacccg

SEQ ID NO: 88430 - DNA, 235 bp, Homo sapiens
  misc_feature: GYAE6OF01AJ66C.13.15.B04.1.454.CMB.1.raw
  modified_base (227)..(235): a, c, t, g, unknown or other
  misc_feature (227)..(235): n is a, c, g, or t
tcagtcacgtactacacgaccggtgctcgatttagacagtatatatccgcgggacccaggctgtggatgaggctgactattactgtcaggcgtgggacagcagcactgcctccttcggaactgggaccaaggtcaccgtcctaggtcagcccaaggccaaccccactgtcactctcgttcccgccctcctctagtacgtgactgagcgggctggcaaggcgcatagnnnnnnnnn

SEQ ID NO: 88431 - DNA, 706 bp, Homo sapiens
  misc_feature: GYAE6OF01EVMGO.13.15.B04.1.454.CMB.1.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagcccaccttcctcctccgcatcctccgtgagaactccgccagactcacctgcctaccttgcccagtnacatcaatggttgganctaacaactatatacgtcggtaaccagaccaaggaacgccgtaaggggaccgtccccctaccgtaaggttacttccttcctacggttaaccttaacctactccgaacggtacctacgaaggtaaacggtaacgggcccgtaaggggtcctaccggtacggaccgtcccccgagtccccggtcttccgtacgtagggaccttaaccgaaaggtcttcgacccttacgacgtacctaaacgtacgtaacgggttaacttttaccgtacgtactccgtccgggtaccttaccgtacgtacgtagaggtagtagtacgtcttagactttaacgttacgttagttagtagttacgtttcggaactaagtacgtaagttcgtagttggttaagggtcggttacggggacgggtaaccgggaccgtaaggtcccgtaacggtaccccggttaacgtacgggccgtaccgggtaacccgg

SEQ ID NO: 88432 - DNA, 715 bp, Homo sapiens
  misc_feature: GYAE6OF01CU9P4.13.15.B04.1.454.CMB.1.raw
  modified_base (316)..(316): a, c, t, g, unknown or other
  misc_feature (316)..(316): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcacgccctaccttcctccctccgctacttcctccgtagggaacgtaactcccggaccacgtacctccacctcgacctaccgttcgccctagtcgaacctatactaagttggttaggtacacctaacaactatacttacgtcggtaaccagacagaacgccgaggacnccctcgagtactcctctacgtacctactactacagactacgaacgtaacgtaacgggaccgaggggtcctcggtaccgggtacccgtccccgacgtcccggtcctttcgtccgttacgggaacttaaccgaaagtcgtcgtccttacacgaacctaagtacgtacggttactttacacgtacttccggtaccggtcctcgagttccgtaggacggtagtacggtacggtactacgtacgtttacttaacgttaggttaagttacgttacggtttaccggaacttaagacgtagttaggtacggttagggtacggttacggttcgggaacgggtacgggtaaccgacgggtaccgttaaccggtaccggttaccggtacgacccggtaccggtaacccgg

SEQ ID NO: 88433 - DNA, 743 bp, Homo sapiens
  misc_feature: GYAE6OF01EBX4Q.13.15.B04.1.454.CMB.1.raw
  modified_base (529)..(529): a, c, t, g, unknown or other
  misc_feature (529)..(529): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagccaccttcctcctccgcatcctcctggagaactccgccagactcacctgccaccttcgacccagtcgaacagtcaaagttggttaggtactactaacaactattactacgtacggtaccagcgaagaacgccgaaggggacctccccgtacccgtaaggttactccttaccgttacggttaaccttacctacgttaccgagtaccttacgaagtacgtaaacggggcccgaagggtccttcgtacgggtaccgtcccccgaaggtccccgttcctttccgtaccgtggtaacctaacccgaaaagcgttcgaccttacgacgacctaagtaacgtagggttaacttttactacgtacgttccgcccgggtctaccgngttacctagggacgtaatacgggtacgtcgttaacgtacgttaacgtttaaccggagtttattacgggttacgttttacgggaaccctaaggttacgtaaactagggttcggtaaggttcggggttacgtttacccgggggaagggtacggtaaccgtaaacggccgttaaaccgggcccgttaacggttaccggtaccgccgggtaaccccgg

SEQ ID NO: 88434 - DNA, 692 bp, Homo sapiens
  misc_feature: GYAE6OF01CJAAD.13.15.B04.1.454.CMB.1.raw
  modified_base (181)..(181): a, c, t, g, unknown or other
  misc_feature (181)..(181): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttcccctctcgcaggctgtgctgactcagccgtcttcctctctgtctctccgtggancgtcagccagtcctacacctcgctaccttgcgtcagtcgcacctaatggttcgtcctagtgactatatatacggtaccacaaggaacgccgaacggggacgttccctacccctaggttttcctaccgtaggtacggttcgtaagaacctaacgtacaagtaactaacggaacgnggtactcgtaggaccgtcccaggtccncgttaccgcgtacgtacgtactaacgggtatacgtaacctccgtacccgaacgtcggaaggtaactttactaccttacgaagttcccgtacggtacgggccctttccgagtcgtaggtacgtagtacgagtcgttataacggttacctttagttcgttacgtacgttacgacaacgtaaccctaggccgttaagacgttcccgtacccgggtacgtacggggaacccggttaacccgtcccgtaaccccggttaccgtaacgggtaaccccacgggtacccccggttaaacccgaccccggttaaacccc

SEQ ID NO: 88435 - DNA, 740 bp, Homo sapiens
  misc_feature: GYAE6OF01C5SKH.13.15.B04.1.454.CMB.1.raw
  modified_base (172)..(172): a, c, t, g, unknown or other
  misc_feature (172)..(172): n is a, c, g, or t
  modified_base (243)..(243): a, c, t, g, unknown or other
  misc_feature (243)..(243): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcacgcccaccttcctcctccgcntcctcctggagaactccgccagacctcacctgctaccttgacccagtcactatacaagttggttacggtanacctaacaaactagtatacgtacggtaaccagacaagaacgccgaaggggacctaccccaccgaaggttacctccgttaccgttacgttaacctacctactcgaacgtaactacgaagtaaagtacggggaccgaagggtcctcggtacggaccgtccccaaggtccctcgtcgtacgtgtactacggtaagactggtaacctccggaccaacgagtaaggtacttaacttactctaagttccgttaggtccgggtacctaccgttacgtaccgttacgaaccgtaggtttaggacgggtacctttaacgtacggtttaacctttacggtttcggtttacgtaacgttacgaacccaaacgtaaacgtccgtaccggttaggtactttacccgggttaccgggtaaccccgttacgggaaccccggtaccgtttacccgaacccggttccgttaacgggaccaaccccggttaacccggaacccggtaaaccccccg

SEQ ID NO: 88436 - DNA, 228 bp, Homo sapiens
  misc_feature: GYAE6OF02F0AP6.13.15.B04.1.454.CMB.1.raw
  modified_base (226)..(228): a, c, t, g, unknown or other
  misc_feature (226)..(228): n is a, c, g, or t
tcagtcacgtactacacgaccggtgctcgatttagacagtatatatccgcgggacccaggctgtggatgaggctgactattactgtcaggcgtgggacagcagcactgcctccttcggaactgggaccaaggtcaccgtcctaggtcagcccaaggccaaccccactgtcactctgttcccaccctcctctagtacgtgactgagcgggctggcaaggcgcatagnnn

SEQ ID NO: 88437 - DNA, 228 bp, Homo sapiens; identical to SEQ ID NO: 88436
  misc_feature: GYAE6OF02GID0H.13.15.B04.1.454.CMB.1.raw
  modified_base (226)..(228): a, c, t, g, unknown or other
  misc_feature (226)..(228): n is a, c, g, or t

SEQ ID NO: 88438 - DNA, 230 bp, Homo sapiens
  misc_feature: GYAE6OF02FJLIQ.13.15.B04.1.454.CMB.1.raw
  modified_base (226)..(230): a, c, t, g, unknown or other
  misc_feature (226)..(230): n is a, c, g, or t
tcagtcacgtactacacgaccggtgctcgatttagacagtatatatccgcgggacccaggctgtggatgaggctgactattactgtcaggcgtgggacagcagcactgcctccttcggaactgggaccaaggtcaccgtcctaggtcagcccaaggccaaccccactgtcactctgttcccaccctcctctagtacgtgactgagcgggctggcaaggcgcatagnnnnn

SEQ ID NO: 88439 - DNA, 487 bp, Homo sapiens
  misc_feature: GYAE6OF02GGZ9X.13.15.B04.1.454.CMB.1.raw
  modified_base (352)..(352): a, c, t, g, unknown or other
  misc_feature (352)..(352): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagntgcttcagccaatacagggtattttacgtcatctccgggctccagtctgagatgagctgactattactgtatgatttgccaagcaatgatgtggtattcggcggaggaccaagctgaccgtctaggtcagacccg

SEQ ID NO: 88440 - DNA, 731 bp, Homo sapiens
  misc_feature: GYAE6OF02HGOJB.13.15.B04.1.454.CMB.1.raw
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
  modified_base (366)..(366): a, c, t, g, unknown or other
  misc_feature (366)..(366): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtanctacaacatatactggtaccagcagaagccagggacnccctccaggtatctctgtactactactcagactcagataagggccaggggtctcgtaggacgtaccccagccgtcttcctactggacttaccgaaaagtntacggtccttacacggtacccaaagtacgtaacgggtaactttttaaccgtactaacgttacccgtcccgggggtaccttacccgtaacgtttccggtacgggtaagggtaacgttagggtaaaccggggtcgttacgggtaaacttttaacgtttaaacccggtttcgtttaaaagtttcggttaacggtttttacggtaacccggtaaagtaaccgtaaacgtttacggtagtttagggttacgggtttaacggtttaccgggggaaccggggtaacgggggtaaacccggtaacgggtaccggttaccgggaaccccggtttacccgggtaacgggtttaccgaacccggtaacccccgggg

SEQ ID NO: 88441 - DNA, 704 bp, Homo sapiens
  misc_feature: GYAE6OF02H6H1V.13.15.B04.1.454.CMB.1.raw
  modified_base (169)..(169): a, c, t, g, unknown or other
  misc_feature (169)..(169): n is a, c, g, or t
tcagtcacgtactacacgaccggtgctcgatttagacagtatatatccgcgggggtgcatgtcaggctgtgtccaccatggcctggactcctcttcttctcttgctcctctctcactgcaacacggttccctctcccagcctgtgctcgactcacgtccgtcttccctntcctgtccttcctccgtaggcgtccgtacgacgtcctacgtcctaccgtaccgtcggtacctaccgttggccgtacgtaggtacggacctaaccgtagttcggttccggtacctagttcgaactattacgttagttaccggtaaccgagaacgtaacggccggtaagggtccttaccctccgttacgttcctaccggtaggttacgtacgtaacggaactaacgtacgaagtaaacgtaacgacggtacggtctcggtacggtacctccgacgtccgtctcgtcgtacgtactacgtaagtcgtacgtacgtcccgacgacgtacgtagtactactactactcgtcgtcgtcgtctcgtgtctacgcgtagtacgagtcgtacgtacttgttacgtgttacgtacgtcgtaacgtaccaacgtacgtacgttacgtaccgttacggtccggtacggtccggtaccgtaccgtaccgttaccggtaccggttcgaccggtaaccgtacccggaacccgtaccccgtacgtacccgg

SEQ ID NO: 88442 - DNA, 732 bp, Homo sapiens
  misc_feature: GYAE6OF02HFY8P.13.15.B04.1.454.CMB.1.raw
  modified_base (302)..(302): a, c, t, g, unknown or other
  misc_feature (302)..(302): n is a, c, g, or t
tcagtcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcacgccctaccttccctcctccgcactcctcctaggaagaactccgccagacctcacctgcctaccttcgccctagtcgactatactaagttggttaggtcactaacaactatattaccgttggaaccagacgaagaacgccggagggtaccnccccgtaccgtaggtactcccgtccttagtacctaacctacctacgtacgacttacgaaggtaacggtaacgggccggaacggttcctcggtacggtcccgtaccccgacgtcccggtactttcgtcgtacgtaacgtaccgtaaagctccgtactcgaacgaacctaaggtacgtacggtttactttacctacgtcgttccggtcccggtctaccggtcgttacgtgggtaacttaagcggtacgtacgtacgttaactttacgttacgttagttaacgttggttaacgtttaccgaacgtaacttaacctagggttattacggttaggtttacggtaaccggggttaccgggacgggtaacggtaaccgtaacggttccggtaaccggttcccggttacggttaacggtccgtaacccggtaacccgg

SEQ ID NO: 88443 - DNA, 498 bp, Homo sapiens
  misc_feature: GYAE6OF01ASHCJ.21.8.A08.1.454.CMB.1.raw
  modified_base (489)..(489): a, c, t, g, unknown or other
  misc_feature (489)..(489): n is a, c, g, or t
tcagtcgtcgctcgcacgaccggtgctcgatttagcatactctacaggggctgtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatccctgagagattctctgcctccagctcagggcagtggccacttgactatcagtgggccaggtgacgatgaagctgactactattgtacgcacagacagtagtggtcatcgaggggtattcggcggaggaccaaggttgaccgtccgttggtcacgcccaaggctcggcccctggtcncgtcgtccg

SEQ ID NO: 88444 - DNA, 506 bp, Homo sapiens
  misc_feature: GYAE6OF01BA1JC.21.8.A08.1.454.CMB.1.raw
  modified_base (330)..(330): a, c, t, g, unknown or other
  misc_feature (330)..(330): n is a, c, g, or t
  modified_base (498)..(498): a, c, t, g, unknown or other
  misc_feature (498)..(498): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattcnctgccctccagctcagggacagtggccaccttgactatcagtcgggcccaggtggacgatgaagctgactactattgttacgcaccagacagtagtggtcagtcgaggggtatcgggcggaggaccagttgaccgtcttggcagcccaaggcctcgccccctggtccncgtcgtcg

SEQ ID NO: 88445 - DNA, 517 bp, Homo sapiens
  misc_feature: GYAE6OF01DTTMN.21.8.A08.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagcatactctacagggggcgtgtgggctcaggaggacagagctctgggaatctcaccatggcctggacccctctcctgcctcccctctcactttctgcacaggtctcgtggggcctcctatgagctgacacagccaccctcggtgtcagtgtccccaggacaaacggccaggatcacctgctctggagattcattgaccaaaagatatacttgtggttccagcagaagtcaggccaggccctgtactggtcatccatgaggccagtcgacgacactccgggatccctgagagattcnctgcctcagctcagggcagtggccacttgactatcagtgggcccaggtggacgatgaagctgactactattgttacgcaccagacagtaagtggtacagtcgagggggttattcgggcggtagggaccgtagttcgaccgtcgttcggtcaggcccaaggctcgcccctcggtcactctcgtccccg

SEQ ID NO: 88446 - DNA, 508 bp, Homo sapiens
  misc_feature: GYAE6OF01BRLS8.21.8.A08.1.454.CMB.1.raw
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
  modified_base (475)..(475): a, c, t, g, unknown or other
  misc_feature (475)..(475): n is a, c, g, or t
  modified_base (499)..(499): a, c, t, g, unknown or other
  misc_feature (499)..(499): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgcctccagctcgagggacaggtggcctacttgactatcaggtcgggccgaggtggacgagtgaagctgactactattgtacgcacagacagtagtgtnagtacgaggggtatcggnggaggacgtagtcgaccgtcttgcgngacccgaggctcgcccctggtccncgtcgtccg

SEQ ID NO: 88447 - DNA, 558 bp, Homo sapiens
  misc_feature: GYAE6OF01BQSNM.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttgttccagcagaagtcaggccaggcccctgtactggtcatccatgaggccagtcgacgacactccgggatcccctagagagacttctctgccctccagcctacgagggacagtcggcccaacgttgacttagtcaggtcgggcccaggtggacgagtggaaagctagactactagttagttacgcacaagacagtaagtggtactagtcgaggggtattcgggcggtagggaccgaaggttacgaccggttcgttggtaccgacgaccccgtaaggccgtcggcccccctaggtccctaccgtccgttcccgg

SEQ ID NO: 88448 - DNA, 502 bp, Homo sapiens
  misc_feature: GYAE6OF01C685U.21.8.A08.1.454.CMB.1.raw
  modified_base (472)..(472): a, c, t, g, unknown or other
  misc_feature (472)..(472): n is a, c, g, or t
  modified_base (494)..(494): a, c, t, g, unknown or other
  misc_feature (494)..(494): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgccaaaagaatatacttgttggttccagcagaagtcaggccaggcccctgtactggtcatccatgaggccagtcgacgacacgtccgggatccctgagagattctctcgcctccagctcagggacagtggccaccttgactatcagtgggcccaggtgacgatgaagctgactactatgttacgcaccagacagtagtgtcagtcgaggggtattcggcggagggaccaggttgaccgtcttggcngcccaaggctcgcccctggtcnctcgtccg

SEQ ID NO: 88449 - DNA, 509 bp, Homo sapiens
  misc_feature: GYAE6OF01CZIKN.21.8.A08.1.454.CMB.1.raw
  modified_base (413)..(413): a, c, t, g, unknown or other
  misc_feature (413)..(413): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctcagagatccctgagcgattctctggctccagctcgagggacagcagtcacgttgactatcagtgaacgtcaggcagaggacgaggctgactattactgtacaaanagtaagacagtagagtactcgagttgggtgttcgggcgggagggacccaaggtcctaggacccgtccgtagggtcaggcccaagggtcctacccgg

SEQ ID NO: 88450 - DNA, 543 bp, Homo sapiens
  misc_feature: GYAE6OF01CCX2G.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggcgtgtgggctcaggaggcagagcgtctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcaattgaccaaaagatatacttgttggttccagtcagaagtcaggccaaggcccctgtactggtccatccatgagccagtcgacgacactccgggatccccgtggacgagacttctctcgcctccagcctacgaggacagtcggcctaccttcgacctatcaggtcgggcccagggtcgacgagtgaagctagactatagttgttacgcaccagacagtagtggtcagtcgaggggtactcggcggagggaccaaggttcgaccggtcgttaggtacacggcccgaaggcctcggaccccctggtccacgtcgtcccg

SEQ ID NO: 88451 - DNA, 524 bp, Homo sapiens
  misc_feature: GYAE6OF01BATYE.21.8.A08.1.454.CMB.1.raw
  modified_base (312)..(312): a, c, t, g, unknown or other
  misc_feature (312)..(312): n is a, c, g, or t
  modified_base (372)..(372): a, c, t, g, unknown or other
  misc_feature (372)..(372): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggatcacctgctctgcagatggactgaccaaagaaatatgcttattggtaccaacagaagccaggccaggcccctgtcgttagtgatataataaagacactgagaggccctnagagactccctgagcgattctctggctccagctacgagggacagcagtcacgttgactancagtgaagtccgaggcaggacggacgaggactgaacttattactgtacaaacgagtaagactagtagagtactcgtagttggtgttacgggacgggtacgggaccgaaggcgtcggaccgtccgtaggtcaacgcccgaggccgtaccccgg

SEQ ID NO: 88452 - DNA, 515 bp, Homo sapiens
  misc_feature: GYAE6OF01ASHMX.21.8.A08.1.454.CMB.1.raw
  modified_base (220)..(220): a, c, t, g, unknown or other
  misc_feature (220)..(220): n is a, c, g, or t
  modified_base (425)..(425): a, c, t, g, unknown or other
  misc_feature (425)..(425): n is a, c, g, or t
  modified_base (460)..(460): a, c, t, g, unknown or other
  misc_feature (460)..(460): n is a, c, g, or t
  modified_base (507)..(507): a, c, t, g, unknown or other
  misc_feature (507)..(507): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgccctccagcctcagggaccaggtcggacccaccttgacttatcgaggtcgggcccagggtggacgagtgaagctgacttactattgtacncacagacagtagtggtcagtcgaggggttatcggnggaggacagttgaccgtctggcagcccaggcctcgccccgtggtccncgtctccg

SEQ ID NO: 88453 - DNA, 567 bp, Homo sapiens
  misc_feature: GYAE6OF01BXGXG.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcgatgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccgtgagagattctctcgccctcgagctcgaggggaccaggtcggcccacgttgactatcgaggtcggggcccagggtcggaacgagtacggaagtcgtagtacttacgttattcggttacgcaaccgagacagtagtggtacagttcggaggggttactcgggcggaacgggacgtaaggttcgacccggttccgttggtccgacggacccgaaggtccctccggcccccgtcggtccaccgttcccg

SEQ ID NO: 88454 - DNA, 502 bp, Homo sapiens
  misc_feature: GYAE6OF01AXSZX.21.8.A08.1.454.CMB.1.raw
  modified_base (494)..(494): a, c, t, g, unknown or other
  misc_feature (494)..(494): n is a, c, g, or t
tcagtcgtcgctcgcacgaccggtgctcgatttagcatactctacaggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcgagggacagtggccacttgactatcagtgggcccaggtggacgatgaagctgactactatgttacgcacagacagtagtggtcagtcgaggggtatcggcggagggaccaaggttgaccgtcttggcacgcccgaaggctcgccccctggtcncgtctccg

SEQ ID NO: 88455 - DNA, 563 bp, Homo sapiens
  misc_feature: GYAE6OF01AL3Z2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatcccgtgagagtattctctgccctccagcctcgagggacaggtcggcctaccttgaacttatcgaggtcggggcccagggtcggacgagtggaagtctagactactagttagttacgcaccgagacagtagtggtactagtcggaggggtagttcgggcggtaacgggacctaaggttcgacccggttcgttggtcgacgacccgaacggccgtcggcccccgttaggtcctaccgtccgttcccgg

SEQ ID NO: 88456 - DNA, 581 bp, Homo sapiens
  misc_feature: GYAE6OF01EDCQL.21.8.A08.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtgtccccaggacaaacggccaggatcacctgctctggagattcattgaccaaaagatatacttgttggtccagcagaagtcaggccaggcccctgtactggtcatccatgacggccagtcgacgacactccgggatccctagagagattcnctgccctcagctcgaggacagtcggccacgttgactatcgaggtcgggaccctaggtcggacgagtaggaacgcgtagaacttacgttattcgttaccgactaaccgagacgtaaggtaggttggtactaagttcggaggggttacttcgggacgggaagggtacctaaggttcggaccgttcgttaggtaccgtacggacccgaaggtcccgtccggacccccgttaggtcctccgttccgttacccgg

SEQ ID NO: 88457 - DNA, 527 bp, Homo sapiens
  misc_feature: GYAE6OF01BA3WR.21.8.A08.1.454.CMB.1.raw
  modified_base (220)..(220): a, c, t, g, unknown or other
  misc_feature (220)..(220): n is a, c, g, or t
  modified_base (516)..(516): a, c, t, g, unknown or other
  misc_feature (516)..(516): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgccctccagctcgagggacagtcggccacttgactatcgaggtcgggccaggtcggacgatgaagctagactactattgttacgcacagacagtagtggtcagtcgaggggtagttcgggcggagggacctaaggttcgaccgtccgttggcgacgcccgaaggcctcgcccccgtggtccnccgtcgtcccg

SEQ ID NO: 88458 - DNA, 536 bp, Homo sapiens
  misc_feature: GYAE6OF01BD1BJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatcccctgagagattctctgccctccagctcagggacagtgccaccttgactatcagtgggcccaggtggacgatgaagctgactactattgttacgcaccagacagtagtggtcatcgagggggtattcgggcgggagggaccgtaaggttcgaccggtccgttggtccacggccccgaagggcctcggccccccgttcgggtcctaccgtccgttcccgg

SEQ ID NO: 88459 - DNA, 492 bp, Homo sapiens
  misc_feature: GYAE6OF01EEGPK.21.8.A08.1.454.CMB.1.raw
  modified_base (464)..(464): a, c, t, g, unknown or other
  misc_feature (464)..(464): n is a, c, g, or t
  modified_base (484)..(484): a, c, t, g, unknown or other
  misc_feature (484)..(484): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatccctgagagattctctgcctccagctcagggacagtggccacttgactatcagtcgggccaggtggacgatgaagctgactactattgtacgcaccagacagtagtggtcagtcgaggggtatcggcggaggacagtgaccgtctggtcngccgagctcgcccctggtcncgtctccg

SEQ ID NO: 88460 - DNA, 574 bp, Homo sapiens
  misc_feature: GYAE6OF01APXNE.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttgttccagcagaagtcaggccaggcccctgtactggtcatccatgaggccagtcgacgacactccgggatccctgacgagacttctctcgccctccgagcctcgagggacaggtcggcctaccttgactactcgaggtcgggcccagggtcggacgagtgaacgctgactactagttgtaccacacgagactagtaggtgtctagtcggtaggggtagttcgggacgggacgggtaccgtaaggttcgtaaccggttcgttagggaacgtcccggaacgggtccgtccggtcccccgttcggtaccctacgtccgttcggttcccccg

SEQ ID NO: 88461 - DNA, 789 bp, Homo sapiens
  misc_feature: GYAE6OF01BT4LQ.21.8.A08.1.454.CMB.1.raw
tcagtcgtcgctcgcacgaccggtgctcgatttagcatactctacagggggacggtgtgggctccaggaggcagagcgtcgtgggtaactcttcgacatcggcctcggacccctctacctgctccccgtcctcacctttctggctacggtcgtctcgtgtagggtccctttcctagtcgtacgttactaggacaccagtcccacccgtggtgtcagtcgtcccgaggacaacggcggaggctcgacctgcctggtaggactagttcgattcgaccaaaaggatactacgttgttcggttaccgagtctaacgtaagtcgaggacctacggcccctagtactggtcaacgttccgacgtacggacggccctaggtaccggaccgaaccggtaccgttacccggggattccccggtaggacgtaaggtaactttcctcgtacggtacctaccgtaagtccgttaacgggaacgggtaactaggtaccggtacctaccgttaggtaaccgtaacgttccggacgggttacggggcccgtaagggtccggaacgtaacgttacggaaacgtacgtacgtaaccgttaacgtaagttacgtaaccgacctaacgtaacgtaacgtaacgtaacgtcggtaacgacgttaccggtaaggggttaacgtcgggaccgggtaagggaacccgtaacggttaccgggacccgtttcgggttaggtacgtaccggtaccgtaacggtaccgttaacccgtccccgttaccgggtaccgtaccggtacggttacccccgg

SEQ ID NO: 88462 - DNA, 521 bp, Homo sapiens
  misc_feature: GYAE6OF01C4X4S.21.8.A08.1.454.CMB.1.raw
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaatatgcttattggtaaccaacagaagccaggccaggcccctgtgttagtgatataataaagacactgagacgccctnagagactcctagagcgattcncgtggctcagctcgagggacagcagtcagttgactatcagtgaagtcgaggcagaggacgagctgactatactgtacaaacgagtagacagtagagtactcgtagttgggtgttacgggacgggaaggaccgaaggcgtacggtacccgtcgtaacggtcacggaccccgaagggtccctaccccggg

SEQ ID NO: 88463 - DNA, 647 bp, Homo sapiens
  misc_feature: GYAE6OF01BCW96.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctctggagattcattgaccaaaagatatacttgttggttccagcagaagtcaggccacggcccctgtactggtcatccatgagccagtcgacgacacgtccgggactcccgagagagtacttctctcgccctccagcctacgacgggacaggtcgcctacgttgacttagtcgaggtcggggacccagggtacggacgtagtacggaagtcgtagaacttacttagtttacgttaaccgctaaccaaggacgtaaggttacggttcggtactacgttacgggtagggggttacttacggggacgggtaacgggtaaccgtaagggttaccgggtacccggttccgtttagggaccgtaaccgggaccccggtaaacgggtcccgttacccgggacccccccgttagggttacccctaccgttcccggttcccccgg

SEQ ID NO: 88464 - DNA, 521 bp, Homo sapiens
  misc_feature: GYAE6OF01A54N6.21.8.A08.1.454.CMB.1.raw
  modified_base (238)..(238): a, c, t, g, unknown or other
  misc_feature (238)..(238): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggccctgtgttggtcatccatgaggacaggagacgaccctccgggatccctgagagattctctggctccaactcagggacggtggccacgttgattctcagtggggcccaggtggaggatgaagctgactactactgttactcagcagacagcagtgtcatcgaggggtcagttcggcggagggacgaggttgaccgtccgtaggtcaggcccgaaggcctcgcccccgtcggtccactcctcgttcccgtcccc

SEQ ID NO: 88465 - DNA, 550 bp, Homo sapiens
  misc_feature: GYAE6OF01DQHFV.21.8.A08.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctggagattcattgaccaaaagaatatacttgttgttccagcagaagtcaggccaggcccctgtactggtcatccatgaggccagtcgacgacacgtccgggatccctgagagtattctctcgccctccagctcgaggacnggtcggcctacttgactatcgaggtcggggcccagggtggacgagtgaagctgactactagttcgtacgcaccagacagtagtggtacagtcggaggggttatcgggacgggaagggaccgaaggttcgacccggttccgttggtcacgacccgaggcctccggtcccccgttcggtccaccgttcgttacccg

SEQ ID NO: 88466 - DNA, 502 bp, Homo sapiens
  misc_feature: GYAE6OF01BVR8I.21.8.A08.1.454.CMB.1.raw
  modified_base (495)..(495): a, c, t, g, unknown or other
  misc_feature (495)..(495): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgttgttccagcagaagtcaggccaggcccctgtactggtcatccatgaggccagtcgacgacactccgggatccctgacgagattctctgcctccagctcaggacagtggccaccttgactatcagtgggcccaggtggacgatgaagctgactactattgttacgcaccagacagtagtggtcatcgagggggtattcggcggagggaccaagtgaccgtcttggcagcccaaggcctcggccccctggtccncgtctcg

SEQ ID NO: 88467 - DNA, 520 bp, Homo sapiens
  misc_feature: GYAE6OF01ERDE7.21.8.A08.1.454.CMB.1.raw
tcagtcgtcgctcgcacgaccggtgctcgatttagcatactctacaggggctgtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattatgtttttggtaccagcagaagtcaggccaggccctgtgttggtcatccatgaggacaggagacgaccctccgggatccctgagagattctctggctccaaactcagggacgtggccacgttgattctcagtggggcccaggtggaggagtgaagctgactactactgttactcagcagacagcagtgtcatcgaggggcagttcggcggagggaccgaggttgaccgtccgtaggtcagcccgaaggcctcggccccctcggtcactctcgttcccgtccccg

SEQ ID NO: 88468 - DNA, 494 bp, Homo sapiens
  misc_feature: GYAE6OF01BWGJJ.21.8.A08.1.454.CMB.1.raw
  modified_base (467)..(467): a, c, t, g, unknown or other
  misc_feature (467)..(467): n is a, c, g, or t
  modified_base (487)..(487): a, c, t, g, unknown or other
  misc_feature (487)..(487): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgcctccagctcaggacagtggccacttgactatcagtgggcccaggtggacgatgaagctgactactattgtacgcaccagacagtagtggtcagtcgaggggtatcggcggaggaccaggtgaccgtctggtcncgccaggctcgcccctggcnctctccg

SEQ ID NO: 88469 - DNA, 531 bp, Homo sapiens
  misc_feature: GYAE6OF01CWTM5.21.8.A08.1.454.CMB.1.raw
  modified_base (221)..(221): a, c, t, g, unknown or other
  misc_feature (221)..(221): n is a, c, g, or t
  modified_base (519)..(519): a, c, t, g, unknown or other
  misc_feature (519)..(519): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctgganattcattgaccaaaagaatatacttgttggttccagcagaagtcaggccaggcccctgtactggtcatccatgaggccagtcgacgacactccgggatccctgagagattctctgcctccagctcgagggacagtggccaccttgactatcaggtcggggcccaggtggacgatgaagctgactactattgttacgcaccagacaagtagtggtcagtcgaaggggttattcgggcggtagggaccgaggttcgaccggttccgttggtcagcccgaaggcctcggccccctggtccncgtcgttcccgg

SEQ ID NO: 88470 - DNA, 596 bp, Homo sapiens
  misc_feature: GYAE6OF01ADDO6.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgacgccagtcgacgacacgtccgggatcccgtgagagattctctgcctccagctcgagggacaggtcggcctaccttgaccttagtcgacggtcggggcccgagggtcgggaacgtagtcggaagtctagtaacttacgtagtttcgttacgaccaaccgagactagtaggtcgtacgtagtcggtaaggggttacgttacgggacgggtacgggacgtaaggttcggacccggttcgttcggtacgacggtacccgtaaggcccgttccggacccccgttcggtaccctaccgttccgttaccccg

SEQ ID NO: 88471 - DNA, 528 bp, Homo sapiens
  misc_feature: GYAE6OF01B73RC.21.8.A08.1.454.CMB.1.raw
  modified_base (321)..(321): a, c, t, g, unknown or other
  misc_feature (321)..(321): n is a, c, g, or t
  modified_base (517)..(517): a, c, t, g, unknown or other
  misc_feature (517)..(517): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgagccagtcgacgacacgtccgggatcccgngagagacttctctgccctcagctcgaggcagtcggcctaaccttgacctatcaggtcgggccgaggtggacgagtgaagctagactactattgtacgcacagacagtagtggtcagtcgaggggtagtcgggacggagggaccgtaagtcgaccggtcgttggtcgacgcccgaagccgtcgcccccgttggtccncgtccgtccgg

SEQ ID NO: 88472 - DNA, 551 bp, Homo sapiens
  misc_feature: GYAE6OF01AGKTB.21.8.A08.1.454.CMB.1.raw
  modified_base (539)..(539): a, c, t, g, unknown or other
  misc_feature (539)..(539): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactgtcatccatgaggccagtcgacgacacgtccgggatccctgagagattctctgccctccagctcgagggacaggtcggaccctaccgttgacttatcgaggtcggggccccagggtcggacgagtagaagctagactactattacgttacgcaccagacagtagtggtctagtcgaggggtacgttcgggcggtacggacgtaaggttcggacccggttcgttggtacgcgcccgaaggcctccgcccccgtcggtccncgttccgtcccg

SEQ ID NO: 88473 - DNA, 510 bp, Homo sapiens
  misc_feature: GYAE6OF01BCM4V.21.8.A08.1.454.CMB.1.raw
tcagtcgtcgctcgcacgaccggtgctcgatttagcatactctacaggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggctcctttgccatgcactgggtccgccaggctccaggcaaggggctgggagtgggtggcgattatctggtatgatgggaagtgagagatattattcagactccgtgaagggccgattcaccatctccagagacaatgaccaacaaacacactgtatcttacaaatgaccggctgagagccgagacacggctatgtattactgtacgagctttggctagttcggggaccagggaaccctggtac

SEQ ID NO: 88474 - DNA, 497 bp, Homo sapiens
  misc_feature: GYAE6OF01BOT9M.21.8.A08.1.454.CMB.1.raw
  modified_base (489)..(489): a, c, t, g, unknown or other
  misc_feature (489)..(489): n is a, c, g, or t
tcagtcgtcgctcgcacgaccggtgctcgatttagcatactctacaggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatccctgagagattctctgccctcagctcaggcagtggccaccttgactatcagtgggcccaggtgacgatgaagctgactactattgtacgcacagacagtagtggtcatcgaggggttattcgggcggagggaccaagttgaccgtccttggtcagcccaaggctgcccctggtcncctgtccg

SEQ ID NO: 88475 - DNA, 630 bp, Homo sapiens
  misc_feature: GYAE6OF01AYVY4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccagcccctgtactggtcatccatgaggccagtcgacgacacgtccgggatccctgagagactttcctcgtcgccctccgagtcctcgagggacaggtcggaccctaccttgaccttatcgaggtcggggccccagggtggaacgtagtagaacgtctagacttaacttagtttacggttacgccaacagaacgtaggtagtcggtactagttacggtagggggttacgttccgggacgggaacgggtaccgtaaagggttccgggtaacccggttcccgtttgggtaccgtaccggaccccgtaaacgggtcccgtacccggacccccccgttaccgggtccctacccgttccgttcccccgg

SEQ ID NO: 88476 - DNA, 533 bp, Homo sapiens
  misc_feature: GYAE6OF01BVT1H.21.8.A08.1.454.CMB.1.raw
  modified_base (519)..(519): a, c, t, g, unknown or other
  misc_feature (519)..(519): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatcccctgagagattctctgcctccagctcagggacagtcggccaccttgactatcaggtcggggcccagggtggacgagtgaagctgactactattgttacgcaccagacagtagtggtcagtcgaggggtattcgggacgggagggacctaaggttcggaccggtcgttggcacggccccgaaggcctcgcccccgtcggtccnccgtccgttcccgg

SEQ ID NO: 88477 - DNA, 550 bp, Homo sapiens
  misc_feature: GYAE6OF01B9TFI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccgtgagagattctctgccctccagctcgagggacaggtcggccaccgttgacttatcgaggtcggggcccgagggtggacgagtggaagctagactactattgttacgcacagacagtagtggtacagtcgagggggtattcgggacggagggaccgaaggttcgaccggttccgttggtacgacggacccgaaggccgtccgcccccgtcggtccaccgttccgtcccgg

SEQ ID NO: 88478 - DNA, 618 bp, Homo sapiens
  misc_feature: GYAE6OF01CC4WO.21.8.A08.1.454.CMB.1.raw
tcagtcgtcgctcgcacgaccggtgctcgatttagcatactctacagggggctgtgggctcaggaggcagagctctgggaatctcaccatggccttggacccctctcctgctccccctcctcactttctgcacagtctctgaggcctcctatgagtctgacacagtccaccctcggtgtcagtgtccccaggacaaacggccaggatcgacctgctctggagattcattgaccaaaagatatacttgttgttccagcagaagtcaggccaggcccctgtactggtcatccatgaggccaggtcgacgacacgtccgggactccctgacgagtacttctactgcctccagtctcgaggacaggtcggaccctaccttcgaacttatcgacggtcgggacccagggtcggaaccgtataggaaagcttaggtaactttaacgtaatttacgttaacgacctaaccgaacgacgtaaggttaaggtcggtactagttacggtagggggttacttcgggacgggtaacgggaccgtaaaggttcggaccggttccgttggtaccgtcggacccgaaggtccgttaccggtcccccgttagggtcctaccgttccgttacccg

SEQ ID NO: 88479 - DNA, 534 bp, Homo sapiens
  misc_feature: GYAE6OF01DX1MV.21.8.A08.1.454.CMB.1.raw
  modified_base (393)..(393): a, c, t, g, unknown or other
  misc_feature (393)..(393): n is a, c, g, or t
  modified_base (521)..(521): a, c, t, g, unknown or other
  misc_feature (521)..(521): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccctagagagattctctgccctccagctcgagggacaggtggccaccttgactatcagtgggcccaggtggacgngtagaagctagactactattcgttacgcaccagacagtagtggtcagtcgaggggtattcgggcggagggaccgaggttggacccggttccgttggtcacggcccaaggcctcggcccccgtggtccncgttccgtcccgg

SEQ ID NO: 88480 - DNA, 561 bp, Homo sapiens
  misc_feature: GYAE6OF01DP17F.21.8.A08.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggccctgtactggtcatccatgaggccagtcgacgacacgtccgggatccctgagagattcnctgcctccagctcgagggacaggtcggccctacttgaacttatcgaggtcgggcccgagggtcggacgagtgaagctagacttactatttgttacgcaccagacagtagtgtcagtcgtaggggtagttcgggacggagggaaccgtaaggttcgaccgttccgttcgggtccaggcccgtaaacggccgtcgccccccgttcggtacctaccgtccgttcgttccccgtcccccg

SEQ ID NO: 88481 - DNA, 612 bp, Homo sapiens
  misc_feature: GYAE6OF01ERGJ2.21.8.A08.1.454.CMB.1.raw
tcagtcgtcgctcgcacgaccggtgctcgatttagcatactctacgagggggctgtgggctcaggaggcagagctctgggaatctccaccatggcctggacccctctcctgcctccccctcctcactttctgcacagtctctgaggcctcctatgagctgacacagcccaccctcggtgtcagtgtccccaggaccaaacggccaggatcacctgctctggagtattcattgaccaaaagattatacttgttggtccagcagaagtcaggccaggcccctgtactggtcatccatgacggccagtcgacgacactccgggatccctgacgagtattctcgtggcccttccgagtccgtacgaaggggacctacggtcggaccctacctttgaactactcgtaggtcggggccccgagggtcggacgtagtagaagacgtgaactactattacgttacgacaccgagacgaggtacgtcggtactagtcggtaaggggtacgttacggggacgggagggaccgtaaggttacgtacccggttccgttagggtccgtacgacccgaaggtccgtaccggacccccgttaccggttcctacccgtcgttaccccg

SEQ ID NO: 88482 - DNA, 727 bp, Homo sapiens
  misc_feature: GYAE6OF01DB7YP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagtattcattgaccaaaagatatacttgttggttccagcagaagtcaggccaggcccctgtactggtcatccatggagccagtcgacgacacgtccgggatcccgtagagagtattctctcgccctccagcctcgagggacaggtcggacctacggttgactttcgtcgtacgggtcggggaccccgaggggtacgggaaggtagtaggaacgtcgttacgtaacgttaacgttacgttacgtttaaccgtacgaacgtaccgaaggaaccgtaaggtaccgtaacgggttacgggtaccgttaacggttaccgggaacggggggtaccgtaacgggtttcccgggggaccgggggtaacggggtaacccgggttaacggggtttaacccgggtaacccccgggtttacccgggttaacggggttaccccgtaaaccggggtaccccccggtaaaacggggtccccgttacccccgggttccccccccggttaccggggttaacccccg

SEQ ID NO: 88483 - DNA, 484 bp, Homo sapiens
  misc_feature: GYAE6OF01A3NSC.21.8.A08.1.454.CMB.1.raw
  modified_base (410)..(410): a, c, t, g, unknown or other
  misc_feature (410)..(410): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggatcacctgctctgcagatggactgccaaagaatatgcttattggtaccaacagaagccaggccaggccccctgtcgttagtgatatataaagacactgagaggccctcagagatccctgagcgattctctggctccagctcagggacagcagtcacgttgactatcagtgaagtccaggcagagacgagctgactatactgtacaaanagtagacagtagagtactgagttgggtgtcggcggagggacaggctgaccgtctaggcagcccaaggctcccgg

SEQ ID NO: 88484 - DNA, 572 bp, Homo sapiens
  misc_feature: GYAE6OF01APJBC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagtattctctgccctccagctcgaggacagtcggccaccttgactatcgaggtcggggcccagggtcggacgagtgaagctagactactattgttacgcaccagacagtagtggtcagtcgaggggtagttcgggcgggtaacggggaccgtaaaggttcggtacccggttccgtttagggtacctacggaccccgtaaagggccctccggtccccccgttacgggtccctaccgttccgttaccccgg

SEQ ID NO: 88485 - DNA, 526 bp, Homo sapiens
  misc_feature: GYAE6OF01DF9EQ.21.8.A08.1.454.CMB.1.raw
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgagccagtcgatgacactccgggatccctgagngattcnctgcatccagctcgagggactaggtcggcctaccttgactatcgaggtcgggcccgtaggtggacgagtgaacgcgtagactactagttgtacgcaccgagactagtagtgtactagtcgaggggtagtcgggcggagggacgaaggttcgaccgttcgtggtcagcccgaacggctcgcccccgtgtccgtaccg

SEQ ID NO: 88486 - DNA, 576 bp, Homo sapiens
  misc_feature: GYAE6OF01A0ZY8.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatcgaggccaggtcgacgacacgtccgggactcccgtagagagtacttctctcgccctcgagctcgagggacaggtcggacctaccgttgactagtcgaggtcgggcccgagggtcggacgagtagaagcgtagtacttactattcgtacgcacgagacgtagtagtggtactagtacggtaggggtacgtcgggacgggacggaccgtaggttcggtacccgttcgttggcgacggcccgaacggtccgtaccggcccccgttaggtccctccgttccgttcccg

SEQ ID NO: 88487 - DNA, 513 bp, Homo sapiens
  misc_feature: GYAE6OF01BF1J4.21.8.A08.1.454.CMB.1.raw
  modified_base (481)..(481): a, c, t, g, unknown or other
  misc_feature (481)..(481): n is a, c, g, or t
  modified_base (504)..(504): a, c, t, g, unknown or other
  misc_feature (504)..(504): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatccctgagagattctctgccctccagctcgagggacagtcggccaccgttgactatcgagtcgggcccaggtggacgagtgaagctgactactattgtacgcacagacagtagtggtcagtcgaggggtatcgggcggagggactaggttcgaccgtcgttggcgngcccgaaggctcgcccctggtcncgtcgtccg

SEQ ID NO: 88488 - DNA, 638 bp, Homo sapiens
  misc_feature: GYAE6OF01CCNC6.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtcgtcccaggacaaacggccaggatcacctgctctgganattcattgaccaaaagatatacttgtgtcagcagaagtcaggccaggcccctgtactggtcatccatgagccagtcgacgacacgtccgggatcccgtgagagattctctcgcctccagctcgaggacagtcggacctaccgttgactatcgaggtcgggacccagggtcggacgagtaggaaacgtcgtaggaacttaacgttaacgtttcggtttaaccggacctaaccaacgtaaccgtaaggttaaggtggttacccaaggttaccggaaggggggttacgttcgggacgggttaacgggacccgtaaaggttccggaacccggtttccgttgggttaccgacggtaccccgaaacgggttcccgtaccggtacccccccgttacggggttccctaacccgttcccgtttcccccgg

SEQ ID NO: 88489 - DNA, 550 bp, Homo sapiens
  misc_feature: GYAE6OF01EITI7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccaggtcgacgacacgtccgggatccctgagagattctctgccctccagctcgaggacaggtcggccacttgactatcgaggtcgggccagggtggacgagtgaagctagacttactattcgtacgcacgagacagtagtggtacagttcggaggggttatcgggcgggaagggaccgtagttcgtaccggtccgttgggtaccacggacccgaaggccgttccggacccccgttcggtacctccgtccgttcccg

SEQ ID NO: 88490 - DNA, 534 bp, Homo sapiens
  misc_feature: GYAE6OF01EVPN5.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgccctccagctcgagggacaggtcgccaccttgactatcgaggtcgggcccgaggtggacgagtagaagctagactactattgttacgcaccagacagtagtggtactagtcgtaggggtagtcgggacggagggacctaggttcgaccgtcgttggtcacgcccgaaggccgtcgcccccgtggtcctcgtcgtcccg

SEQ ID NO: 88491 - DNA, 728 bp, Homo sapiens
  misc_feature: GYAE6OF01C5ZON.21.8.A08.1.454.CMB.1.raw
tcagtcgtcgctcgcacgaccggtgctcgatttagcatactctacgagggggctgtgggctcaggaggcagagctctgggaatctcaccatcggcctggaccccctctcctcggcctccccctcctcactttctgcacagtctcgtggggcctcctatgagctgacacagcccaccctcggtcgtcacgtcgtccccaggacaaacggccaggactcacctgctctggacgattcattgaccaaagatatacttgtgtccagcagaagtcaggccacggccctagtacgtggtcactccagtcggacggccagtacgaacgacaccgtccgggaactccccgtagacggacgtattccgtacgtcgtccctaccgacgtcgtacgtaacggggactaacggttccggaccctaaccgtttacggaaaccttacgtccgtaacgggttaccggggacccgtaacggggttacggaaccgggtagtacgggaacggtcgtacggtaaccgttaacgttagtttacggttaccgtaccgtaaccgtaacgaccgtaggttacgtacggttacgtaacgttaccgggtaaggggttacggttcgggacgggtaacgggtaccggtaacgggtaccggtacccggttaccgttacgggtaccgtaacggtacccgaaacgggtccgtacccggacccccgttacgtaccgtacctcccgtcccgttacccccg

SEQ ID NO: 88492 - DNA, 676 bp, Homo sapiens
  misc_feature: GYAE6OF01B77H5.21.8.A08.1.454.CMB.1.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctggaggcctcctatgagctgacacagcccacccgtggtgtcagtcgtccccaggacaaacggccaggatcactgctctggganattcattgaccaaaaagatntacttgttaggttcagcagaagtcaggccaggcccctgtactggtcatccagtcgaggccagtcgagacacgtcgggatccctgacgagacttctacgtcgccctaccaggcttacgaggggacaggtcggacctaccgtttggaaccttagtccgagggtcggggaccccgaagggtcgggaacggtaagtacggaaacggtctacggtaaccttaacgttagtttacgttaaccggacctaaccgaaggacgtaacggttagtacggtactaagtacggtaagggggttacgttcggggacgggtaacgggtaacccgtaagggttaccgtaccggtttaccgtttcgggtaccggtaaaccggcccgtaaacgggtcccgttacccgggtaccccccgttagggttccctaacccggttccgtttaccccgg

SEQ ID NO: 88493 - DNA, 511 bp, Homo sapiens
  misc_feature: GYAE6OF01D4U4R.21.8.A08.1.454.CMB.1.raw
tcagtcgtcgctcgcacgaccggtgctcgatttagcatactctacaggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggctcctttgccatgcactgggtccgccaggctccaggcaaggggctggagtgggtggcgattatctggtatgatggaagtgagagatattatcagactccgtgaagggccgattcaccatctcagagacaatgaccaacaacacactgtatcttacaaatcgaccggctgagagccgaggacacggctatgtattactgtacgagtctttggctagttcggggaccagggacccctggtacccg

SEQ ID NO: 88494 - DNA, 725 bp, Homo sapiens
  misc_feature: GYAE6OF01DHZ4Y.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctggatattcattgaccaaaagatatacttgttggtccagcagaagtcaggccaggccctgtactggtcatccatgacgcagtcgacgacacgtccgggatcccgtagacgtagtactttcgtctcggcccttaccaggtccttacggaacggggtacctagggtccgggaccctacccgtttaggaaccttaacgttcgtacgggttccggggaccccgtaggggtacggggtacgttagggaagttaggaacggtccgttacggtaacctttaacgttaacgttttcggtttaaccgaccgtaacccgtaaggtaccgtaaggttacggtacgggttacgtaaggttcgggtaacgggggttacgttaccggggtacggggtaacggggtaacccgtaagggtttaccgggtaaccccggtttccggttacgggttcccgtaccggtaccccgtaaacgggttcccgtcccggtaccccccgttccgggtcccgtacccgtttccccgg

SEQ ID NO: 88495 - DNA, 534 bp, Homo sapiens
  misc_feature: GYAE6OF01DTM7Z.21.8.A08.1.454.CMB.1.raw
  modified_base (217)..(217): a, c, t, g, unknown or other
  misc_feature (217)..(217): n is a, c, g, or t
  modified_base (461)..(461): a, c, t, g, unknown or other
  misc_feature (461)..(461): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagccaccctcggtgtcagtgtccccaggacaaacggccaggatcacctgctctgganattcattgaccaaaaagatatacttgttggttccagcagaagtcaggccaggcccctgtactggtcatccatgaggccagtcgacgacacgtccgggatcccgtgagagattctctcgccctccagctcgagggacaggtcggccacgttgactatcgagtcgggcccgagggtggacgagtagaagctagactactattgttacgcaccagacagtagtggtacagtcgaggggttatcgggnggacgggacaggttgaccggttcttggtcacgcccgaaggcctccgcccccgtcggtcctccgtccgttcccg

SEQ ID NO: 88496 - DNA, 530 bp, Homo sapiens
  misc_feature: GYAE6OF01EZ4A1.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgccctccagctcgagggacaggtggccacttgactatcaggtgggcccaggtggacgagtgaagcgtagactacttattgtacgcacagacagtagtggtacagtcgtaggggtatcgggcggagggacctaaggttcgaccgtcgttggcacgacccgaaggcctcggccccccgtggtccaccgtccgttacccg

SEQ ID NO: 88497 - DNA, 516 bp, Homo sapiens
  misc_feature: GYAE6OF01A157I.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctgcctccagctcgaggacagtggccaccttgactatcaggtcgggcccagggtggacgatgaagtctgactacgtattgttacgcaacgagactagtagtgtacatcggaggggtatcggcggagggacaagttcgaccgtcgttggcacgcccaaggcctcgaccccctggtcctcgtcgtccg

SEQ ID NO: 88498 - DNA, 701 bp, Homo sapiens
  misc_feature: GYAE6OF01BZWCU.21.8.A08.1.454.CMB.1.raw
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagtcgtcgctcgcacgaccggtgctcgatttagcatactctacagggggacggtgtgggctccaggaggcagagctctgggtaatctcgaccatggcctggacccctctacctgctcccccgtcctcactttctggctacgagtctctgagggtcctccttatgagtactgacacagccaccctcggtgtcagtgtccccgaggacaacggccgaggatcgacctgcctcgtggacgattcgattgaccaaaagatatacgttgttggttccagtcagtaagtcaggccaggcccctgtactggtcatccgatgaggccagtcgacgacacgtccgggatcccgtggaganattcnctgccttcagctcgaagggtacagtcggacctaccgtttgaaccttagtcgacggtcggggacccgtagggtacggtacgaacgttacggtaaacgcgtaggaaccttaacttacgtttacgttaaccgacctaaccgtaagtaacgtaaggttacggtacggtacgtaagttaccggtaacgggggttacgttacggggaacggggtacgggtaaccgtaaagggttaccggaacccggtttccggtttagggttaccgtaacgggtaccccgtaaacgggtccgttaccgggtacccccccgtttacgggtcccgtaaccggttcccggtttaacccccgg

SEQ ID NO: 88499 - DNA, 571 bp, Homo sapiens
  misc_feature: GYAE6OF01CG8PQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttgttcagcagaagtcaggccaggcccctgtactggtcatccatgaggccagtcgacgacacgtccgggatccctgagagtacttctctgccctccagctcgagggacaggtcggccctaccgttgacttatcgaggtcggggcccgagggtcggacgagtaggaacgcgtagacttaacgtagtttgttaccgcaccgagacagtagtcggtactagtcggaaggggttattcgggacgggtacgggaccgtaaggttcggaccgttccgttggtcacgacccgaacggccgtccgcccccgttggtcctccgttccgttacccg

SEQ ID NO: 88500 - DNA, 564 bp, Homo sapiens
  misc_feature: GYAE6OF01DD2PJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgagccagtcacgacactccgggatccctagagagatttctctcgccctcagctcgagggacaggtcggccctacgttgactatcgaggtcggggccagggtgacgagtgaagctagactactattgtacgcacagacgagtaggtgtactagtcggtaggggttacgttcgggacgggaacggtaccgtaaaggttcggacccggttcgttgggtacgtacggaccccgaagggcctaccggcccccgttacggtcccaccgtccgttaccccg

SEQ ID NO: 88501 - DNA, 569 bp, Homo sapiens
  misc_feature: GYAE6OF01AKDKV.21.8.A08.1.454.CMB.1.raw
  modified_base (219)..(219): a, c, t, g, unknown or other
  misc_feature (219)..(219): n is a, c, g, or t
  modified_base (514)..(514): a, c, t, g, unknown or other
  misc_feature (514)..(514): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcacctgctctgganattcattgaccaaaagatatacttgttggttccagcagaagtcaggccaggcccctgtactggtcatccatgagccagtcgacgacacgtccgggactcccgtgagagtattcctctcgccctccagctcgagggacagtcggccctacttgactagtcgaggtcggggcccgtagggtggacgagtggaagtcgtagtacttactagttcgtacgcacagactagtagtggtactagtcggaggggtacttcgggacggtacggacgtaacggttcgaccggttccgttggacncggacccgaacggtccgtccggtccccccttacgggtcctccgttccgttccccg

SEQ ID NO: 88502 - DNA, 523 bp, Homo sapiens
  misc_feature: GYAE6OF01DAH35.21.8.A08.1.454.CMB.1.raw
  modified_base (218)..(218): a, c, t, g, unknown or other
  misc_feature (218)..(218): n is a, c, g, or t
  modified_base (367)..(367): a, c, t, g, unknown or other
  misc_feature (367)..(367): n is a, c, g, or t
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtgtccccaggacaaacggccaggatcacctgctctgganattcattgaccaaaagatatacttgttggttccagcagaagtcaggccaggcccctgtactggtcatccatgaggccagtcgacgacactccgggatccctgagagattctctgccctccagctcgagggacagtggccaccttgactntcaggtcgggccaggtggacgatgaagctgactactattgtacgcaccagacagtagtggtnagtcgtaggggtattcgggacggacgggaccaaggttcgacccgttcgttggtcacgacccgaaggccgtcgccccctggtccncgtccgtccg

SEQ ID NO: 88503 - DNA, 580 bp, Homo sapiens
  misc_feature: GYAE6OF01DC6Z4.21.8.A08.1.454.CMB.1.raw
  modified_base (221)..(221): a, c, t, g, unknown or other
  misc_feature (221)..(221): n is a, c, g, or t
  modified_base (529)..(529): a, c, t, g, unknown or other
  misc_feature (529)..(529): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcaggccacggcccctgtactggtcatccatgagccagtcgacgacacgtccggatccctgagagtattcctctcgccctccagctcgagggacagtcggccctacgttgacttagtcgaggtcggggcccagggtcggaacgagtaggaagtctacggaacttacgttattcgttaccgacaaccagactaggtaggtggtactagtcggtaggggttacttcggggacggaagggaccgtaaggttcgacccggttcgttaggacncggaccccgaaggccgtccggtcccccgtacggtcctaccgtccgttcccg

SEQ ID NO: 88504 - DNA, 550 bp, Homo sapiens
  misc_feature: GYAE6OF01C5Z7N.21.8.A08.1.454.CMB.1.raw
  modified_base (539)..(539): a, c, t, g, unknown or other
  misc_feature (539)..(539): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctggagattcattgaccaaaaagatatacttgttggttccagcagaagtcaggccaggcccctgtactggtcatccatgagccagtcgacgacactccgggatccctgagagatttctctgccctccagctcgagggacaggtcggccctacttgacttatcgaggtcggggacccagggtacggacgagtaggaagtctacgtacttacttattgttacgcaaccagacagtagtgtcagtcgaggggttatcgggacgggaggaccgtaaggttcgaccgtccgttggcgacgacccgaaggcctccggcccccgtggtccncgttcttcccg

SEQ ID NO: 88505 - DNA, 513 bp, Homo sapiens
  misc_feature: GYAE6OF01A2X37.21.8.A08.1.454.CMB.1.raw
  modified_base (505)..(505): a, c, t, g, unknown or other
  misc_feature (505)..(505): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctgcctccagctcgagggacaggtcggccaccttgacttatcgaggtcgggcccagggtggacgagtgaagctgactactattgtacgcacagacagtagtggtctagtcgaggggtatcgggcggagggaccagttgaccgtcgttggcacgcccaaggctcgcccctggccncgtctccg

SEQ ID NO: 88506 - DNA, 554 bp, Homo sapiens
  misc_feature: GYAE6OF01A2LU6.21.8.A08.1.454.CMB.1.raw
tcagtcgtcgctcgcacgaccggtgctcgatttagcatactctacagggggcgtgtgggctcgaggaggcagagctctgggaatctcaccatggcctggacccctctcctgcctccccctcctcactttctgcacagtctcttgaggcctcctatgtagctgacactagccaccctcggtgtcagtgtcccaggacaaacggcaggagtcacctgctctggagattccattgaccaaaagatatacttgttggttccagcagtaagtcaggccaggcccctgtactggtcatccagtcgagccagtccgacgacacgtccgggatcccgtgagagattctctgccctccgagctacaggacaggtcggccaccttgactatcgaggtcgggccgtaggtcggacgagtcgaagctagacttactagttcgtacgcacagacagtagtggtacagtcgaggggttatcgggacggacggtacctaaggttcgaccgttccgttggcgtcgacccgaaggtcctcggtacccccgtggtcctaccgttcgttaccg

SEQ ID NO: 88507 - DNA, 541 bp, Homo sapiens
  misc_feature: GYAE6OF01B33EX.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatcccgtgagagattctctgccctccagctcagggacagtcggccaccttgactatcgaggtcggggcccagggtggacgagtgaagctgactactattcgtacgcacagacgagtagtggtcagtcgaggggtattcgggcggagggaccaggttcggaccggttccgttggtccgacgcccgaaggccgtccggcccccgtcggtcccaccgttccgttcccgg

SEQ ID NO: 88508 - DNA, 633 bp, Homo sapiens
  misc_feature: GYAE6OF01CTJWR.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagtattcattgaccaaaagatatacttgttggtccagcagaagtcaggccacggccctgtactggtcactccatgaggccagtcgaacgacacgtccgggactcccgtagagagtacttctctcgccctccgagtctcgagggacaggtcggcctacgtgactagcgaggtcgggccagggtacggacgtagtaggaagtctacgtacttacgttagttcgttaccgctaacgaagacgtaggttagtcggtactagtacgggtagggggttagttcggggacgggtacggggtaacctaagggttcggtaaccccggttccggttacgggtaccgacggaccccggtaaacgggtcccgttcccggtccccccgttcgggtaccctaccgtttcccgttccggtttccccccgtccccg

SEQ ID NO: 88509 - DNA, 554 bp, Homo sapiens
  misc_feature: GYAE6OF01EM12Q.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagagtcaggccaggcccctgtactggtcatccatgaggccagtcgacgacactccgggatccctgagagattctctgccctccagctacgagggacaggtcggccaccttgactatcgaggtcggggcccaggtcggacgagtgaagctgactactattgtacgcaccagacaggtagtggtacagtcgtaggggttagtccgggcgggacgggacctaaggttcggacccggttccgttggtcgacggccccgaagggcctccggccccccgttcggtcctacccgtcgttccccgg

SEQ ID NO: 88510 - DNA, 529 bp, Homo sapiens
  misc_feature: GYAE6OF01ELD98.21.8.A08.1.454.CMB.1.raw
  modified_base (491)..(491): a, c, t, g, unknown or other
  misc_feature (491)..(491): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactggtcatccatggaggccagtcgacgacacgtccgggatccctgagagattctctcgccctccagctcgagggacagtcggcccaccgttgaactatcgaggtcggggccaggtggacgagtgaagctagactactattgtacgcaccagacagtagtggtcagtcgaggggtatcgggacggagggacctagtcgaccgtcgttggcncgacccgaaggcctcgccccctggtcctcgtcgtcccg

SEQ ID NO: 88511 - DNA, 538 bp, Homo sapiens
  misc_feature: GYAE6OF01B0O6J.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggaccaaacggccaggatcacctgctctggagattcattgccaaaagatatacttgttggtccagcagaagtcaggccaggcccctgtactggtcatccatgaggccagtcgacgacaccgtccgggatcccctgagagattctctggcctacccaactcgagggacggtggccctacgttgattctcgaggtcgggcccgagggtggaggatgaagcgtgactactactgttactcacgcagacagcgagtggtcagtcgaggggcagtcggcgggacgggaccgtagggttcggtaccgtcgtacggtcgacgacccgacggcctccgcccccgtcggtcgtccgtccg

SEQ ID NO: 88512 - DNA, 514 bp, Homo sapiens
  misc_feature: GYAE6OF01CCVCW.21.8.A08.1.454.CMB.1.raw
  modified_base (505)..(505): a, c, t, g, unknown or other
  misc_feature (505)..(505): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccctgagagtattctctcgccctccagctcgagggacagtgccctacttgactatcgaggtcgggcccgaggtggacgatgaagctagactactattgtacgcacgagacgagtagtgtcatcgagggtagtcggcggagggacagtgaccgtcgttggcacgcccgaaggccgtacgcccctggccncgtctcccg

SEQ ID NO: 88513 - DNA, 534 bp, Homo sapiens
  misc_feature: GYAE6OF01EH2DY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatggaggccagtcgacgacacgtccgggatcccctgagagtattctctgccctccagctcgagggacaggtggcccacttgactatcgaggtcgggcccgaggtggacgagtgaagctagactactattgtacgcaccagacagtagtgtacagtcgaggggtatcgggacggaggaccgtagttcgaccgtcgttacggctacgacccgaggccgtcgcccccgttggtcctaccgtctcccgg

SEQ ID NO: 88514 - DNA, 513 bp, Homo sapiens
  misc_feature: GYAE6OF01EOPIW.21.8.A08.1.454.CMB.1.raw
  modified_base (479)..(479): a, c, t, g, unknown or other
  misc_feature (479)..(479): n is a, c, g, or t
  modified_base (505)..(505): a, c, t, g, unknown or other
  misc_feature (505)..(505): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactcccgggatcccctgagagattctctgccctccagctcagggacagtggccaccttgactatcagtgggccagggtcgacgatgaagctgactactattgttacgcaccgagacagtagtggtcagtcgaggggtattcggcgggaggaccaaggttgaccgtcgttggtcncgcccgaaggctcgccccctggtccnctcgtccg

SEQ ID NO: 88515 - DNA, 634 bp, Homo sapiens
  misc_feature: GYAE6OF01CID27.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtccagtcgtccccaggaaccaaacggccaggatccacctgcctcgtggagattcattcgaccaaaagaatatacttgttggttccagcagaagtcagccaggcccctgtactggtcatccatgacgccagtcgacgacacgtccgggatcccgtagagtagtacttcctctcgccctccgagtctacgacgggactaggtcggaccctacgttgacttagtcgacggtcggggcccgtagggtcggaacgtagtaggaacgctacgacttacgttagttacgttacgcaacctacgacgtagtagtcggtacgagtcggaggggttacgttcggggacgggtacgggtaccgtaaggttccggtacccggttccggttacggtaccgtaccggaccccgtaacggtcccgttacccggtaccccccgttcggttaccctaccgttcccgttaccccg

SEQ ID NO: 88516 - DNA, 604 bp, Homo sapiens
  misc_feature: GYAE6OF01AGBQ7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgacggccagtcgacgacactccgggatccctagagagtattctcgtcgcctccagctcgagggacagtcgcctacttgactatcaggtcgggacccaggtggacgagtaggaacgtctagtacttacgtattacgttaccgacaaccagaacgtagtaggttcggtactaagtcggaagggggtttacgtcgggacgggaagggtaccgtaaaggttcggaacccgggtttccgttagggtaccgacggacccccgtaaagggcccttcccgggacccccccgttacgggtccctaaccgttccgttaccccgg

SEQ ID NO: 88517 - DNA, 640 bp, Homo sapiens
  misc_feature: GYAE6OF01CVSE0.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggaacaaacggccaggatcacctgctctgganattcattgaccaaaagatatacttgttcgtccagcagaagtcaggccaggcccctgtactggtcatccatgacgccagtcgacgacaccgtccgggatcccgaggagagtactttccgtcgtcgtccctccagccgtacgagggtacaggtcgaccctacttgactagtcgaggtcgggacccgtagggtacggacgtagtaggaacgcgtacgtaacgttaacttaagttacgttaaccgacctaaccgtaacgaactaggtaacggtcggttacgtacgttacgggtaagggggttagttaccggggagggtacgggtaaccgtaacggttacggtacccggttccgttaggtaccgaccggtaccccgaaggtcccgtaccggtcccccgtacggtccctccgtccgttaccccgg

SEQ ID NO: 88518 - DNA, 527 bp, Homo sapiens
  misc_feature: GYAE6OF01BPYE0.21.8.A08.1.454.CMB.1.raw
  modified_base (492)..(492): a, c, t, g, unknown or other
  misc_feature (492)..(492): n is a, c, g, or t
  modified_base (518)..(518): a, c, t, g, unknown or other
  misc_feature (518)..(518): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtgtccccaggacaaacggccaggatcacctgctctggagattcattgaccaaaagatatacttgttggttccagcagaagtcaggccaggcccctgtactggtcatccatgaggccagtcgacgacactccgggatcccgtgagagattctctcgccctccagcctcgagggacaggtcggccaccttgactatcgaggtcggggcccagggtggacgagtagaagctagacttactattgttacgcaccagacagtagtgtcagtcgaggggttatcggcggagggacctagttcggaccgtcgttggacncgacccgaaggcctcgcccctggtcncgtcgtccg

SEQ ID NO: 88519 - DNA, 549 bp, Homo sapiens
  misc_feature: GYAE6OF01C4P8B.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggccccctgtactggtcatccatgaggccagtcgacgacactccgggatcccctgagagattctctgcctccagctcgaggacagtggccaccttgactatcaggtcggggcccagggtggacgagtgaagctgactactattgttacgcaccagacagtagtggtacagtcgaggggttattcgggacgggtacgggaccgaaggttgacccggttccgttggtcgacggcccgaaggccgtccggccccccgttggtccctaccgttcgttccccgg

SEQ ID NO: 88520 - DNA, 654 bp, Homo sapiens
  misc_feature: GYAE6OF01ANOKY.21.8.A08.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaacggccaggatcacctgctctggagattcattgaccaaaagatatacttgtgttccagcagaagtcaggccacggcccctgtactggtcatccagtgaggccagtccgacgacacgtccgggatcccgngagagtattcctctcgccctcagcctcgagggacaggtcggaccaccgtttagactacgtcgaggtcgggggacccctaggggtcgggaacgtagtacggaaacgtcgtacggtaaccttaaccgttagttacggttaccgaccaacctaaggaacgtaggtagttcggtactagttcgggtaagggggttacgttcgggacgggtaacgggaacctaagggttccggaaccccggtttccgttgggtacccgtaaccggacccccggtaagggtccccgttaccccgggtacccccccgttacgggttccctaccgttcccgttaccccgg

SEQ ID NO: 88521 - DNA, 529 bp, Homo sapiens
  misc_feature: GYAE6OF01AMUB9.21.8.A08.1.454.CMB.1.raw
  modified_base (428)..(428): a, c, t, g, unknown or other
  misc_feature (428)..(428): n is a, c, g, or t
  modified_base (485)..(485): a, c, t, g, unknown or other
  misc_feature (485)..(485): n is a, c, g, or t
tcagtcgtcgctcgcacgaccggtgctcgatttagcatactctacaggggggaggaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggctcctttgccatgcactgggtccgccaggctccgaggcaaggggctggagtgggtgcgattatcgtggtatgatgggaagtgagagatattatcagactccggtagaagggccgtattcaccatctaccagagacaatgaccaacacgacacctgtaancttacaaatcgacccggctagacgagaccgagacacggctatgtactacgtgtacgngtctttggtactaggttcgggacacgggtaacccgtggtacccg

SEQ ID NO: 88522 - DNA, 536 bp, Homo sapiens
  misc_feature: GYAE6OF01C4I1A.21.8.A08.1.454.CMB.1.raw
  modified_base (451)..(451): a, c, t, g, unknown or other
  misc_feature (451)..(451): n is a, c, g, or t
tcagtcgtcgctcgcacgaccggtgctcgatttagcatactctacagggggtgggctcaggaggcagagctctgggaatctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttatggtaccaacagaagccaggccaggcccctgtgttagtgataatataaagacactgagaggccctcagagatccctgagcgattctctggctcagctcagggacagcagtcacgttagactatcagtgaagtccaggcagaggacggaggctgacttaattactgtacaaacagttaagacgtagtaagaggttaactcgtagttggggtnttcgggcgggagggaacccgtaaggcgttcggaacccgttccgtagggtccaaggcccccgaaagggccgtccggtaccccccgg

SEQ ID NO: 88523 - DNA, 569 bp, Homo sapiens
  misc_feature: GYAE6OF01CVQK4.21.8.A08.1.454.CMB.1.raw
  modified_base (222)..(222): a, c, t, g, unknown or other
  misc_feature (222)..(222): n is a, c, g, or t
  modified_base (379)..(379): a, c, t, g, unknown or other
  misc_feature (379)..(379): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaacggccaggatcacctgctctgganattcattgaccaaaagatatacttgttggttccagcagaagtcaggccaggcccctgtactggtcatccatgaggccagtcgacgacacgtccgggactcccgtgacgagatttctctcgccctccagctcgagggacaggtcggcctacttgactntacgaggtcggggcccagggtcggaacgataggaagctagacttactattcgtacgcaccagacgtagtagtggtcagtcggagggggttacttcgggacgggacgggaccgtaaggttcgacccgttcgttggtcgacgaccccgtaaggccctccggcccccgttaggtccctacgttccgttcccgg

SEQ ID NO: 88524 - DNA, 562 bp, Homo sapiens
  misc_feature: GYAE6OF01EXBFL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccagtgaggccagtcgacgacactccgggatcccgtgagagattctctgccctcagctcgagggacaggtcggcctaccgttgactatcgaggtcgggacccgagggtcggacgagtagaagtcctgtactacttagtttacgttacgcaaccgagacgagttagtggtcagtcggaggggtacgttcgggacgggacgggtaccgtaggttacgaccggttccgttggcacggcccgaaggccctcggcccccgtaggtcctactccgttacccg

SEQ ID NO: 88525 - DNA, 505 bp, Homo sapiens
  misc_feature: GYAE6OF01A0N5Z.21.8.A08.1.454.CMB.1.raw
  modified_base (219)..(219): a, c, t, g, unknown or other
  misc_feature (219)..(219): n is a, c, g, or t
  modified_base (473)..(473): a, c, t, g, unknown or other
  misc_feature (473)..(473): n is a, c, g, or t
  modified_base (496)..(496): a, c, t, g, unknown or other
  misc_feature (496)..(496): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatgaggccagtcgacgacactccgggatccctgagagattctctgccctccagctcagggacagtggccacttgactatcagtgggcccaggtggacgatgaagctgactactattgttacgcaccagacagtagtggtcagtcgaggggtattcggcggagggaccagttgaccgtcgttggcncgccaggcctcgccccctggtcncgtcgtccg

SEQ ID NO: 88526 - DNA, 554 bp, Homo sapiens
  misc_feature: GYAE6OF01D7T1Y.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagtattctctcgccctccagctcgagggacaggtcggcctaccttgacttatcgaggtcggggacccagggtggaacgagtggaagctagacttacttagttcgttacgcaaccagacgagtaggtggtcagtcggaggggttatcgggcgggagggacctaaggtggtacccgtcgttggcgacgcccgaaggccgtccgcccccgtggtcctacgtccgtcccg

SEQ ID NO: 88527 - DNA, 543 bp, Homo sapiens
  misc_feature: GYAE6OF01CZUS5.21.8.A08.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagcatactctacagggggctgtgggctcaggaggcagagctctgggaatctcaccatggcctggacccctctcctgcctccccatcctcactttctgcacagtctctgaggcctcctatgagctgacacagcccaccctcggtgtcagtcgtccccaggacaaacggccaggatcacctgctctgcagatggactgaccaaagaatatgcttattggtaccaacagaagccaggccaggcccctgtgttagtgatatataaagacactgagaggccctanagagactccctagagcgattctctggcctccagctcgagggacagcagtcacgttgactatcagtgaacgtcaggcaaggaggacgaggctagaacttattactgtacaaagagtaagacgaaggttagaaggtactacgtaaggttgggaggttcgggcgggaacgggaccaaggtcgtacggacccgtcgtaacgggtacacggaccccgaagggtccctaccccggg

SEQ ID NO: 88528 - DNA, 660 bp, Homo sapiens
  misc_feature: GYAE6OF01BITUH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagtattcattgaccaaaagatatacttgttggttccagcagaagtcaggccaggcccctgtactggtcatccatggaggccagtcgacgacacgtccgggatcccgtagagagtacttcctctcgccctccagcctacgaagggacaggtcggaccctaccgttgaacttagtcgaggtcggggccccgagggtcggacgagtaggaacgcgtacgtacttacgttagttcgttaaccgcgtaaccgagaaccgtaaggttacggttcggtaccgtagttacgggtaagggggttacgttcgggaccgggaacggggtaacccgtaaggttaccgggtacccggttccggtttacgggtacccgtaccggtacccccgtaagggtccccgtccggtaccccccccgttacgggttcccgtacccgttcccgttcccccggg

SEQ ID NO: 88529 - DNA, 566 bp, Homo sapiens
  misc_feature: GYAE6OF01A9TB2.21.8.A08.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagaatatacttgttggttccagcagaagtcaggccaggcccctgtactggtcatccatgacggccagtcgacgacacgtccgggactcccgtgagagattcnctgcctccagctcgaggcagtcgccacttgacctatcgaggtcgggcccgaggtcggacgagtggaagtctgacgtactagttgttacgcaccgacgactagtagtcggtctagtcgtaggggttagtcgggacgggaggtaccgtaggttaccgtaccggtcgttgggtaccgcggaccccgaagggtccctccggaccccccgttcgggtccctcgttccgttccccgg

SEQ ID NO: 88530 - DNA, 571 bp, Homo sapiens
  misc_feature: GYAE6OF01DL573.21.8.A08.1.454.CMB.1.raw
  modified_base (222)..(222): a, c, t, g, unknown or other
  misc_feature (222)..(222): n is a, c, g, or t
  modified_base (559)..(559): a, c, t, g, unknown or other
  misc_feature (559)..(559): n is a, c, g, or t
tcagtcgtcgctcgcacgaccggtgctcgatttagcatactctacagggggctgtgggctcaggaggcagagctctgggaatctcaccatggcctggaccccctctcctgcctcccccctcctcactttctgcacagtctctgaggcctcctatgagctgacacagcccaccctcggtgtcagtgtccccaggacaaacggccaggatcacctgctctgganattcattgaccaaaagaatatacttgttggttccagcagaagtcaggccaggccccctgtactggtcatccatgaggccagtcgacgacacgtccgggatccctagagagtattctctcgccctccagctcgaggacagtcggccacttgactatcgaggtcggggacccagggtcgaacgatagaagcgtagacttaacttagttcgttaacgccaccagacgtaagtaggtcggtactagtacggagggggttattcgggacggtacgggtaaccaggttcgaccggttcgttggtacgacggacccaaggtcctcccggtccccctcggtaccncgttccttcccg

SEQ ID NO: 88531 - DNA, 483 bp, Homo sapiens
  misc_feature: GYAE6OF01E1PK2.21.8.A08.1.454.CMB.1.raw
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
tcagtcgtcgctcgcacgaccggtgctcgatttagcatactctacagggggctgtgggctcaggaggcagagctctgggaatctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggcctcagagatccctgagcgattctctggctcagctcaggacagcagtcacgttgactatcagtgaagtcaggcagaggacgagctgactatactgtcaaacngtagacagtagaggtntcattgggtgttcggcggtagggacctagacgtggacccgtctaggtcacgtcccaaggtccg

SEQ ID NO: 88532 - DNA, 613 bp, Homo sapiens
  misc_feature: GYAE6OF01BO12U.21.8.A08.1.454.CMB.1.raw
  modified_base (221)..(221): a, c, t, g, unknown or other
  misc_feature (221)..(221): n is a, c, g, or t
  modified_base (337)..(337): a, c, t, g, unknown or other
  misc_feature (337)..(337): n is a, c, g, or t
  modified_base (390)..(390): a, c, t, g, unknown or other
  misc_feature (390)..(390): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccagtgacggccagtcgacgacacgtccgggatccctagagagtattcnctcgcctccagctcgaggacaggtcgcctacgtgactatcgaggtcgggaccngggaggacgagtgaacgcgtagtaacttacgtaagtttacggttaccgcctaaccgagaacgtaaggtacggtcggtactaaggtcggtagggggttacttcggggcgggaaggtacccgtaagtttccgggacccgtttcggttaggaccgtaccgggaccccgtaaacggggtccttaccccggtcccccgttagggtccctaccgtttcccgttccccgg

SEQ ID NO: 88533 - DNA, 620 bp, Homo sapiens
  misc_feature: GYAE6OF01CLOYN.21.8.A08.1.454.CMB.1.raw
  modified_base (224)..(224): a, c, t, g, unknown or other
  misc_feature (224)..(224): n is a, c, g, or t
  modified_base (343)..(343): a, c, t, g, unknown or other
  misc_feature (343)..(343): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgagcctcctatgagctgacacagcccacccgtcggtgtcagtcgtccccaggaaccaaacggccaggactcacctgctctgganattcattgaccaaaagatattacttgttggttccagcagaagtcaggccacggcccctgtactggtcactccatgacgccagtcgacgacacgtccgggatcccgtagagagtacttcnctacgccctcgagtcctacgaagggactaggtcggacctacgttgacttagtcgaggtcgggcccgagggtacggacgtagtaggaacgtcgtagtaacttactagtttacgtaccgtacaaccgaacgacgtagtacggtgtacgagttacgggtaaggggttacgttacgggacgggagggtaaccgtaggttacgtaccggttccgttacggtacgaccggtacccgaacgggtcctcccggtcccccgtcggtcctaccgttccgttccccgg

SEQ ID NO: 88534 - DNA, 522 bp, Homo sapiens
  misc_feature: GYAE6OF01BHGOD.21.8.A08.1.454.CMB.1.raw
  modified_base (487)..(487): a, c, t, g, unknown or other
  misc_feature (487)..(487): n is a, c, g, or t
  modified_base (513)..(513): a, c, t, g, unknown or other
  misc_feature (513)..(513): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttgttccagcagagtcaggccaggcccctgtactggtcatccatgaggccagtcgacgacacgtccgggatccccgtgagagtattctctgccctccagctcaggacagtcggccacttgactatcaggtgggcccgaggtggacgagtgaagctgactactagttcgtacgcacagacgagtagtggtactagtcggaaggggtattcgggaggaggacctaaggtcgaccgtcgttggacncgcccgaggccgtcgccccctgtccncgtctcccg

SEQ ID NO: 88535 - DNA, 692 bp, Homo sapiens
  misc_feature: GYAE6OF01B0QOE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagaatatacttgttgttccagcagaagtcaggccaggcccctgtactggtcatccatgacgccagtcgacgacacgtccgggatcccgtgacgagtacttctctcgcccttccgagtccgtcgaagggacaggtcggaccctaccgttgaccttatccgaggttcggggccctagggtacgggacgtagtggaaacgtcgtagtaaccttacgttagtttacgttaccgacctaaccgaagaccgtaggtacggttacggtacctaagttacggtaaggggggttacttaccgggggaccgggtaacggggtaacccgtaaagggtttacccggaacccgggttttcccgtttacggggttacccgaaccgggtacccccggtaaaggggtccccgttaccccggtaccccccccggttacgggttacccctaacccggtttcccgtttacccccggg

SEQ ID NO: 88536 - DNA, 520 bp, Homo sapiens
  misc_feature: GYAE6OF01B97OG.21.8.A08.1.454.CMB.1.raw
  modified_base (459)..(459): a, c, t, g, unknown or other
  misc_feature (459)..(459): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgagccagtcgacgacactccgggatccctgagagacttctctcgcctcagcctcgagggacagtcggcctaccttgaacttagtcaggtcggggcccagggtggacgagtagaagcgtagactactattgttacgcaacagacagtagtgtcagtcgagggtattcgggnggtaggactagtgaccgttccgtggcacgccaaggcctcgcccctggtcctcgtcgtcccg

SEQ ID NO: 88537 - DNA, 514 bp, Homo sapiens
  misc_feature: GYAE6OF01BXIT7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggcccctgtgttagtgatatataaagacactgagagccctcagagatccctgacgcgtattctcgtggctccagctacgagggacagcagtcacgttgactatcagtagaagtccagcagaggacgagctgactattacgtagtaacgaaaagtgaactagtagagtactgtaagttgggtaggttcggacggagggaccagcgtgacccgtacgtaggtcacgcccgaaggccgtcgtcccccg

SEQ ID NO: 88538 - DNA, 629 bp, Homo sapiens
  misc_feature: GYAE6OF01EHJ53.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgacaaaagatatacttgtgtcagcagaagtcagccagccctgtactggtcatccatggagccagtcgacgacacgtccgggactcccgtgacgagtacttctctcgccctcagctcgaagggacaggtcggacctacttgactagtcgaggtcgggcccgagggtcggacgtagtaggaacgcgtacgaacgttacttagtttacgttaacgaccgtaaccacggaacgtaaggttaaggttcggtactacggttacgggtaggggttaacgttcggggacgggtaacggggaaccgtaaggttaccggtaccgttccggtttagggaccgtaccggaccccgtaacgggtcccgtcccggtacccccgttaccggtaccctaccgttcccgttaccccgg

SEQ ID NO: 88539 - DNA, 546 bp, Homo sapiens
  misc_feature: GYAE6OF01BZS68.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgacggccaggtcgacgacaccgtccgggatccctgagagattctctgcctccagctcgagggacaggtcggcctaccgttgactatcgaggtcggggcccagggtgacgagtgaagctgacttactagttcgtacgcacagacagtagtcgtctagtcgaggggttatcgggaggaggaccgtaggttcgaccgttccgttgggactcggaccgaaggcctccggcccccgtacggtcctaccgtccgttcccg

SEQ ID NO: 88540 - DNA, 846 bp, Homo sapiens
  misc_feature: GYAE6OF01C0FRC.21.8.A08.1.454.CMB.1.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggacagacggcaggatcacctgctcngcagntggactgaccaaaagaaatctagcttaagttacggtaaccaaacgaagaacggacccgaaggacccgaacgggccccccgttaggttacggtttaaggtaggtaattaataaagttaaaaaggaccaacgttaggaacggacgggaccccttacgaagaacgacgttaccccgttaggaacgtaccgtaatttcccgtacgttcgggaccttaccccgaaggtccgttaccgaacggggaaccaacggacgtaaccggttaccgaaccgggtttacgtaaacctttaacgttaccgaaagggttaacggtaaaaccgggttacccgaacggggaaccgaaagggaacggggaaaccggaacggggtacgtacggtaaaccgttttaacgtttaaccttaacggttaaccgaaaaaccgaagggtttaaacggaaaccgtaaaggttaacgggtaaacggttaacccgtaaccggttaaggtttccgggggttaacgggttaccgggggtaccggggaaacggggtaaaccgtaaacgggtaccggtaaccggttaaccccggtaacccgttacggggttaacccgaaacgggtacccccgtaaacgggcccgttacccccgggg

SEQ ID NO: 88541 - DNA, 692 bp, Homo sapiens
  misc_feature: GYAE6OF01AQAUO.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctctggagnttcattgacaaaagatatacttgttggttccagcagaagtcaggccacggcccctgtactggtcatccatgacgccagtcgacgacaccgtccgggactcccgtagagacgtattcctccgtcgccctccacgcctacgacggggacacggtcggtaccctaccgttcgaacttacgtcgagggtccggggacccgtaggggtacggaacggtaagtaggaacgtcgtacgtaccttaacgttacgtttacggtaaccgacctaaccgaaggtaaccgtaagggttaacgggttacggtacgtaacggttacgggtaacggggggttacgttacggggacggggtaacgggtaacccgttaaggggttccggtacccgggttccggttcgggtaccgtaccggaccccggtaaagggtcccgttacccggtaccccccggttagggtaccctaccgttcccgttacccccgg

SEQ ID NO: 88542 - DNA, 548 bp, Homo sapiens
  misc_feature: GYAE6OF01D0VL4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgtgtcagcagaagtcaggccaggcccctgtactggtcatccatgagccagtcgacacactccgggatccctgagagattctctcgcctccagcctcgaacgggacaggtcggcctaccgttgacctagtcgaggtcgggcccgagggtcggacgataggaagcgtagacttacttattcgttaccgcaccgagacagttagtcggtcagtcgaggggtacttcgggcggtacggacctaggttcgaccgttccgttaggtcacgcccgaaggcctccggcccccttggcctacgtccgttccccg

SEQ ID NO: 88543 - DNA, 549 bp, Homo sapiens
  misc_feature: GYAE6OF01B5S81.21.8.A08.1.454.CMB.1.raw
  modified_base (428)..(428): a, c, t, g, unknown or other
  misc_feature (428)..(428): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtcccaggacaaacggccaggatcacctgctctggagattcattgaccaaaagatatacttgttggttccagcagaagtcaggccaggcccctgtactggtcatccatgagccagtcgacacacgtccgggatcccgtgagagattctctcgcctccgagctcgagggacagtcggcctaccgtgactatcgaggtcgggcccagggtggacgagtaggaagtctacggacttactagttcgtaccncacagacgtagtagtggtactagtgaggggttactcgggacggaggactaggttacgaccggtcgttgtacgcgacccgaaggtccgtccggtcccccgtaggtcctaccgtcgttacccg

SEQ ID NO: 88544 - DNA, 547 bp, Homo sapiens
  misc_feature: GYAE6OF01BUCPC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagattctctcgccctccagctcgagggacaggtcggccctaccttgactatcgaggtcggggcccagggtcggacgagtgaagctgactactattgtacgcaccagacagtagtggtacagtcgaggggttattcgggcgggagggacctaaggttcgacccgttccgttggtccgacggcccgaagggcctccggcccccgtcggtcctcgtccgtccgg

SEQ ID NO: 88545 - DNA, 559 bp, Homo sapiens
  misc_feature: GYAE6OF01ECYWE.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgccctccagctcgagggacaggtcggccacttgactatcgaggtcggggccagggtggacgagtgaagctagacttactagttgtaccgcacagacagtagtggtcagttacggaggggttactcggggacggagggtacctaaggttcggaccggttccgttgggtaccacggcccgaaggcccgtccggaccccccgttcgggtacctccgtccgttccccg

SEQ ID NO: 88546 - DNA, 854 bp, Homo sapiens
  misc_feature: GYAE6OF01DGYM1.21.8.A08.1.454.CMB.1.raw
  modified_base (176)..(176): a, c, t, g, unknown or other
  misc_feature (176)..(176): n is a, c, g, or t
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtntcagtcgtccccaggacaaacggccaggatcacctgctctgganattcattgaccaaaagatatacttgttggtccagcagaagtcacggccacggcccctgtactggtcatccatgacgccagtcgacgtacacgtccgggactccctagacgagtacttcgtctacggtccctccgaagtccctacgacgggacacggttcggacccctaaccgtttgaaccttacgtaccgtaacgggttacgggggacccccgtaaggggttaccggggaaaccggtaacggttaacgggtaaacggtccgttaacgggtaacctttaaaccgtttaacgttttaccgggtttaacccgaccgtaaaccgtaacgggtaaccgtaacgggtttaacgggttacgggtaccgttaacgggttaccgggtaaagggggggtttaacgtttacccggggggtaaccgggggtaaaccgggggtaaacccggttaaaaccggggtttaccgggttaaaccccccggggttttacccgggttttaccggggtaacccggtaaaccccggggttaacccccccggtaaaacgggggttacccccgttacccccgggttacccccccccgggtttaccccggggtttaccccgttaaccccggttttcccccggttttaacccccccgggg

SEQ ID NO: 88547 - DNA, 553 bp, Homo sapiens
  misc_feature: GYAE6OF01B7MGK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagacttctctgccctccagcctcgagggacaggtcggccctaccgttgactatcgaggtcggggcccagggtggacgagtgaagctgactactattgtacgcaccagacagtagtggtctagtcgaggggttattcgggacggagggaccgtaaggttcggacccggttcgttggtacacggacccgaaggccgtccggccccccgtcggtcctccgtccgttcccg

SEQ ID NO: 88548 - DNA, 530 bp, Homo sapiens
  misc_feature: GYAE6OF01DQ9OA.21.8.A08.1.454.CMB.1.raw
  modified_base (365)..(365): a, c, t, g, unknown or other
  misc_feature (365)..(365): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggccctgtactggtcatccatgaggccagtcgacgacactccgggatccctgagagattctctgcctccagctcgagggacagtcggcctacttgactancgagtcgggcccagggtggacgagtgaagctagacttactattgttacgcaccagacagtagtgtcagtcgaggggttatcgggacggagggaccaagttcgaccgtcgttggtcagcccgaaggcctcgcccccgtcggtacaccttcgtcgttccccgtcccc

SEQ ID NO: 88549 - DNA, 553 bp, Homo sapiens
  misc_feature: GYAE6OF01D1U9S.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttgttccagcagaagtcaggccaggcccctgtactggtcatccatgaggccagtcgacgacaccgtccgggatcccgtgagagtattcctctcgccctccgagccgtacgagggacagtcggcctaccgttgacttatcgaggtcgggcccgagggtcggacgagtgaagctagactactagttgtacgctacagacagtagtgtactagtcggtaggggtatcgggcggtagggaccgtaagttgacccggtcgttaggtcgacgcccgaaggccgtccgcccccgtggtcctccgtccgttccccg

SEQ ID NO: 88550 - DNA, 688 bp, Homo sapiens
  misc_feature: GYAE6OF01CEH2H.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcacttttctgcacagtctctgaggcctcctatgagctgacacagccaccctggtgtcagtcgtccccaggacaaacggccaggactccacctgctcgtgganattcattcgaccaaaaagatatacgttgttggttccagcagaagtcaggccaggcccctgtactggtcatccatgagccagtccgacacactccgggatcccgtgacgagtacttctctcgccctccacgctcgaggactaggtcggacctacgttcgactacgtcgacggtcggggaccctagggtcggacgagtaggaaacggtcgtacgtaacgttaacgttacgtttacgttaaccggtaccaaccgtaacgaacgtaaggttaacggtcggttacgtaagttaccgggtaagggggttacgttacggggaacggggtacgggaaccgtaagggtttaccggtacccgggtttaccgttaccgggttaccggaacccgggtaccccgtaaacggggttccccgttacccggtaccccccggttacccgggttaccctcccggttcccgttttaccccccgg

SEQ ID NO: 88551 - DNA, 663 bp, Homo sapiens
  misc_feature: GYAE6OF01A79V3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctctatgagctgacacagcccaccctcggtgtcagtcgtccccaggacaaacggcaggatcacctgctctggagattcattgaccaaaagatatacttgtgtccagcagaagtcaggccaggcccctgtactggtcatccatgacggccagtcgacgacacgtccgggatcccgtagaacgtacgtacttctacgtcgaccctaccgagtcctacggaagggacctagggtcggaccctacgttgaacttactcgaggtcggggaccctagggtcggaacgtagtacgaaacgtctacgtaaccttacgttagtttcgtaaccgacgtaaccgagtaacgtaggtaacggttcggtacctaacggttcggaagggggttacgttccggggaccgggtaacgggtaacccgttaaggtttaccggaacccgggttcgtttacgggacccgaacggtaccccgtaacgggtcccgttcccggaccccccgttcggttacctacccgttccgttccccggg

SEQ ID NO: 88552 - DNA, 582 bp, Homo sapiens
  misc_feature: GYAE6OF01C87GU.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctgagagtattctctcgccctccagctacgagggacaggtcggccctacttgactatcgaggtcggggacccgtagggtcggaacgtagtaggaagtcgtagaacttacgttagtttacgttaccgccaaccgagacgtagttaggtggtactagtacggtaggggttacgtcgggacgggagggaccgtaggttcgaccgttcgttggtcacggacccgaaggccgtccggcccccgttggtccctcgttccgttcccgg

SEQ ID NO: 88553 - DNA, 554 bp, Homo sapiens
  misc_feature: GYAE6OF01EKAYE.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatggaggccagtcgacgacacgtccgggatcccgtgagagattctctgccctccagctcgagggacaggtcggcctaccgttgactatcgacggtcgggcccgagggtggacgagtaggaagcgtagactactagttcgtacgcacagacagtagtggtctagtcgaggggtagttcgggacgggagggaccgtaaggttcggaccgttcgttgggtcacggcccgaaggccgtccggcccccgttggtcctaccgtcgttcccg

SEQ ID NO: 88554 - DNA, 665 bp, Homo sapiens
  misc_feature: GYAE6OF01CW42G.21.8.A08.1.454.CMB.1.raw
  modified_base (298)..(298): a, c, t, g, unknown or other
  misc_feature (298)..(298): n is a, c, g, or t
  modified_base (435)..(435): a, c, t, g, unknown or other
  misc_feature (435)..(435): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactgggtggagtcgtgggggagcatggtccagcctgggaggtccctgacgcctctcctgtgcagcgtctggattcagtatcggcttccttgccatcgcacgtcgggtccnccaggcctccgaggcgaaggggctggggagtggggtggcgtatttagcgtaggtatgagttagggaagtgaagtagtattagtttacttcgaagtacctccggtaggaacgggccgtattccacctatctaccaganaacaatcgaccaacaaacacctacgtacgttaatccttaacaaacgtcggaaccccggcttagggaacgaccgggtacccggaacgggaaccgtaaccgggtacttaagttacggttaacgtttaaccgttaaggttaccggtaacggtttccggtttttacgggtacgttacgggttttacccggggggacccgttaaacgggggtaacccccgttgggttaacccccg

SEQ ID NO: 88555 - DNA, 538 bp, Homo sapiens
  misc_feature: GYAE6OF01BHYSK.21.8.A08.1.454.CMB.1.raw
  modified_base (334)..(334): a, c, t, g, unknown or other
  misc_feature (334)..(334): n is a, c, g, or t
  modified_base (416)..(416): a, c, t, g, unknown or other
  misc_feature (416)..(416): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctgtactggtcatccatgaggccagtcgacgacactccgggatcccgtgagagacttcnctgccctcagctcgaggacagtcggccacttgactatcgagtcgggccagggtgacgagtgaagctagactactatgttacncaccagacagtagtggtcagtcgaggggtatcgggacggagggacaaggttcggaccgttccgttggtaccgacgtccccgaaggcccgttccgccccggtcgtcctccgttccgtccccgg

SEQ ID NO: 88556 - DNA, 547 bp, Homo sapiens
  misc_feature: GYAE6OF01C2ETG.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggactcccgtagacgagattctctgaccctccagctcgagggacaggtcggccctacttgacttatcgaggtcggggcccaggtcggacgagtgaagctgactactatgttacgcacagacagtagtgtacagtcgtaggggtattcgggacggagggaacctaggttcgaaccggttccgttaggtcacgccccgaaggcctccggaccccctcggtcctacgtccgttcccg

SEQ ID NO: 88557 - DNA, 564 bp, Homo sapiens
  misc_feature: GYAE6OF01B0R8D.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctaacacagccaccctcggtgtcagtcgtccccaggacaaacggccaggatcacctgctctggagattcattgaccaaaagatatacttgttgttcagcagagtcaggccaggcccctgtactggtcatccatgaggccagtcgacgacacgtccgggatccctgagagtattctctgccctcgagctcgagggacaggtcggccctacgttgactatcgaggtcggggcccagggtggacgatagagctggactacttagttcgttaccgacaccagacgagtagtcggtcagtcggaggggttcgtcgggacgggacgggaccgtaggttcgacccggttccgttcggtcacggcccaacggtccctccgtcccccggttcggacctccgttccgtcccgttcccccg

SEQ ID NO: 88558 - DNA, 576 bp, Homo sapiens
  misc_feature: GYAE6OF01B58Z8.21.8.A08.1.454.CMB.1.raw
  modified_base (269)..(269): a, c, t, g, unknown or other
  misc_feature (269)..(269): n is a, c, g, or t
  modified_base (330)..(330): a, c, t, g, unknown or other
  misc_feature (330)..(330): n is a, c, g, or t
  modified_base (435)..(435): a, c, t, g, unknown or other
  misc_feature (435)..(435): n is a, c, g, or t
tcagtcgtcgctcgcacgaccggtgctcgatttagcatactctacagggggctgtgggctcaggaggcagagctctgggaatctcaccatggcctggacccctcctcctgctccccctccctcactttctgcacagtctctgaggcctcctatgagctgacacagccaccctcggtgtcagtgtccccaggacaaacggccaggatcacctgctctggagattcattgaacctaaaaaattattggttttttaggacctagcagaagtnaggccaggccctgtgttgtcatccatgagacgaggagaccgaccgtcgggactccctgagngattctctggctaccgaactccgagggcggtggcctacgttgacttcgtcgaggtgggcccgtaagggtggaggtatacggaagcgtgaactacgtactgttacncgtagcagactagctagtcgtcagtcgaggggtctagttcggcgggacggacgtagggttcggaccgtccgtaggcacgacccggagtccgtacccgtcccccggtcgtccaaccgttccgttcccggttcccccgtcccc

SEQ ID NO: 88559 - DNA, 553 bp, Homo sapiens
  misc_feature: GYAE6OF01CO8K0.21.8.A08.1.454.CMB.1.raw
  modified_base (433)..(433): a, c, t, g, unknown or other
  misc_feature (433)..(433): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctgtactggtcatccatgaggccagtcgacgacacgtccgggatcccgtgagagacttctctcgccctcagctacgagggacaggtcggccctacgttgacttagtcgaggtcgggacccaggtggacgagtagaagctagacttactattcgttacncacagacgaagtagtgtactagtcggaggggttagtcgggacggtagggacctaggttcgaccgttcgttggtacacgacccgaaggctcccggaccccctggtacctcgtcgttccccg

SEQ ID NO: 88560 - DNA, 526 bp, Homo sapiens
  misc_feature: GYAE6OF01EZI8A.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgccaaaagatatacttgttggttccagcagaagtcaggccaggcccctgtactggtcatccatgaggccagtcgacgacactccgggatccctgagagattctctgcctcagctcgaggacagtggccaccttgactattcaggtcgggcccagggtgacgatgaagctgactactatgttacgcacctagacagtagtgtcagtcgaggggttagtcgggacggagggtaccgtaaggttcgtaccgttccgttggtcacgcccgaaggccgtacgcccccgtagtccacgtcttcccgg

SEQ ID NO: 88561 - DNA, 609 bp, Homo sapiens
  misc_feature: GYAE6OF01DQQA3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctcgccctccagctcgagggacaggtcggaccctaccgttggaacttagtcgaggttcggggcccctagggtacgggacgagtagaagctacggacttaacgttatttcgttaacgctaaccgagactaggttagtaggtactagtcggagggggttacttcgggcgggtaacgggaccgtaaggttcggaacccggttccgttagggtacacggtaccccgaaaggtcccgttaccggtaccccccgttacgggttcctaaccgttccgtttaccccgg

SEQ ID NO: 88562 - DNA, 576 bp, Homo sapiens
  misc_feature: GYAE6OF01A7CQG.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggccctgtactggtcatccatgaggccagtcgacgacactccgggatcccgtgacgagtattcctctcgccctccgagctacgagggacaggtcggaccctaccttgacctagtcgagggtcgggcccaggggtcggacgagtagaagcgtagtactatattgtaccgcaccgagacagtagtggtacagtcgtaggggttacgttcgggacgggacgggaccgtaaggttcgtaccggttccgttcggtccgacggcccgaaggccgtccgcccccgttcggtccacctccgtcgttccccgtccccg

SEQ ID NO: 88563 - DNA, 743 bp, Homo sapiens
  misc_feature: GYAE6OF01CC3ZN.21.8.A08.1.454.CMB.1.raw
  modified_base (355)..(355): a, c, t, g, unknown or other
  misc_feature (355)..(355): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacacgcccacccgtcggtgtcagtcgtccccaggaaccaacggccaggatccacctgctcgtggatattcagttcgaaccaaaaagatactacgttgttggttccagacaagaagtcaggccacggcccctgtactggtacatccagtggacgcccagtccgacgaccacgtccgggatcccgtgagagtacttcnctcgccctcagctacgagggtacagtcggaccctacgttgaacttacgcgagggtccgggacccgagggtcggaacgtagacgaacgtcgtaacggtacttaacttacgtttacgttaaccgaccgtaacctaagggactaagggttaaacggttcggtaaccgtacggttaaccgggggtaaggggggtttaaccgtttaccgggggaaccggggtaaacggggttaaacccgtaacggggttttaaccggtaacccccgggtttcccggttttaaggggtaccccgtaaaaccgggtacccccggtaaacgggtcccggtttcccccggtaacccccccggtttccggggtaacccttacccggtttcccccggtttaccccgggg

SEQ ID NO: 88564 - DNA, 578 bp, Homo sapiens
  misc_feature: GYAE6OF01BUU9I.21.8.A08.1.454.CMB.1.raw
  modified_base (220)..(220): a, c, t, g, unknown or other
  misc_feature (220)..(220): n is a, c, g, or t
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatggaggcccagtcgacgacacgtccgggatcccgngagagacttctctcgccctccagcctacgagggacaggtcggccctaccgtttgacttagtcgagggtcggggaccccgagggtcgggaacgagtggaagcgtagacttactatttgtacgacaccagacagtagtgtactagtcggtaggggtagttcgggacggtacgggaccgtaggttcgaccggttccgttggtcgaccgacccgaaggccgtcccgtcccccgtcggtccctaccgtcgttaccccg

SEQ ID NO: 88565 - DNA, 549 bp, Homo sapiens
  misc_feature: GYAE6OF01EDW6V.21.8.A08.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaaaatttntgttttttggaccagcagaagtcaggccaggccctgtgttggtcatccatgaggacaggagacgaccctccgggatccctgagagattctctggctccaactcgagggacggtggccacgttgattctcgagtggggcccagggtggaggagtgaagctgactactactgttactcagcagacagcagtggtcagtcgagggggcagttcgggacgggagggaccgagggttcgaccgtccgtacgggtcaggcccgaacggccgtccgcccccgtcggtacccaccttccgtcgttccccgtcccccg

SEQ ID NO: 88566 - DNA, 581 bp, Homo sapiens
  misc_feature: GYAE6OF01BTZ19.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtgtccccaggacaaacggccaggatcacctgctctgganattcattgaccaaaagatatacttgttggttccagcagaagtcaggccaggcccctgtactggtcatccatgacgccagtcgacgacacgtccgggatcccgtgagagtattctctcgccctccagctacgagggacaggtcggcctacttgactatcgaggtcgggccgaggtcggacgagtggaagcgtagacttactagttacgtacgcacagacagtagtcggtacagtcggtagggggttagttcgggacgggacggtaaaccgtaaggttacggacccggttccgttagggtccgacggaccccgtaaggcccgttccggccccccgttcggtccctaccgttccgttccccgg

SEQ ID NO: 88567 - DNA, 664 bp, Homo sapiens
  misc_feature: GYAE6OF01C6S42.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagaatatacttgttgtcagcagaagtcaggccaggcccctgtactggtcatccatgacggccagtcgacgacacgtcgggatccctagagagtattctctacgcctccgagcctcgacgggacaggttcggaccctaccgtttgaacttacgtaccgtaacgggtccggggacccgtaaggggtcgggaaccgtagtaggaaacgtcgttagaccgttaacttagtttacgttaaccgtacaaccaaggaacctaaggttaacggttacggttactagttacggtaagggggttacttccggggacgggtaaaccggggtaacctaacgggttcggaaccccggtttacccgttagggtaccgaccggtaccccgtaaagggcccgttcccggaccccccgttcgggtccctaccgttccgttccccgg

SEQ ID NO: 88568 - DNA, 632 bp, Homo sapiens
  misc_feature: GYAE6OF01BJ09N.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttgtccagcagaagtcaggccaggccctgtactggtcatccatgacggccagtcgacgacacgtccgggatcccgtagacgagtactttctcgtcgccctccgagcctacgagggacaggtcgccctacgttgaactatcgagggtcgggcccgtagggtcggacgtagtaggaagtcgtagtaacttactagtttacgtaccgacaaccgacgacgtagtaggtcggtacgtagttacggtaaggggttacgtacggggacgggaacgggtaaccgtaagggttaccggtacccggttccgttacgggtaccgtacggtaccccggaaaggtcccgtcccggtacccccccgttacgggtaccctacccgttcccgttaccccgg

SEQ ID NO: 88569 - DNA, 562 bp, Homo sapiens
  misc_feature: GYAE6OF01A8LCO.21.8.A08.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggtccagcagaagtcaggccaggcccctgtactggtcatccatgaggccagtcgacgacacgtccgggatccctgagagattcnctcgccctccagctacgagggacaggtggccctacttgaccttatcgaggtcggggcccagggtcggaacgagtaggaagccgtagaccttactatttgtaccgcaaccagacagtagtggtacagtcgaggggtattcgggcggagggaccgtaaggtcgaccggttccgttaggtccgacggacccgaaggtccgtccgtcccccgtacgggtccctcgtcccgttcccg

SEQ ID NO: 88570 - DNA, 595 bp, Homo sapiens
  misc_feature: GYAE6OF01C56ZA.21.8.A08.1.454.CMB.1.raw
  modified_base (581)..(581): a, c, t, g, unknown or other
  misc_feature (581)..(581): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcacttttctgcacagtctctgaggcctcctatgagctgacacagcccaccctcggtgtcagtcgtccccaggacaaacggccaggatcacctgctctggagtattcattcgaccaaaagaatatacttgttgttccagcagaagtcaggccacggcccctgtactggtcatccatggagccagtccgacgacacgtccgggactcccgtagagagactttctctcgccctccagtctacgaggacaggtcggccctacgttgacttatacgtacgggtcggggacccgtagggtacggacgtagtaggtaacgcgtcgactacgttagttcgttacgccaccgagacgtaagtagtgtactagtcggtaggggtacgtcgggacgggagggtaaccgtaggttcggaccgttccgttggtacgacgacccgtaaggccgtccggtcccccgtggtcccncgttccgttcccgg

SEQ ID NO: 88571 - DNA, 554 bp, Homo sapiens
  misc_feature: GYAE6OF01DZ6R5.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctcgccctccagcctcgagggacaggtcggcctaccgttgactatcgacggtcggggacccagggtcggacgagtaggaagctagactactagttagttacgcaccagacagtagtggtcgagtcgaggggtagtcgggacggagggaccgtaaggttcggaccgttccgttaggtacgacgcccgaaggcctccggccccgtacggtccacgtccgttccg

SEQ ID NO: 88572 - DNA, 535 bp, Homo sapiens
  misc_feature: GYAE6OF01CIK9M.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctgtactggcatccatgaggccagtcgacgacactccgggatcccgtgagagattctctgccctcagctcgacggacagtcggcctaccgttgacttatcaggtcgggccaggtggacgagtgaagctgactactattgtacgcacagacaggtagtggtcagtcgaggggtatcgggcggagggacctaagttcggacccgttcgttgggtacgacgtcccgaaggcccgtcgcccccgtggtccaccgttcttacccgg

SEQ ID NO: 88573 - DNA, 603 bp, Homo sapiens
  misc_feature: GYAE6OF01EIOKE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggttcatccatgaggccagtcgacgacactccgggatcccctgagagattctctgccctccagctcgagggacagtggccaccttgactatcacggttcggggcccagggtacgggacgtagtagaagtcctagaaccttaactaatttacggttacgaccgaaccacgaacgtaggttaacgtgggtactagttcggtaagggggttacttacggggacgggaagggtaccgtaaagggttcggacccggttcgttaggtccgacgacccgtaaacggccgttccgccccccgttacgggtccctaccgtccgttccccgg

SEQ ID NO: 88574 - DNA, 540 bp, Homo sapiens
  misc_feature: GYAE6OF01DMWB8.21.8.A08.1.454.CMB.1.raw
  modified_base (529)..(529): a, c, t, g, unknown or other
  misc_feature (529)..(529): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccaccctggtgtcagtgtccccaggacaaacggccaggatcacctgctctggagattcattgaccaaaaagaatatacttgttggttccagcagaagtcaggccaggcccctgtactggtcatccatgaggccagtcgacgacacgtccgggatcccgtgagagatttctctgccctccagctcgagggacaggtggccctaccttgactatcgaggtcggggacccagggtacggacgagtagaacgctgacttacgtattgttacgcaccagacagtagtgtacagtcgaggggttatcgggacggagggtacaaggttcggaccgtcgttggtcacgacccgaggcctcgacccctggtccncgtcgttccgg

SEQ ID NO: 88575 - DNA, 532 bp, Homo sapiens
  misc_feature: GYAE6OF01DBGMX.21.8.A08.1.454.CMB.1.raw
  modified_base (218)..(218): a, c, t, g, unknown or other
  misc_feature (218)..(218): n is a, c, g, or t
  modified_base (355)..(355): a, c, t, g, unknown or other
  misc_feature (355)..(355): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
tcagtcgtcgctcgcacgaccggtgctcgatttagcatactctacagggggtgggctcaggaggcagagctctgggaatctcaccatggcctggacccctctcctgcctcccccctcctcactttctgcacagtctctgaggcctcctatgagctgacacagcccaccctcggtgtcagtcgtcccaggacaaacggccaggatcacctgctctgganattcattgaccaaaaagatatacttgttggtccagcagaagtcaggccaggccctgtactggtcatccagtgaggccaggtcgacgacacgtccgggatcccgtagagagattctctgccctccagctcgagggacngtcggcctacgttgactatcgaggtcggggacccagggtggacgataggaagctagacttatatttagtacgcaccagactagtagtggtcagtcgaggggtntcgggngacggactaggtgaccgtcgtcggtcagccgaggccgtcgccccgtcgtcacttcctcgtccctaccc

SEQ ID NO: 88576 - DNA, 524 bp, Homo sapiens
  misc_feature: GYAE6OF01BMF5N.21.8.A08.1.454.CMB.1.raw
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
  modified_base (512)..(512): a, c, t, g, unknown or other
  misc_feature (512)..(512): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagtattctctgccctcagctcgagggacaggtcggccctacgttgacttatcgaggtcggggcccagggtgacgagtgaagctgactatattgtacncacagacagtagtggtnagtgaggggtatcgggacggaggacaggttcgaccgttctaggcacgcccgaaggccgtcgccccgtgtcncgttccgtcccg

SEQ ID NO: 88577 - DNA, 534 bp, Homo sapiens
  misc_feature: GYAE6OF01E1SLP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggccccctgtactggtcatccatgaggccagtcgacgacactccgggatcccctgagagattctctgccctccagctcgagggacagtcggccacttgactatcgaggtcggggcccagggtggacgagtgaagctgactactattgttacgcaccagacagtagtggtcatcgaggggtattcgggcggagggacctaaggttcgaccgttccgttggtcacggacccgaaggcctccggccccctggtccaccgtcgttcccg

SEQ ID NO: 88578 - DNA, 626 bp, Homo sapiens
  misc_feature: GYAE6OF01C1XPC.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctcggtgtcagtcgtcccaggacaaacggcaggatcacctgctctgganattcattgacaaaagatatacttgtgtcagcagagtcaggccaggccctgtactggtcatccatgagccagtcgacgacacgtccgggatcccgtaggagagtactttcctctcgccctcgagcctacgagggacaggtcggacctaccgttgacttatcgaggtcgggcctagggtcggacgtagtaggaacgtcgtacgaaccttaattacgtttacgttaaccgaccaaccgaaggaacgtaaggttacggttacggtactacgtaccggtaagggggttacgttcggggacgggtaacgggtaccgtaaacggttcggaacccggttcgttagggtaccgtacggaccccgaaggtccgttacccggacccccgttcggtaccctaccgttccgttaccccg

SEQ ID NO: 88579 - DNA, 696 bp, Homo sapiens
  misc_feature: GYAE6OF01AJPV3.21.8.A08.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctcggtgtcagtcgtccccaaggaccaaacggccaggactcacctgctcgtggagtattcattacgaccaaaaagtatattacgtttgttggttccagcgagaagtcaggccaggcccctgtactggtcatccatggacgccgagtccgacgacaccgtccgggactcccgngagtagtacttctctcgtccctccagtcctacggacggactacggtccggaccctaccgttagaaccgttacgtaccggacgggtccggggacccgtagggtacgggaacgaggtacggaacgtcgtacgtaaccgttacgttacgtttacgttaaccgacaaccgacgtaacgtaaggttacggttacggtacgtaaggttcgggtaggggttacggtacgggacgggaaccgggtaccgtaacgggttccggaacccggtttccggttacgggacggtaccggaaccccggtacgggccccgttcccgggtccccccgttacgggtacccttccgttcccggttacccccg

SEQ ID NO: 88580 - DNA, 521 bp, Homo sapiens
  misc_feature: GYAE6OF01EBJGM.21.8.A08.1.454.CMB.1.raw
  modified_base (490)..(490): a, c, t, g, unknown or other
  misc_feature (490)..(490): n is a, c, g, or t
  modified_base (513)..(513): a, c, t, g, unknown or other
  misc_feature (513)..(513): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttgttccagcagaagtcaggccaggcccctgtactggtcatccatgaggccagtcgacgacactccgggatccctgagagattctctgcctccagctcgagggacagtcggcctacttgactatcgaggtcggggcccagggtcggacgagtagaagcgtagaccttatatttgttacgcaacagacagtagtggtcagtcgaggggtattcgggcggaggaccaaggttcgaccgtcgttggcncgacccgaggctcgcccctgccncgtctccg

SEQ ID NO: 88581 - DNA, 732 bp, Homo sapiens
  misc_feature: GYAE6OF01BY81W.21.8.A08.1.454.CMB.1.raw
  modified_base (110)..(110): a, c, t, g, unknown or other
  misc_feature (110)..(110): n is a, c, g, or t
  modified_base (135)..(135): a, c, t, g, unknown or other
  misc_feature (135)..(135): n is a, c, g, or t
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
tcagtcgtcgctcgcacgaccggtgctcgatttagcatactctacagggggctgtgggctcaggaggcacgagcctcgtggtaatcgtctaccattggcctggacccctntcctgacctccccgtctcactttcngcacgagttcgtctgacggccttcgtattgagctgtactacgngtcccaccgtggtntcgagtcgtcccaggacaacggcaggatcgactgctcnggagtagttccattcgacctaaaagtatnttacgttgttcggttccagtcgagtacgtcgtacggccgtacggtcccctgtacctggtacacgtccgtacgtcggacggaccgacggttaccggacggtacgtccggtccgggtactcccgtaggtacggtagtactttcgtactcggtcctacgacgtcgtacgtaggtactggtacggaccctacgttagaccgttactccgtacgggtaccgggacctagggtacggaacgtaagtacggtaacgtcgtaacgtaacttacttacgttacgtaccgtacctaaccgtagtacgtaggttagtacgtacgtacggtacggtaacggggttcgtacggggaccgggtaaaccggtaccgttaaacggttaccggtaccggttaccggttaggtaaccggtaccgaacccggtaaggtccccgttcccggtaccccggttacggtacccgtaaccgttcccggttaaccccg

SEQ ID NO: 88582 - DNA, 688 bp, Homo sapiens
  misc_feature: GYAE6OF01CMLNM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctcgcctccccctcctcactttctgcacagtctctgaggcctcctatgagctgacacagccaccctggtgtcagtcgtcccaggacaaacggccaggactccactgctctggagtattcattcgaccaaaagtaatacttacttgttcggttccagcagaagtcgacgccacggcccctgtactggtcagtccagtgacgccagtcgacgaccacgtccgggatcccgtagacgtagtacttctctcgtccctacgagctacgacgggacacggtcggaccctacgttacggacttacgtacggtagggtccggggacccgtagggttacgggaacgtaggttacggaaacggtccgttaaggtaaccctttaagtttaacgtttaccggttaacgaacccgtaacggaactacggtaacggttaggttcggtaactagggtacggggtaagggggttacgttccggggacgggtaacgggtaaccgtagggttccgtacccggttcggttacggaccgacggtccccggaaggtcccgttacccggacccccgtggtacccgtacgttccccgttccccgg

SEQ ID NO: 88583 - DNA, 681 bp, Homo sapiens
  misc_feature: GYAE6OF01D20HK.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctcccccctcctcactttctgcacagtctctgaggcctcctatgagctgacacagcccaccctcggtgtcagtgtccccaggaccaaacggccaggatcacctgctctggagtattcattgaccaaaaagatatacttgttggttccagcagaagtcaggccaggccctgtactggtcatccatgacggccagtcgacgacacgtccgggatcccgtagacgagtacttctctcgccctcgagcctcgagggacaggtcggaccctaccgttgactagtccgagggtcggggccctagggtacggacgtagtaggaacgtctagaaccttaattagtttacgtaccgacctaaccgagtaacgtaggtaggtcggtactaggttacgggtaagggggttacgttacggggacgggtaacggggtaaccgtaaagggtttccggtaccccgggttccgtttacgggtacccgaacgggtacccccggtaaacgggtccccgtacccggtcccccccgtttaccggggtacccttaacccggtttcccgttccccggttcccccccggttacccccc

SEQ ID NO: 88584 - DNA, 516 bp, Homo sapiens
  misc_feature: GYAE6OF01BAH50.21.8.A08.1.454.CMB.1.raw
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggagcatggtccagcctgggaggtccctgagcctctcctgtgcagcgtctggattcagtatcggctccttgccatgcactgggtccncaggctccgaggcaaggggctgggagtgggtggcgattatctggtatgatggaagtgagagatattatcagactcgtagaacgggcattcaccatctcaganacaatgaccaacaacacactgtatcttacaatcgaccggctagagagccgagacacggntagtgtacttacgtgtacgagtcgtttggtctaggttcggggacctagggtaccctgggtcccg

SEQ ID NO: 88585 - DNA, 670 bp, Homo sapiens
  misc_feature: GYAE6OF01CORNV.21.8.A08.1.454.CMB.1.raw
  modified_base (127)..(127): a, c, t, g, unknown or other
  misc_feature (127)..(127): n is a, c, g, or t
  modified_base (173)..(173): a, c, t, g, unknown or other
  misc_feature (173)..(173): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttcngcacagtctctgacggcctctatgagctgacacagccacctcggtntcagtcgtcccaggacaaacggcaggactcacctgctcgtggaatattcattcgaaccaaaaagtatattacgttgttcggttaccagcaagaacgtcacggccacggtccctgtactggtcaatccagtcggacgccctagtcggaaccgacgtacgtaccgggacttcccgtaggacgtaggtacttccgtcgtcgccctacgagccgtcggaacgggtactaacgtccggacctacttcggacttacgacgtagggtcgggacctaggggtacggacgtacgtagaacgtctacgtacgtattacgttacgtaacgccaagaacgtacgtaaggtacgtcggtacgtacggtacgggtaaggggtacgttacggggacggtaacgggtaaccgtaacgggttccgttacccggtcgttagggacccgtaccgggacccgtaacgggccgttacccggtacccccgtacgggttacctcccgttccgttaccccg

SEQ ID NO: 88586 - DNA, 552 bp, Homo sapiens
  misc_feature: GYAE6OF01BZGWF.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggccctgtactggtcatccatgaggccagtcgacgacacgtccgggatcccgtgagagattctctcgcccttcagcctcgagggacaggtcggacccaccgttgactagtcgaggtcggggcccaggtggacgataggaagctagactactattgtacgcaccagacagtagtggtcagtcggtaggggttattcgggacggagggtaaccgtaaggttcgaccgttcgttggcgacgcccgaaggcctcgcccccgtcggtccaccgttctccgttcccctacccc

SEQ ID NO: 88587 - DNA, 716 bp, Homo sapiens
  misc_feature: GYAE6OF01DHLH8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcactgctctggagattcattgaccaaaagatattacttgttggttccagcagaagtcaggccaggcccctgtactggtcatccatgacggccagtcgacgacacgtccgggatccctagagagtattcctcgtcgtccctccagtctcgagggactaggtcggcctaccgttgaacttagtcgaaggtccgggggacccctaaggggtacggacgtagtacggaacgtcttacgtaaccttaacgttagtttacggttaaccgaccaacccgaaggtaccgtaaggttacggttaggttaccgtaaggttacgggtaagggggggttacgttcggggggaccggggtaaacggggtaaccccgtaaaggggttttaccgggaaccccgggttttccggtttaggggtacccggtaaccgggtaccccccggtaaacggggtcccgtttccccgggaccccccccgtttaccggggttacccttaccccggtttcccgtttacccccggg

SEQ ID NO: 88588 - DNA, 583 bp, Homo sapiens
  misc_feature: GYAE6OF01AMPMO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctgtactggtcatccatgagccagtcgacgacacgtccgggatcccgtgagagacttctctcgccctccagctcgagggaccaggtcggccctaccgttgaccttagtcgaggtcggggcccgagggtcggacgtagtagaacgtctagaccttacgttagtttcgtaccgcaccagactagtagtgtactagtcggtaggggttacgtcgggacgggaggaccgtaagttcggacccgttcgttagggtaccacggaccccgaaggtcccgtaccggcccccgttaggtccctccgtccgttccccgg

SEQ ID NO: 88589 - DNA, 541 bp, Homo sapiens
  misc_feature: GYAE6OF01CQWVL.21.8.A08.1.454.CMB.1.raw
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggcatccatgaggccagtcgacgacactccgggatcccgtgacgagattctctgccctccagctcagggacngtgccacttgactncagtgggcccgaggtggacgatgaagctgactactatgtacgcacgaagacagtagtggtactagtcggtaggggttatcgggacggagggaccgtaggttcgaccggttccgttggtaccgacgcccgaacgccgtccggacccccgttcggtaccctaccgttcttaccccgg

SEQ ID NO: 88590 - DNA, 600 bp, Homo sapiens
  misc_feature: GYAE6OF01B70WM.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcgaggccaggcccctgtactggtcatccatgacgccagtccgacgacaccgtccgggactcccgagagagtactttctcgtcgccctccgagctacgagggacaggtcggcccaccgtttgaaccttgtcgaggtcggggcccgagggtcggaacggtagtaggaacgtcgtaggtaaccttactaccgttgttaacctcgacgaccaagaccgagccgtaggtcgtacagttcgggaggggctaggttcgggacgggacgggtaccgtacgggttcgaccggttccgtacggtacgaccggtacccgacggtccgtccggtcccccgtcggtacccg

SEQ ID NO: 88591 - DNA, 535 bp, Homo sapiens
  misc_feature: GYAE6OF01B8GVT.21.8.A08.1.454.CMB.1.raw
  modified_base (219)..(219): a, c, t, g, unknown or other
  misc_feature (219)..(219): n is a, c, g, or t
  modified_base (360)..(360): a, c, t, g, unknown or other
  misc_feature (360)..(360): n is a, c, g, or t
  modified_base (525)..(525): a, c, t, g, unknown or other
  misc_feature (525)..(525): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtcgtccccaggacaaacggccaggatcacctgctctgganattcattgaccaaaagaatatacttgttggttccagcagaagtcaggccaggcccctgtactggtcatccatgaggccagtcgacgacaccgtccgggatcccgtgagagtacttcctctcgccctccagcctcgaggacnggtcggccaccttgactatcgaggtcggggcccagggtcggacgagtagaagctagacttacttattcgtacgcaccagactagtagtgtctagtcgaggggtattcgggacggaggacgagttcgaccgtcgttggcacgcccgaaggcctcgcccctggtccncgttctcccg

SEQ ID NO: 88592 - DNA, 590 bp, Homo sapiens
  misc_feature: GYAE6OF01CEMF9.21.8.A08.1.454.CMB.1.raw
  modified_base (222)..(222): a, c, t, g, unknown or other
  misc_feature (222)..(222): n is a, c, g, or t
  modified_base (441)..(441): a, c, t, g, unknown or other
  misc_feature (441)..(441): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganattcattgaccaaaagatatacgttgttggttccagtcagaagtcaggccaggcccctgtactggtcatccatggaggccagtccgacgacacgtccgggactcccgtgacgagtacttctctgtccctacgagcctcgaggacagtcggcctaccttgactatacgaggtcgggccgtagggtcggacgataggaagctagacttatacgttagtacncaccagacagtagtgtctagtacggtaggggttattcgggacgggacgggtaaccgtaaggttacggtacccggttcgttaggtaccgtacggacccccgaaggtcccgtaccggtcccccgtacggtcccaccgttccgttccccggg

SEQ ID NO: 88593 - DNA, 735 bp, Homo sapiens
  misc_feature: GYAE6OF01BJSHS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccgaggacaaacggccaaggactccacctgctcgtggagtattcattcgaccaaaagaatatacgttgttcggttccagacaagaagtcgaggccacggtcccctgtacgtggtcactccagtcggacggccaggtccgacgacaccggtccgggactcccgtaggagacgtacttcctcgtcgccctaccgagcctacggagggacctagggtccgaccctacgttcgaccttactcggaacgggttccgggaccgtagggtacggaacgagtacggaacgtccttagtaacctttacgttacgtttacggttaacctacccgaaacgtaacggaacgttagggtaacggttacggtaccgtaggttaccgggttaagggggttaccggttaccgggaaccggggtaaacggggtacccgttaaagggttcccggttaaccccggttcggtttacgggtacccgaaccggtaccccggtaaaccggtccccgttacccggtaccccccgttaccgggtacccttacccggttcccggttacccccg

SEQ ID NO: 88594 - DNA, 586 bp, Homo sapiens
  misc_feature: GYAE6OF01DNXNB.21.8.A08.1.454.CMB.1.raw
  modified_base (221)..(221): a, c, t, g, unknown or other
  misc_feature (221)..(221): n is a, c, g, or t
  modified_base (574)..(574): a, c, t, g, unknown or other
  misc_feature (574)..(574): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcgaggccaggcccctgtactggtcatccatgacggccagtcgacgacaccgtccgggactccccgtaggagagtactttcctcgtcgcccttccgacgtctacgagggacaggtcggccctaccgttgaacttgtacgacgggtcggggaccccgagggtacggacgagtaggaagcgtagaacttactagtttcgtacgacaccgaagacagtagtaggtctagtcggtaggggttacgtcgggacgggaacggtacctaggttcgaccggttccgttggactcgacccgagcctccgccccgtcgtacnccgttcgtcccg

SEQ ID NO: 88595 - DNA, 602 bp, Homo sapiens
  misc_feature: GYAE6OF01A213L.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactgcatccatcgacgccagtccgacgaccaccgtccgggactcccgtaggagacgtacttcctctcgtccctccagcctcggaacgggactacggtccggaccctaccgtttagaccttagtccgacgggttccggggacccgtagggtacgggaacgtagtaggaacgcgtacgaacttacgtatttcgttacgcaccgagacgagtagtcgacgtagtcggtagggtacgttcgggacggacgggacctaggttccggaccgtcgttggacgcgacccgtaacggccgtccgtacccccgtcgtcctccgtccgttacccg

SEQ ID NO: 88596 - DNA, 852 bp, Homo sapiens
  misc_feature: GYAE6OF01CBI42.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaacggccaggatcacctgctctggagattcattgaaccaaaagatatacttgttcggtccagcaagaagtcgaggccacggcccctgtacgtggtcactccagtcggacggccgaggtccgaacgacctaccgtccgggactccccgtaggacgtacgtactttcctcgtcgtcccttaccgacgtccgtacggaacggggacgtaacgggttccgggaccccttaaccgtttcggtaaccttacgttaccggtaacggggttacccggggggaccccggtaagggggttaccggggaaaccggtaacggttaacgggaaaccggtccggttaacggtaaacccgtttaaccgtttaacgttttacgggttaacccggtacccgtaaacccggtaaacggtaacggttaaagggtttaacgggttacgggttaaccgttaacgggttaccgggggttaaggggggtttaaccggttaccgggggaaccgggggtaaacggggtaacccgttaaacggggtttaccggtaacccgggtttccggtttacggggtaacccgtaaccgggtacccccggtaaaggggttccccgttaccccggggtacccccccggtttaggggttaccccgttacccgttcccggtttaccccccggg

SEQ ID NO: 88597 - DNA, 583 bp, Homo sapiens
  misc_feature: GYAE6OF01DU7FO.21.8.A08.1.454.CMB.1.raw
  modified_base (220)..(220): a, c, t, g, unknown or other
  misc_feature (220)..(220): n is a, c, g, or t
  modified_base (570)..(570): a, c, t, g, unknown or other
  misc_feature (570)..(570): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctgganattcattgaccaaaagatatacttgttgttccagcagaagtcaggccaggcccctgtactggtcatccatgagccagtcgacgacacgtccgggatcccgtagagagtattctctcgccctccagcctacgacggggacacggtcggcccctaaccgtttgaacttacgtcgtacggtcggggcccgtagggtacgggaacgtaagtagaacgctagaacttacgttagtttacgttacgacaccgagacgagtagtggtactagtcggtaggggtagttcggacgggaggacgtagtcgtaccgtcgttggtcgacgacccgtaaggccgtaccggccccgtcggtccnccgttcgtcccgg

SEQ ID NO: 88598 - DNA, 560 bp, Homo sapiens
  misc_feature: GYAE6OF01C28PA.21.8.A08.1.454.CMB.1.raw
  modified_base (546)..(546): a, c, t, g, unknown or other
  misc_feature (546)..(546): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacacgtccgggatccctgagagattctctcgccctccagctcgagggacagtcggccaccttgactatcgaggtcggggacccgagggtggacgagtagaagctagacttacttattgtacgcaccagacagtagtcggtcagtacggtaggggtagttcgggcgggtacgggaccgaaggttcgacccggttcgttaggtcgacggacccgaaggcccgtccgtcccccgtggtcccnccgttccgttcccg

SEQ ID NO: 88599 - DNA, 663 bp, Homo sapiens
  misc_feature: GYAE6OF01DXC58.21.8.A08.1.454.CMB.1.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcactgctcngganattcattgacaaaagatatacttgttgtccagcagaagtcaggccaggcccctgtactggtcatccatgacgccagtcgacgacacgtccgggatcccgtaggagagtacttcctcgtcgtccctccgaagcctacggaagggactaggtccggaccctaccgttgaccttagtccgtacgggtcgggacccgtagggtacggaacgagtaggaacgtacgtacgtaacttacgttagttacgttaccgaccaaccgagaacgtagttacggtggtacgtaaggtacggtagggggttacgttaccggggacgggtaacgggtaaccgttaaagggttaccggtaaccccggttccggttcgggtaccgtaccgggaccccgtaaacggtcccggtcccggtccccccgttacgggtcccgttaccgtcccggtttcccccgg

SEQ ID NO: 88600 - DNA, 534 bp, Homo sapiens
  misc_feature: GYAE6OF01CUU0D.21.8.A08.1.454.CMB.1.raw
  modified_base (220)..(220): a, c, t, g, unknown or other
  misc_feature (220)..(220): n is a, c, g, or t
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttggtccagcagaagtcaggccaggcccctgtactggtcatccatgaggccagtcgacgacacgtccgggatccctgacgagatttcnctcgcctccagcctacgagggacagtgccctacttgactatcagtgggccaggtggagagtagaagcgtgactactactgttactacagacagaacagcgaagtggtcagtcgacggggcgtacgttcggcggagggaccgtacggttagaccggtccgtacggtacacgcccgaacggcctacgcccccgtcggtacccg

SEQ ID NO: 88601 - DNA, 550 bp, Homo sapiens
  misc_feature: GYAE6OF01ASX9P.21.8.A08.1.454.CMB.1.raw
  modified_base (237)..(237): a, c, t, g, unknown or other
  misc_feature (237)..(237): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaaaattntgttttttgaccagcagaagtcaggccaggcccctgtgttggtcatccatgaggacaggagaccgaccctccgggatcccctgagagattctctggctccgaactcgagggacggtggccacggtttgattctcgagtcggggcccagggtggaggatgaagcgtgacttactactgttactcagcagacagcagtggtcagtcgagggggtcagttcgggcgggtacggaccgtaggtcgtaccggtcctacggtcaggcccgtacggccgtcgcccccgtcggtccaccgtccgtcgttcccctacccccg

SEQ ID NO: 88602 - DNA, 631 bp, Homo sapiens
  misc_feature: GYAE6OF01CRKUV.21.8.A08.1.454.CMB.1.raw
  modified_base (222)..(222): a, c, t, g, unknown or other
  misc_feature (222)..(222): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctgganattcatgacaaaagatatacttgtgtcagcagaagtcaggccaggcccctgtactggtcatccatgagccagtcgacacacgtcccgggatccgagganagtacttcncgtcgaccctcagcctcgaggacagtcggacctactgactactcgaggtcgggccagggtacgagagtaggaagtcgtagacttaactagtttacgtaccggacaaccgaaggtaacgtaagtaggttacggtactaagttacggtaacggggggttacgtccggggacgggtaacgggtaacccgtaaagggttccggtaaacccgggttccgtttagggacctaaccgggaccccgtaaggggtccctacccgggtaccccccgttcggtacccgtaacccgtttccgttacccccggg

SEQ ID NO: 88603 - DNA, 527 bp, Homo sapiens
  misc_feature: GYAE6OF01B3APD.21.8.A08.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagaatatacgttgttgttccagcagaagtcaggccaggcccctgtactggtcatccagtgagccagtcgacgacacgtccgggactcccgngagagacttcgtctcgccctccagcctcgaggacaggtcgcctaccttgactatcgaggtcgggccgtaggtcggacgagtgaagctagactactagttgtacgcacagacagtagtggtacagtcgaggggtagtcgggacggacggacgtaggtcgacgtcgttgcgcgccgaggctccgcccctggtcctcgtctcccg

SEQ ID NO: 88604 - DNA, 642 bp, Homo sapiens
  misc_feature: GYAE6OF01C7JX6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctctatgagctgacacacgccaccctcggtgtcagtcgtccccaggacaaacggccaggactcacctgctctggagattcattgaccaaaagatatacttgttgtccagcagaagtcgacggccacggccctgtactggtcatccatgagccagtcgacacacgtccgggactcccgtagagagtacttctctcgccctcgacgcgtcgaaggacaggtccggaccacctttgactatcgaggtcgggccagggtgacgtataggaagcgtagtaacgttatagtttacgttaaccgactaaccgaagaacgtaagtaaggtcgttacgaacgttacgggaaggggttacgttccggggaacgggtaacggtaacccggtaaaggtttccggtaaaccccggttccggttacgggtacccgtaccggaccccgtaaacgggtccccgtacccggtaccccccgttaccgggtccctaacccgttcccgtttcccccgg

SEQ ID NO: 88605 - DNA, 733 bp, Homo sapiens
  misc_feature: GYAE6OF01EU5ZZ.21.8.A08.1.454.CMB.1.raw
tcagtcgtcgctcgcacgaccggtgctcgatttagcatactctacgagggggctgtgggctcaggaggcagagctctgggaatctcaccatggcctggacccctctcctgcctccccctcctcactttctgcacagtctctgaggcctctatgagctgacacagccaccgtggtgtcagtcgtcccgaggacaaacggccaggactccgaccgtgctcgtggactattcagttcgaccaaaaagtattattactttgttcgttccagcaagaagtcgacggccacggcccctggtacctggtacacgtccgagtcggacggcctagtacgaacgaacacgtccgggatcccgtagaagtacgtattctcgtcgacccttacgaacgtctacgaagggactacggtccgacctaccgttgaacttacgtacgtaacggtccggggaccgtagggtacggaacgtaagtaaggaaacgtccgtacgtaaaccttaagttaacgtttacggtaaccgactaaccgtaacggtactaaggttaacggtacgttacgtaacgttaccgggtaagggggttacgttaccggggaccgggtaaacgggtaaccgttaaacgggttaccggtaacccggtttccggttacgggttaccgtaaccgggttacccgtaaacgggtcccgttacccggacccccggtttaccgggtaaccctaccggttcccgtttaccccggg

SEQ ID NO: 88606 - DNA, 614 bp, Homo sapiens
  misc_feature: GYAE6OF01BXL9E.21.8.A08.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagcatactctacagggggctgtgggctcaaggaggcacgagctctgggaatcctcaccatggacctggacccctctcctgcctcccccgtcctcacgtttctgcacagtctctgaggcctcctatgagctgacacagccaccctggtntcagtgtccccgaggacaaacggccaggatcacctgcctctggagattcgattcgaccaaaagatatacttgttggtccagcagaagtcaggtccaggcccctggtactggtcactccgagtggacgtccgaggtcgacgacactccgggactcccgtgagagtattctctgccctccagctcgaggacaggtcggcctaaccgttagactatcgaggtcgggacccaggtcggaacgagtagaacgtctagacttacgtagtttcgtacgcaacagacgtagtacgtgtacgagtacggaaggggttactacgggacggtaacgggtaaccgtaaggttcggtaccgttccgtttaggtaccgtacggaaccccgtaaggtacccgttccggtaccccccgtttaggtaccctaccgttccgttacccccgg

SEQ ID NO: 88607 - DNA, 624 bp, Homo sapiens
  misc_feature: GYAE6OF01A3D9T.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcactgtctctgaggcctcctatgagctgacacagccaccctcggtgtcagtcgtccccaggacaaacggccaggatcacctgctctggagattcattgaccaaaagatatacttgttggttccagcagaagtcaggccaggcccctgtactggtcatccatgaggccagtcgacgacactccgggatccctgagagattcgtctgcctacccagtcctacgagggacacgtcggacccaccgtttgaacttagtccaggtcggggcccgtagggtcgggaacgatacggaaaggtcctagaacttacgtaagtttggttaaccgcctaacagtacgagttaggtaggtcctagtccggtagggggttacttccgggacgggtaagggtaccctaaagggttccgggaccgttccgttagggtcctacggaccccgaaacgggtcccgtaccggtaccccccgttaccgggttcctaaccggttccgttaccccgg

SEQ ID NO: 88608 - DNA, 639 bp, Homo sapiens
  misc_feature: GYAE6OF01CC7IR.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcaggccaggcccctgtactggtcatccatggacggccaggtccgacgacaccgtccgggactcccgtgagagtattctctcgccctccgagctcgagggacaggtcgaccctacgttagacttagtcgacggttcggggacccgtagggtacgggacgagtagaacgtcgtagtaacttacgttagtttacgttaccgacaaccgaagacgtaaggtaggtacggtactagtacgggtaggggttacgtcgggacgggtagggtaaccgtaagggttaccggtacccggttccggttacgggtaccgtaccggacccgtaaacggtcccgttacccggtaccccccgttacgggtccctaccgttcccgttaccccgg

SEQ ID NO: 88609 - DNA, 640 bp, Homo sapiens
  misc_feature: GYAE6OF01DM1R2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtgtccccaggacaaacggccaggatcacctgctctggagattcattgaccaaaagaatatacttgttgttccagcagaagtcaggccaggcccctgtactggtcatccatgagccagtcgacgacacgtccgggatccctgacgagattctctgccctcagctcgagggacagtcggaccaccgttgaactatacgacggtcggggacccagggtaggacgagtaggaaacgctagtaacttacttaagtttacgttaccgacgaacctaagaacgtaaggttaacggtaggttacctaagttacggtaagggggttacgttccggggacgggtaacgggtaccgtaaaggtttcggaacccgggtttcccgtttaggggttacccaacggtaccccgaaagggtcccgttacccggacccccccgttaccgggttaccctacccgttcgtttccccggg

SEQ ID NO: 88610 - DNA, 535 bp, Homo sapiens
  misc_feature: GYAE6OF01CDYJQ.21.8.A08.1.454.CMB.1.raw
  modified_base (219)..(219): a, c, t, g, unknown or other
  misc_feature (219)..(219): n is a, c, g, or t
  modified_base (468)..(468): a, c, t, g, unknown or other
  misc_feature (468)..(468): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaaagatatacttgttggttccagcagaagtcaggccaggcccctgtactggtcatccatgaggccagtcgacgacacgtccgggatccctgagagattctctgccctccagctcgagggacaggtcggcccaccgttgactatcaggtcgggccgagggtggacgagtgaagctgacttactagtttcgttacgcacgagacaggttagtggtcagtcggtaggggtagttcgggnggacgggaccgaagttcgaccgtcgttggcgacgcccgaaggctcgcccccgtgtccactcgtcccg

SEQ ID NO: 88611 - DNA, 533 bp, Homo sapiens
  misc_feature: GYAE6OF01BYEFA.21.8.A08.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggactccctgagagtacttctctcgccctccagtctcgacgggacaggtcggcctaccttgacctatcgaggtcgggccctagggtcggacgatgaagtctagacttactattgtaccgcacagacagtagtgtcagtcgagggtgtcgggnggagggactaggttcgaccgtcgttgtacacgccgaaggcctccggccccgtacggctcgtcgtccg

SEQ ID NO: 88612 - DNA, 547 bp, Homo sapiens
  misc_feature: GYAE6OF01ERATV.21.8.A08.1.454.CMB.1.raw
  modified_base (221)..(221): a, c, t, g, unknown or other
  misc_feature (221)..(221): n is a, c, g, or t
  modified_base (534)..(534): a, c, t, g, unknown or other
  misc_feature (534)..(534): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgagccagtcgacgacacgtccgggaatccccgtagacgagtacttctctgccctccagctcgaggacagtcggcctacttgactatcgaggtcgggcccaggtggacgagtagaagctagactacgttattacgttacgcacagacagtagtgtacagtcggaggggtactcgggcggagggacctaggttcgaccgttccgttaggtcgacgacccgaaggccctcggccccctggtcccncgtccgttacccg

SEQ ID NO: 88613 - DNA, 713 bp, Homo sapiens
  misc_feature: GYAE6OF01CP5RU.21.8.A08.1.454.CMB.1.raw
tcagtcgtcgctcgcacgaccggtgctcgatttagcatactctacagggggctgtggggctcaggaggcagagctctgggaatctcaccatggcctggaccctctcctgctccccctcctcactttctgcacagtctctgaggcctcctatgagctgacacagccaccctcggtgtcagtcgtccccaggacaacggccaggatcacctgctcgtggagacttcattcgaccaaaagatattacgttgttgttccagcagaagtcacggccacggcccctagtactggtacataccagtcgacggccagtccgacgacacgtccgggactcccgtaggacgagtacttcgtcctacgtccctaccgacgccgtacgaaggggtacaggtcggacctaaccgtttgaaccttagtaccgtaacgggtccggggaccccgaagggtcgggaacgtagttacgaaacggtctacggtaaccttaacgttaacgtttcggttaaccggacctaaccgtaacggtaacgttacggttaacggttcgggtactaacggttcgggtaagggggtttaccgttcccggggaccgggtaacggggtaacccgtaacgggtttcggaacccggtttccggttagggtacccgtaccgggtacccgaaacgggttcccgtacccggtacccccggttaggtccctacccgttcccgttccccgg

SEQ ID NO: 88614 - DNA, 761 bp, Homo sapiens
  misc_feature: GYAE6OF01DRTA9.21.8.A08.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagcatactctacgtaggggggctgtgggctcaggaggcagagctctgggaatctcaccagttcggcctggacccctctcctggcctccccctctcactttctgccacagtctctcgagtcctcctatgacgctagacacacgcccaccctggtctccaggttcnccccgaggacaacggccaggatccactgcctcgtaggatacttcgagttacgaaccaaaagtaacttattaccgtttaggtttacggttaccaagtactaaagtaagtcacggaccacggacccccttagtaacgtcggtacaacttacctaagtcgacggcctaggtccgacgtacaccgtacggacttcccaggacgtacgacttcctcgttcgccctcgagtcgtacggagggtacctacggtcggacccttaacgtttcggaacctttacgtaccgtaacggggttacccggggaaccccgtaggggttaacggaaccgtagtaacggaacggtccgttacggtaacctttaacgttttaacgtttacggtttaacccgacctaacccgtaccggtaataacggttacggttacggtacttacgttaccggggtacggggtttacgttaccggggacggtaaccgggaacgttacggttaccggaccgtttcgttaggtccaacggtacccgtaaggtcccgtccggtccccgttaggtaccctccgttccgttaccccg

SEQ ID NO: 88615 - DNA, 613 bp, Homo sapiens
  misc_feature: GYAE6OF01BF5FP.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactgtcatccatgagccaggtcgacgacacgtccgggactcccgtgacgagtacttctcgtcgccctccgagcctacgagggacagtcggcctaccgttgactatcgaggtcgggccctagggtgaccgataggaacgtcgtagacttacgttagtttcgtaccgcaaccaggaacctaggtaggttggtacctagtacgggtagggggttattaccggggacgggacgggtaaccgtaaggtttacggaccccggttcgttcgggtaccgacggtaccccgaagggtcccgtaccggtccccccgttcgggtccctacccgttccgttccccgg

SEQ ID NO: 88616 - DNA, 617 bp, Homo sapiens
  misc_feature: GYAE6OF01D7FZA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggaccaaacggccaggatcacctgctctggagattcattgaccaaaagatatacttgttgttccagcagaagtcaggccaggcccctgtactggtcatcatgagccagtcgacgacacgtccgggactccctaggagagtattcctctcgccctccaggcctcgaagggacaggtcgaccctaccttgaacttagtcgtaaggtcggggacccgtagggtcggacgagtacgaagcgtagtacttacttagttcgttacgctaaccgagtacaaggtagtggtactagtacggtaagggggttactcgggacgggtaacgggaaccgtaagggttcgtaacccggttccgtttagggtaccgtaaccggacccgtaagggtcccgtcccgtaccccccgtcggttcccgtaccgttccggttccccgg

SEQ ID NO: 88617 - DNA, 751 bp, Homo sapiens
  misc_feature: GYAE6OF01EU5ZS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaagatatacttgttggtccagcagagtcaggccacggcccctgtactggtcatccatgacggccagtcgacgacacgtccgggatccctgagagtattctctcgccctcagtcctcgaacgggacacggtcggaccctaccgttacgacttacgtacgacgggttccgggggaccccgtaacggggttacggggaacggtaagttaacgggaacgtaccgttaacggtaacccttaaccggtttaagtttacggtttaaccggtcccgtaacccgtaagggaaaccgttaacggggtttacggtacgggttaccgtaacggttacgggttaaacgggggggtttacgtttaccgggggaacggggtaaaccggggtaaccggttaaacgggttaccggggtaaccccggtttccggtttacggggtaacccgtaccggtaaccccggtaaccgggacccgtttacccgggcccccccgtttaacggggttccctaacccgttccggtttaaccccccg

SEQ ID NO: 88618 - DNA, 781 bp, Homo sapiens
  misc_feature: GYAE6OF01BRFKZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggcaggatcacctgctctggagtattcattgaccaaaagatatacttgttgtccagcaagaagtcaggccaggcccctgtactggtcatccagtcgacggccaggtacgacgactaccgtccgggactcccgtaggagtacgtactttcgtcgtacggtccccttaccgacggtcctacggaacggggacctaacgggttccgggacccttaacccgtttaggaaccttagtaccgtacggggttaccgggggacccgtaaggggtacgggacgtaaggtacggtaaacgtccgttacggtaacctttaacgtttaacggttttaccggttaaccggtaacccgtaaccgtaaccggtaaccggtaagggtttaacgggttaccgggtactaacggttacggggtaacggggggtttacggttaccggggaaccggggtaacggggtaacccggttaaacgggttaccgggtaacccgggttcccggtttacgggtaccggtaccgggtaccccggtaacgggtcccggttaccccggtaccccccggttcggttacccttcccgtttcccggttaccccccgg

SEQ ID NO: 88619 - DNA, 670 bp, Homo sapiens
  misc_feature: GYAE6OF01BBY63.21.8.A08.1.454.CMB.1.raw
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggaccaaacggccaggactccacctgctcgtggagtattcattcgaaccaaaagtaattatacgtttggttcggttaccagtcaagaacgtcgacggccacggcccctgtactggtcatccgatcggacgccgagtccgacgactaccgtaccggactccctagagacgtcttcnctcgcctcncgctcgacggactacggtcgcctacgttgaactgtcgacgggtcgggaccgtagggtcgacgagtacggaagtccgtacgtaacgttacttaggtttacgtaccgacgtaaccgaggtactaagggtacggttacggagtacgggtacggtaagggggttacgttacgggggacgggtaaaccgggtaccgttaaggttccgggtaccggttccggtttaggaccggtacgaccccggtaggtcccgttcccggtacccccggttaggtacccctccgttccggtttacccccgg

SEQ ID NO: 88620 - DNA, 720 bp, Homo sapiens
  misc_feature: GYAE6OF01CMUVN.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggtccagcagaagtcaggccaggcccctgtactggtcatccatgacggccagtcgacgacacgtcccgggatcccgtgacgagactttcgtctgccctccgtaggcctacgaagggctaggtcggacctaccgtttgacttatcgaacgggttcggggaccccgtagggtacgggaaccgtaagttacggaaacgtcgttacggtaaccttaacgtttacgtttacggttaaccggacaaccgtaagtaaccgtacggtaaggttcgggttaccaacgttcggggtaacgggggtttacgttacccgggggacggggtaaacggggtacccgtaaaaggggtttccggtaaccccgggtttcccggtttcggggtaccctaaaccgggtcccccggtaaaaccggggtcccctttcccgggtacccccccgtttaccggggttccccttaacccggttccccggtttacccccgg

SEQ ID NO: 88621 - DNA, 558 bp, Homo sapiens
  misc_feature: GYAE6OF01EV9ZN.21.8.A08.1.454.CMB.1.raw
  modified_base (223)..(223): a, c, t, g, unknown or other
  misc_feature (223)..(223): n is a, c, g, or t
  modified_base (334)..(334): a, c, t, g, unknown or other
  misc_feature (334)..(334): n is a, c, g, or t
tcagtcgtcgctcgcacgaccggtgctcgatttagcatactctacagggggctgtgggctcaggaggcagagctctgggaatctcaccatggcctggacccctctcctactccccctcctcactttctgcacagtctctgacggcctcctatgagctgacacacgcccaccctcggtgtcagtcgtccccaggacaaacggccaggactcactgctcgtgganattcattgaccaaaagattatacttgttcggttccagcagaagtcaggccacggccctgtactggtcatccatcggacggccaggtcgacgaccacgtccgggactcccgngagatacttctctcgcctcagctcgaggacaggtcgcctacgttgactacgtcgaggtccgggaccgagggtggactagtagaacgctagacttacgttattacgtacgcacgacgactagtagtcgtacagtcggaggggttctcgggacggtacggacgtaagttcggaccgttcgtgacgacgccgacgccgtccgtccccgtgtacctctcgtcgtaccc

SEQ ID NO: 88622 - DNA, 706 bp, Homo sapiens
  misc_feature: GYAE6OF01CREH5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggactcacctgctcgtggagattcattgaccaaaagatatacttgttcggtccagcagaagtcaggccaggcccctggtactggtcatccatgagccagtcgacgacacgtcgggactcccgtagacgtagtactttctcgtcgcccctcgagtcctacgacggggtactaggtcggacccctaaccgtttaggaccttacgtccgtaagggtccggggaccccgtagggtacgggacgtagtaggaacgtcgtacgtaaccgttaacgttacgtttacggttaaccgaccgtaaccgaaggtacgtaaggttacggttcgggttaacctacgggttaccgggaaggggggtttaacgttacgggggaccggggtaaacggggtaacccgtaaggggtttaccggacccggtttcccggttacgggttaccgacccggacccggtaaacgggtccctacccgggtcccccttaccgggttaccctccgtttccccggttaccccg

SEQ ID NO: 88623 - DNA, 545 bp, Homo sapiens
  misc_feature: GYAE6OF01DRPOR.21.8.A08.1.454.CMB.1.raw
  modified_base (220)..(220): a, c, t, g, unknown or other
  misc_feature (220)..(220): n is a, c, g, or t
  modified_base (530)..(530): a, c, t, g, unknown or other
  misc_feature (530)..(530): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggccccctgtactggtcatccatgaggccagtcgacgacacgtccgggatccctgagagattctctgccctccagctcgagggacagtcggccaccttgactatcagtcgggcccagggtggacgatgaagctagactactattgttacgcaccagacagtagtggtctagtcgaggggtattcgggcgggacgggaccgaaggttcgaccgttccgttggtcacggccccgtaaggccttccggccccccgttggtcccncgttccgttccccgg

SEQ ID NO: 88624 - DNA, 736 bp, Homo sapiens
  misc_feature: GYAE6OF01DLULG.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttgtccagcagaagtcaggccaggcccctgtactggtcatccatggacggccagtcgacgacacgtccgggatccctgagagtacttctctcgccctcgagctacgagggaccacgggtcggaccctactttcggaacttacgtaccgtaagggttccgggggaccccgtaggggttacgggacggtaacgttaggaaacggtccttagggtaacctttaacgtttaagtttacggttaaccggtacccgaacccgaacgtaacgtaacggttaagggttacgggttaaccgtacggttacgggtaacggggggtttaacggttaccgggggtaccggggtaacgggggtaacccgtaaacgggtttaccgggaacccggtttacccggttacggggttaccgtaacccggaccccggtaaacgggtaccccgttcccgggtacccccccgttaccgggttccccgtaacccgtttcccgttacccccggg

SEQ ID NO: 88625 - DNA, 702 bp, Homo sapiens
  misc_feature: GYAE6OF01C57E7.21.8.A08.1.454.CMB.1.raw
  modified_base (220)..(220): a, c, t, g, unknown or other
  misc_feature (220)..(220): n is a, c, g, or t
  modified_base (323)..(323): a, c, t, g, unknown or other
  misc_feature (323)..(323): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcactgtctctgaggcctcctatgagctgacacagcccaccctcggtgtcagtcgtccccaggacaaacggccaggatcacctgctctgganattcattgaccaaaagatatacttgttggttccagcagaagtcaggccaggcccctagtactggtcatccatgagccagtcgacgacacgtccgggatcccgngagagtattctctcgccctcagctcgaggacaggtcggccctacgtttgacttagtcgtacgggtcggggaccccgtagggtacgggaacgtagtaggaaacgtccgtagtaaccttaacgttaacgtttacggttaacccgaccaacccgtaaggtaaccgtaaggttacggttacgggttaccgtaaggttaccggggtaaggggggtttacgttccgggggaccggggtaacggggtaaacccgtaaagggtttccggaacccggtttcccggtttacgggtaacccgtaccgggaacccccggtaaacgggtcccgtaccccgggtacccccccggttcggttaaccccgtcccgttccccggtttacccccggg

SEQ ID NO: 88626 - DNA, 745 bp, Homo sapiens
  misc_feature: GYAE6OF01EFAAZ.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggactccacctgctcgtggatattcattcgaaccaaaagtattattacgtttgttcggttccagcaagaagtcaggccacggccctgtacgtggtcactccatcggacggccagtcgacgacaccgtccgggactcccgtagacgtacgtacttccgtctcgccctaccgagtccgtacggacgggacctacggtcggacccctaccgtttacgaaccgttacgtccggtaacggggttcccgggggaccccgtaagggggtacggaacggtaacgttacgggaaacggtccgttaacggtaacctttaacgtttaacggttttacggttaacccgacctaaccgtaacggtaaccgtaggttacgggttacggtacgtacggtacggggtaagggggtttacgttccggggacgggtaacgggtaccgtaagggttccggtacccggttccgttacgggtaccgtacggtaccccgtaacgggtcccgtacccgggtcccccgttcgggtaccctacccgttccgttcccgttccccccgtaccccg

SEQ ID NO: 88627 - DNA, 569 bp, Homo sapiens
  misc_feature: GYAE6OF01BFYYX.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagagtcaggccaggcccctgtactggtcatccatggagccagtcgacgacacgtccgggatcccgtgagagacttctctcgccctccgacgctcaggggacaggtcggcctaccgttgacttatcgacggtcggggcccgtagggtaggacgagtgaagctagactacgtagtttgtacgcaccagacagtagtggtcagtcgtaggggttacgtcgggacgggtagggaccgtaagttcggtaccgttccgttggtaccgacggcccgaacggtccgtaccggcccccgttcggtcctaccgttccgttcccg

SEQ ID NO: 88628 - DNA, 679 bp, Homo sapiens
  misc_feature: GYAE6OF01C3AEJ.21.8.A08.1.454.CMB.1.raw
  modified_base (136)..(136): a, c, t, g, unknown or other
  misc_feature (136)..(136): n is a, c, g, or t
  modified_base (237)..(237): a, c, t, g, unknown or other
  misc_feature (237)..(237): n is a, c, g, or t
tcagtcgtcgctcgcacgaccggtgctcgatttagcatactctacagggggacgtggtgggctcaggaggcagaggctctgggaatctcaccagtggcctggacccctctccctcgcctccccctcctcactttcngcacagtctctgacggcctcctatgagctgacacacgcccacccgtcggtgtcacgtcgtccccgaggaacaaacggccaggactcacctgctcgtggagnttcattcgaaccaaaagatatacgttgttacgttccaagacaagaacgtcgacggccacggccccttggtactggtacagtaccagtacgacgccaggtcgacgaccacgtccgggactcccgtagaacgagtacttctcgtcgtcctcacgcgtacgacggactacggtacggccctaacgtcgactacgtacgtacggtcgggaccgtagggtacggaacgtagtaggaacgcgtacgtacttacgtagttacggtacgacctaacgaacgtaacgtaaggttacggtacgtagtacgtcgggtagggttacggttacgggacgggtaacgggtaccgtagggttaccggacccggttcgttaggacccgtaacggtccccggaaaggttcccgtcccgggtacccccgttagggtaccctaccgttccccgttaccccg

SEQ ID NO: 88629 - DNA, 622 bp, Homo sapiens
  misc_feature: GYAE6OF01CEMSK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccacggcccctgtactggtcatccatgaggccacgtacgacgacacgtccgggactcccgtgacgagtacttctctcgccctcagtctacgagggacaggtcggacctacttgacttatcgaggtcggggaccgagggtcggacgtagtaggaagtcgtagtaacttacgttagttcgttaccgaccaaccgaagtacgtaaggttaggttcggtacgtacgttacgggtagggggttacgtacggggacggtaacgggtaccgtaagggttacgtacccggttccgttagggccgtaccggacccggtaaggtcccgtccggtacccccgtacggtcctaccgttccgttccccgg

SEQ ID NO: 88630 - DNA, 767 bp, Homo sapiens
  misc_feature: GYAE6OF01BVPFS.21.8.A08.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaacgtggtggagtcgtggggggaggcagtggtccagccgtggggaggtccctgacgcctctcctgtgcaggcgtctggattcagtatcggctcctttgcatgcacgtgggtccncaggcctccgaggcgaacgggggtctaggggaggtggggtcgggtacgtaagtttacgtcgtagggttaatggtaagtaggggaaagtaggaaggaaggtatttaagtttacgtttacgaaacggttaccgtacccgggttagggaaacggggtacccgtagtttaccgaacccgtactacccgttaccgaaacggtaacgaaacctaaagttaccggaaccctaaaaccgaaacctaaccgtaaccttacggttaaacttacccgtttaacgtaaaaccgttaccgggaaccccggtaccgttaacgggaacggaaccggacccgggaaacgggaccgaccgggtaacttacgttacggtttaacgtttacggttacggtaacggtacggttaccggttttaggtaccggttacggtttcgggggaacccgtaacgggggttaaccccgttcgggttaaccccgg

SEQ ID NO: 88631 - DNA, 694 bp, Homo sapiens
  misc_feature: GYAE6OF01DQOP5.21.8.A08.1.454.CMB.1.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
tcagtcgtcgctcgcacgaccggtgctcgatttagcatactctacagggggctgtgggctcaggaggcagagctctgggaatctcaccatggcctggacacctctcctgcctccccctcctcactttctgcacagtctctgaggcctcctatgagctgacacacgcccaccctcggtctcagtcgtccccggacaaacggccaggatcactgctctgganatgcattgaacctaaaaaatttnttgttttttaggaccagacaagaatcgacggccacggtccctgtcgtgtcactcatgaggacaggacgaccgacccgtaccgggactcccgtagacgtagtacttctcgtcggtcctaccgaacgtcggaacggggtacggtcggaccttaggttacgtactttcgacggtagggtccggggtacccgtaggggtacggaggtagtacgaaggtctaacgtaccgttaacttacgtacgttactacgaagtaccaacggaacaggactaagggtcgttaccgaagttccgggaaggggtacctagggttaccgggacggtaacggggtacctaggggttaccgacccgttaccggtacggtaccaacccggtacccggaacgggtcccgtacccgggtaccccccggttaggtaccctacccggttccgttcccccggtttacccccccgg

SEQ ID NO: 88632 - DNA, 610 bp, Homo sapiens
  misc_feature: GYAE6OF01CEWP9.21.8.A08.1.454.CMB.1.raw
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactggtcatccatgacggccagtcgacacacgtccgggatcccgtgagagtattcnctcgcctccagctcgaggacngtcggcctacttgactagtcgaggtcgggccctagggtcgggacgagtaggaacgtccgtagaaccttaacgttagtttacgtaccgacaaccgagtacgaggttagtggtacgtagtacgggtaggggttacgtcgggacgggtaacgggaccgtaaagggttcggaacccggttccgttacgggtacgacggtaccccgaagggtccctccggaccccccgttacgggtccctaccgttcccgttccccgg

SEQ ID NO: 88633 - DNA, 669 bp, Homo sapiens
  misc_feature: GYAE6OF01BMHVQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctcgtggagtattcattgaccaaaagatatacttgttgttccagcagaagtcaggccacggcccctgtactggtcatccatgacgccagtcgacgacaccgtccgggatcccgtagagagtacttctcgtcgtccctaccgagtccgtacgaaggggacctacgggtccggaccctaaccgtttggaaccttacgtaccgtacgggttccgggggacccgtagggttacgggaacgtaagtacggaacgtcgtacgtaaccttacgttaacgtttcgttaaccgaccgtaacgaacggtactaaggttacggtaggtaccgtaagttcgggtaagggggttacgttacggggacgggtaacgggtaaccgtaaggttacggtaccggttcgttacggaccgtacgacccgtaacggtcccgtaccgcccccgtaggtcctaccgttccgttaccccg

SEQ ID NO: 88634 - DNA, 673 bp, Homo sapiens
  misc_feature: GYAE6OF01DQ88E.21.8.A08.1.454.CMB.1.raw
  modified_base (175)..(175): a, c, t, g, unknown or other
  misc_feature (175)..(175): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtntcagtcgtccccaggacaaacggccaggatcacctgctctggatattcattcgaccaaaagatatacttgttggttccagcagaagtcaggccacggcccctgtactggtcatccagtgacggccaggtccgaacgacaccgtccgggactcccgtagagtagtactttccgtctcgccctccgagtcctacgagggacacggtcggaccctacgtttagaaccttacgtacggtagggtccgggggtaccccgtaggggttacgggaaccggtagttacggaaacgtccgttaggtaaccttaacgttaacgtttacggttaacccgcaaccgtagtaacgtaggtaggtcggtacgtagtacgggtaagggggttacttcggggacgggtaacgggaaccgttaggttaccggtaccggttccggtttgggaccgtacggaccccgtaagggtcccctacccggtccccttcgggtacctcccgttccgttccccg

SEQ ID NO: 88635 - DNA, 681 bp, Homo sapiens
  misc_feature: GYAE6OF01DHH3Z.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccgaggacaaacggccaggactcacctgctctggatattcattcgaccaaaagtatatacttgttggttccagcaagaacgtcacggccacggcccctagtacgtggtcactccagtcgacggccaggtcgaccgaacgaccgtaccgggactccctagacgtagtacttctcgtcgtcccctccgacgtctacggaacgggactacgggtccggacccttaaccgtttgaaccttacgtccggtaacgggttccggggacccgtaggggtaccggaacggtagtacggaaacgtccgtaggtaacttaacgttagtttacggtaaccgactaacgaggtacgtaaggttacggtcggttactaaggttacgggtaagggggttacgtcggggaacgggaacggtacgtagggttaccgaccggtttccgtacggtcgaaccggacccgacggtcccgttccgacccccggttcgtacctccgtccgttccccgg

SEQ ID NO: 88636 - DNA, 689 bp, Homo sapiens
  misc_feature: GYAE6OF01DZN60.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccaccctcggtgtcagtcgtccccaggaccaaacggccaggactcacctgctcgtggatattcattcgaaccaaaaagtatattacttggtttcggttaccagacaagtaacgtcgacggccacggcccctgtactggtcatccagtggacgccagtcgacgacaccgtccgggactcccgtagacgagtacttctcgtcgccctaccgagcctacggacggacaggtcggaccctacgttgacttacgtacgtacggtcgggaccgtagggtacggaacgtagtacggaacgtccgttagtaaccttacgttacgtttacggtaaccgacctaacgacgaacgtaggttaacggtcggtaacgtacggttacgggtaaggggttacgtacggggacgggtaacgggtaaccgtaacggtttaccggtacccggtttccgttacgggtaccgtacgggaccccgtaaacgggtcccgttacccggtacccccgttaccggttaccctaccgttcccgttaccccg

SEQ ID NO: 88637 - DNA, 769 bp, Homo sapiens
  misc_feature: GYAE6OF01C027N.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacagcccacccgtcggtgtcagtcgtccccaggaaccaaaccggccaggatccacctgctcgtggagattcattcgaccaaaagaatattacttgttgttccagcaagaagtcaggccacggcccctgtactggtcatccatcggagccagtcgacgacacgtcggatccctgagagattctctcgccctcagctcgaggactaggtcggccctacttgaactgtacgtagggtcggggacccgtagggtacgggaacgagtacggaaacgtccgttagtaaccgttaacgtttaacgtttacggtttaacccgaccgtaacccgtaaacggtaacggtaaacggtttaacgggttacgggttaaccgtaacggttaccggggttaacgggggggtttaacggttttccgggggaaaccgggggtaacgggggtaaaaccccgttaaacggggtttacccggtaacccccgggttttcgggttttaaccggggtaccggtaaaccccgggtacccccgggtaaaacggggttccccgttacccccggggttacccccccggttacccggggtttacccgaaccccgtttccccgggttttaaccccccgg

SEQ ID NO: 88638 - DNA, 684 bp, Homo sapiens
  misc_feature: GYAE6OF01BLVZX.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggaaccaaacggccaggactcacctgctcgtggagtattcattgaccaaaagatatacttgttggttccagcagaagtcaaggccacggcccctgtacgtggtcatccagtgacggccagtccgacgacacgtccgggactcccgtgacgagtattccgtctcgccctcagtcctacgacgggacaggtcgacctaccttgacttacgtcgtacggtcgggaccgtagggtacggacgaagtacggaacgtcgtacgtaaccttaacgttacgttttacggtaaccgacctaaccgtaagtaactaagggttacggttcggtaacgtaaggtccgggttaagggggttacgttaccggggacggggtaacgggtaaccgtaagggtttccggtaacccggttccggttacgggtacggacccgtacccggtaaacgggtccccgtacccggtccccccgttagggtccccttaccgtttccccgttcccccgg

SEQ ID NO: 88639 - DNA, 540 bp, Homo sapiens
  misc_feature: GYAE6OF01E00UK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgtggttccagcagaagtcaggccaggcccctgtactggtcatccatgaggccagtcgacgacactccgggatccctgagagattctctcgccctccagtctcagggacagtggccaccgttgactatcgagtcgggccaggtggacgatgaagcagactactatgttacgctaccagacgagtagtggtacagtcgagggggtacttcgggcggtacgggaccgtaaggttcgtacccggtcgttgggtacgtacgcccgtaaggccttcgccccccgtggtccctacgtccgttcccg

SEQ ID NO: 88640 - DNA, 644 bp, Homo sapiens
  misc_feature: GYAE6OF01CN2A6.21.8.A08.1.454.CMB.1.raw
  modified_base (428)..(428): a, c, t, g, unknown or other
  misc_feature (428)..(428): n is a, c, g, or t
  modified_base (629)..(629): a, c, t, g, unknown or other
  misc_feature (629)..(629): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgacggcctcctatgagctgacacacgcccacccgtcggtgtcagtcgtaccccgaggaaccaaacggccaggactccacctgctcgtggagattcattacgaaccaaaagtattattacgttgttacggttaccagcaagaagtcgacggccacggccctagtactggtcatccagtcgacgcagtacgacacgacgtccggactcccgtagagacgtacttcgtctcgccctccgagtcctacggaagggtacctaggtccggtacccctacgttacgacgttaanccggtaacgggtcggggacccgtaagggtcggaaccgtaagtacggaacgtcgtacgtaaccgttagttacgttacgttaccgactaaccgagtaacgtagtaggtcgtacgtagtacgggtagggtacgtgggacggtagaccgtaggtcgaccgttcgtagaccacggcccgaaggtccctcccggcccgtacggtccncgttccgttaccccg

SEQ ID NO: 88641 - DNA, 536 bp, Homo sapiens
  misc_feature: GYAE6OF01BHIZZ.21.8.A08.1.454.CMB.1.raw
  modified_base (337)..(337): a, c, t, g, unknown or other
  misc_feature (337)..(337): n is a, c, g, or t
  modified_base (526)..(526): a, c, t, g, unknown or other
  misc_feature (526)..(526): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagattcattgaccaaaagaatatacttgttgttccagcagaagtcaggccaggccccctgtacctggtcatccatgaggccagtccgacgacactcccgggatcccgtgagagtattcnctgcctccgagcctacgagggacaggtcggcccaccgtttgaccttatcgaggtcgggcccagggtcggacgtagtgaagctagactacttagttgtacgcaccagacagtagtggtcaagtcgtaagggggtattcgggcggaggacctaggtcgaccgtcttggcacgccgaagcgtcgcccctgcnccgtcgtccg

SEQ ID NO: 88642 - DNA, 697 bp, Homo sapiens
  misc_feature: GYAE6OF01ASYA0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttgttccagcagaagtcgaggccaggcccctgtactgtcatcatgagcagtcgacgacacgtccgggatccctggagagtacttcgtctcggcccttccgacgtccgtcgaacggggaccacggtcgggacccctaaccttggtaacctacgtccgtaagggtccgggggaccccgtaaggggttcgggaacccggtagtacggtaaacgtccgtagtaaccgttaacgttacgtttacggttaaccgacctaaccgaaggtactaaggtaggttcggtactacggttacgggaagggggttacgttcggggaacgggtacgggtaccggtaaggttccggtaacccggttcccggttacgggttaccgaaccggtaccccggtaaagggtcccgttacccggtcccccccggttacgggtacccgttaacccgttccgtttaccccccgg

SEQ ID NO: 88643 - DNA, 516 bp, Homo sapiens
  misc_feature: GYAE6OF01EZPGN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgagccagtcgacgacactccgggatccctgagagattctctgccctccagcctcgagggacaggtcggcctacttgactatcgagtcggggcccaggtggacgatgaagcgtgactactattgttacgcaccagacagtagtggtcagtcgaggggtagtcggcggaggaccagtcgaccgtccgttaggcgacgccgaaggcctcgcccctgcctcgtcgtccg

SEQ ID NO: 88644 - DNA, 640 bp, Homo sapiens
  misc_feature: GYAE6OF01CG3TJ.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtntcagtgtccccaggacaaacggccaggatcacctgctctggagattcattgaccaaaagatatacttgttgttccagcagaagtcaggccaggcccctgtactggtcatccatgaggccagtcgacgacacgtccgggatccctgagagacttctctcgccctccagcctacgagggaccaggtcggccctaaccgttgaaccttatcgaggttaccggggccccgtaagggttcgggaaccgtagttacggaaacggcgttagaaccttaacgttaagttcgttaaccggcaaccgagaacgtagtaggttggtacctagttacggtaagggggttacgttcggggacgggtaacgggacctaaagggttccggtacccggttccgtttagggtccgtacggaccccgaacgggtcccgtccggtacccccccgtcgggttccctaccgttcccgttccccgg

SEQ ID NO: 88645 - DNA, 694 bp, Homo sapiens
  misc_feature: GYAE6OF01DQQ6L.21.8.A08.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggagattcattgaccaaaagatatacttgttggttccagcagaagtcaggccaggcccctagtactggtcactcatgaggccagtcgacgacacgtccggactccctggagngactttctctcgccctcagtctcgacggacagtcggaccctacgttcgacttactcgtagggtccggggacccgtagggtacgggaacgtagtaggaacgtccttaggaaccttaacgtttacgtttacggtttacccgaccgtaacccgaaggtaaccgtaaggttaacgggttcggtaaccgtcgttacgggttaagggggttacggtttccggggaacggggtaacggggtaaccgtaaacgggtttccggaacccggttttcccggttgggtaccctaacgggtacccccgtaacgggtcccgttaccccgggccccccggtttaccgggtacccgttacccggttcccgttcccccggg

SEQ ID NO: 88646 - DNA, 629 bp, Homo sapiens
  misc_feature: GYAE6OF01CWXDW.21.8.A08.1.454.CMB.1.raw
  modified_base (220)..(220): a, c, t, g, unknown or other
  misc_feature (220)..(220): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (397)..(397): a, c, t, g, unknown or other
  misc_feature (397)..(397): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccaccctcggtgtcagtcgtccccaggacaaacggccaggatcacctgctctgganattcatgacaaaagatatacttgtgtcagcagaagcaggccaggtccctgtactggtcatccatgagccagtcgagacacgtccggatcccgngagagtatctctcgcctcagctcgaggacagtcggacctacttgactancgaggtgggcccagggtacggacgataggaacgtntacgaacgttactagtttacgtaccgactaacgaacgaacgtaaggtaggttacggtacctaagtcgggtaaggggggttaacgttcggggacgggtaacggggaacctaaacgggttccggaacccggtttccggttacgggtacccgtaaccggtaccccgtaaacgggtccccgttaccggcccccccggttaccgggttacccaaccgtttccccggtttacccccgg

SEQ ID NO: 88647 - DNA, 541 bp, Homo sapiens
  misc_feature: GYAE6OF01BR8QT.21.8.A08.1.454.CMB.1.raw
  modified_base (505)..(505): a, c, t, g, unknown or other
  misc_feature (505)..(505): n is a, c, g, or t
  modified_base (529)..(529): a, c, t, g, unknown or other
  misc_feature (529)..(529): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgacacagcccaccctcggtgtcagtcgtccccaggaccaaacggccaggatcacctgctctggagattcattcgaccaaaagaatatacttgttgttccagcagaagtcaggccaggcccctgactggtcatccatgaggccagtccgacgacacgtccgggactcccgtgagagtattctctcgccctccagctacgagggacaggtcggcctaccgttgacttatcgaggtcgggccgagggtggacgagtagaagctacgacttacgtatttacgtacgcaccagacgtagtagtggtcgagtacgtaggggtagtcgggcgagggactagtcgaccgtctggcncgaccgaggctccgcccctggtcnccgtcgtacccg

SEQ ID NO: 88648 - DNA, 555 bp, Homo sapiens
  misc_feature: GYAE6OF01DF6BD.21.8.A08.1.454.CMB.1.raw
  modified_base (170)..(170): a, c, t, g, unknown or other
  misc_feature (170)..(170): n is a, c, g, or t
tcagtcgtcgctcgcacgaccggtgctcgatttagcatactctacagggggggagaggagcccagcactagaagtcggcggtgtttctattcggtgatcagcactgaacacagaggactcaccatggagtttgggctgagcttgggttttcctccttgcttcttttaagnggtgtccagtgtcaggcgcaactgggtggagtcgtgggggagcatggtccaggccgtggggacggtccctggacgccctctcctgtcgcagcgtctggattcagtatcggcttccttgccatgcacgtcggggtccgccagggcctccgaggcgaaggggctggagtggggtggcgattatcgtggtatgagtggaagtgagagtatattatcagactccggtagaacgggtccattcacctatcctacagaagacaatcgaccaaacaacactactgtatctacaatcgaccgctagacgagaccgaggacacggctagtgtattacgtgtacgtgttctttggtactagggttacgggacccgacgggtacccgtggtacccg

SEQ ID NO: 88649 - DNA, 641 bp, Homo sapiens
  misc_feature: GYAE6OF01DCEY9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaaccaaacggccaggactccacctgctcgtggagattcattgaccaaaagatatacttgttggttccagcagaagtcaggccaggcccctgtactggtcatccatggacgccagtcgacgacacgtccgggatcccgtagagagtacttctctcgccctccagtcctcgagggacaggtcgccctaccgttgaaccttagtcgtacgggtcggggacccgtagggtacgggacgtagtaggaacgtcgtacgtaaccttacgttagttacgttaccgaccaaccgtaacgacgtaaggttaggttcggtacgtagtacgggtagggggttacgttcggggacggggtaacgggtaaccgtaacggttcggacccggtttccgtgggtaccacggaccccgaaggtcccgtccggtacccccgtcggtccctaccgttcccgttccccgg

SEQ ID NO: 88650 - DNA, 584 bp, Homo sapiens
  misc_feature: GYAE6OF01DF0XR.21.8.A08.1.454.CMB.1.raw
  modified_base (219)..(219): a, c, t, g, unknown or other
  misc_feature (219)..(219): n is a, c, g, or t
  modified_base (329)..(329): a, c, t, g, unknown or other
  misc_feature (329)..(329): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagnttcattgaccaaaagaatatacttgttggttccagcagaagtcaggccaggcccctgtactggtcatccatgaggccagtcgacacactccgggatccctgagagattcncgtgcctcagctcaggacagtggcctacttgactagtcagtcggggcccagggtggaccgatggaagctagacttactattagttacgctaaccgagacgagtaagtggtacctagtccgagggggttattccgggacgggtacgggtaacgaaacggtttcggaaccggttaccgtttcgggtaccgtacggtaccccgaagggtccgttccggacccccccttggggttacccacccgtttcgttacccccgg

SEQ ID NO: 88651 - DNA, 888 bp, Homo sapiens
  misc_feature: GYAE6OF01A8MAA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtcggtgtcagtcgtccccaggacaaacggccaggatcacctgctcgtggagtattcattcgaccaaaagtatatacttgttggttccagcagaagtcgaggccaggcccctgtactggtacatcctatgacgccagtcgacgaccacgtccgggactcccgtaggagtacgtacttcctcgtcggtcccttaccgaacgtcccgttacggaacggggtacctaacgggttcccggggtaccccttaacccggtttacggaaccgtttaaccgtaccggtaaccggggttacccggggggtacccccgtaacgggggttacgggtaaaccccgggtaacggttacgggtaaaacgggtcccggttaacggtaaaccccgtttaaacgtttaaacgttttccgggtttaaaccccgacccggtaaacccgtaaccgggtaaaccgtaacgggtttaacgggttacgggttaaccgttaacgggttaaccggggttaacggggggtttaaccgtttacccggggggtaaccggggtaaaccgggggtaaacccggtttaaacggggtttaaccgggtaaccccgggtttacccggttttaccggggtacccggttaaaccgggtaccccccggaaaccggggttccccgttaccccgggtccccccccggtttaacggggtttaccccttaacccggtttccccgggtttaccccccggg

SEQ ID NO: 88652 - DNA, 579 bp, Homo sapiens
  misc_feature: GYAE6OF01BMSQL.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcaggccaggcccctgtactggtcatccatgagccagtcgacgacacgtccgggatcccgtagacgagtacttctcgtcgccctccgagtcctcgaagggactaggtcggcctaccgttgactatcgaggtcgggcccgagggtcgacgtagtgaagtcgtagactactattacgtacgcacgagacgtagtagtggtactagtacggtaggggttactcgggacggacggtaccgtaaggttcgaccgttcgttgggacgacggacccgtaagggtccctccggtcccccgtaggtccctaccgttccgttccccgg

SEQ ID NO: 88653 - DNA, 669 bp, Homo sapiens
  misc_feature: GYAE6OF01D59C0.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganattcattgaccaaaagatatacttgttcgttccagcagagtcaggccacggcccctgtactggtcatccagtggacggccaggtccgaacgacacgtccgggactcccgtggaagtagtacttctacgtcgccctccgagtcctacgaagggactaggtcggaccctaccgtttgaaccgttactcgacggtcggggacccgtagggtacgggacgtagtacggaacgtccgtagtacgttacttacgtttacgttacgactaccgaagaacgtaggtacgttggtacgtagtacgggtaaggggttacggttacgggacgggtacgggtaacccgtaaggttaccggtacccggttccgttagggaccgtaaccggaccccggtaacggtccccgtaccccggtaccccccgttacgggtccccgttccgtcccgtttacccccgg

SEQ ID NO: 88654 - DNA, 672 bp, Homo sapiens
  misc_feature: GYAE6OF01B1Y1T.21.8.A08.1.454.CMB.1.raw
tcagtcgtcgctcgcacgaccggtgctcgatttagcatactctacggggggctgtgggctcaggaggcagagctctgggaatctcaccatggcctggacccctctcctgcctccccctcctcactttctgcacagtctctgacggcctcctatgagctgacacagccaccctggtgtcagtcgtcccagacaaacggcagactcactgctctggagattcattcgaccaaaagattatacttgttcggtacagcagaagtcaggccacggccctgtactggtacatcagtgacgccagtcgacgacacgtccgggactcccgtagacgacgtattctctcgccctcgacgctacgaggactaggtcggaccctacgttcgactacgtcgtaggtccggggacccgtagggtacgggaacgtagtacggaaggtcgtacgtaaccgttacgttagtttacgttaaccgaccaaccgtaacgtaactaaggttacggttacggtacgtacggttacgggtaacgggggttacgttcggggaacgggtaacgggtaacccgtaagggttccggtacccgggttccgttacgggtaccgtaccggacccggtaacggtcccgtaccccggtccccgttaccgggtaccctacccgttccgtcccggtttccccccg

SEQ ID NO: 88655 - DNA, 706 bp, Homo sapiens
  misc_feature: GYAE6OF01EPHDM.21.8.A08.1.454.CMB.1.raw
  modified_base (138)..(138): a, c, t, g, unknown or other
  misc_feature (138)..(138): n is a, c, g, or t
tcagtcgtcgctcgcacgaccggtgctcgatttagcatactctacagggggctgtgggctcaggaggcagagctactgggaactcgtcaccatggcctggacccctctccctgcctccccctctcactttctgctacngtctctgaggcctcctatggagctgacacagccaccctcggtgtcagtcgtccccagggaccaaacggccgaggatccaccgtggcctcgtggagtcttcattcgacctaaaagtatatacgttgttcggttcagcaagaagtcaggccacggccccgtgtactggtacacgtccagtagacggccagtcgacgactacgtaccggatcccgtgagtacgtacttactactacgtccctaccagtctacgtagggactaggtccgaccctacttcgacttacgaccgtaggtccgggaccctagggtacggaacgtagtacggaacgctacgtacttacgtttaagttcgtaccgacctaaccgagtacgtaaggtacggttacggtaccgtaaggttcccggttaagggggttacgtttacggggacggtaacgggggtaccgtaaagggttaccggtacccgggtttacccggtttagggtaaccctacgggaccccccgtaagggtccccgttacccggtaccccccggttacgggtacccctaccggtttcccgttacccccgg

SEQ ID NO: 88656 - DNA, 594 bp, Homo sapiens
  misc_feature: GYAE6OF01DT8CW.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctgganattcattgaccaaaagatatacttgttgtccagcagagtcaggccaggcccctgtactggtcatccatgacggccagtcgacgacacgtccgggatcccgtgacgagtacttctctcgccctccgagcctacgagggacagtcggcctacttgactatcgaggtcgggcccagggtcggacgtagtaggaacgtcgtagtacttaacgttagtttcgttaaccgcaaccgagacgtaggtaggtcggtacgtagtcggtaggggtacgttcgggacgggtacggtaccgtaaggttacggacccggttccgttgggtaccgacggacccgtaagggccgtcccggcccccgttggtccctccgtccgttccccg

SEQ ID NO: 88657 - DNA, 716 bp, Homo sapiens
  misc_feature: GYAE6OF01ENVPR.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtcccaggaaccaaacggccaggactcacctgctcgtggatattcatcgaaccaaaaagattatacgtttggttcggttaccagacaagaacgtcgacggccgacggccccttgtaccgtggtcatccagtcggacgccaggtaccgaaccgacctaccgtccgggtactcccgtagaacgagtacttctcgtcgaccctcgagtccgtacggacgggtactacggtccggtaccctaacgtttcgaaccgttgtaccggtaacgggtccgggggaccgtaggggtacggaaccgtagtaacggaacgtccgtacgtaacttaacgttagtttacggttaacgccgtaacgagaaccgtaggttaacggtgtaacgtacggttacgggtaacgggggttacgtaccggggaacgggtaccgggaacggttacggttaccggttacccggttccggttacgggtaccgaccggtacccgacggtcccggttacccggcccccgttacggtcccttaccgttcccgttcccccg

SEQ ID NO: 88658 - DNA, 599 bp, Homo sapiens
  misc_feature: GYAE6OF01BUPNK.21.8.A08.1.454.CMB.1.raw
  modified_base (308)..(308): a, c, t, g, unknown or other
  misc_feature (308)..(308): n is a, c, g, or t
  modified_base (445)..(445): a, c, t, g, unknown or other
  misc_feature (445)..(445): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagtcagaagtcaggccaggcccctgtactggtcatccatgaggccagtcgacgacncgtccgggatcccgtgagagtattctctcgccctccgagcctacgacgggactaggtcggccctaccgttgaccttatcgaggtcggggccccagggtcggacgagtaggaagctacgtacttactatttcgttacncaaccgagacaggttaagtcggtacgagtcggaagggggttacgttcgggacgggacgggtaccgtaaggttcggacccggtttccgttagggtaccgacggccccgaaggtcccgtccggccccccgttacggcctcccgttcgttccccggg

SEQ ID NO: 88659 - DNA, 697 bp, Homo sapiens
  misc_feature: GYAE6OF01C52R2.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctctgganattcattgaccaaaagatatacttgttgtccagcagatcaggccacggccctgtactggtcatccatgagccagtcgacgacaccgtccgggatcccgtgacgagtacttctctcgccctccagtcctcgagggactacggtcggccctaccgttagaacttcgtacgtagggtccgggaccccgtagggtacggaaccggtaagtacggaaacgtcgttacgtaaccttaacgttagtttacggttaacccgtaccgtaaccgaacgtaaccgtaaggttaaggttacggtacctaggttaccgggtaagggggtttaccgttaccggggacggggtaaccggggtaaccgtaaacgggttccggtaacccggtttcccggttacgggtaccgtaaccggaccccggtaacgggtccccgttaccccgggtacccccgttaccgggtacccctaccggttcccgtttaccccccggg

SEQ ID NO: 88660 - DNA, 611 bp, Homo sapiens
  misc_feature: GYAE6OF01D5MNS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctcggtgtcagtcgtccccaggacagacggccaggatcacctgctctgcagatggactgaccaaaagaaatatgtacttagttacggtaaccaacaaggaaacgaccgacggacccgaacggtcccctaggttagttagtagaataataataaagacacgtagacgacgccctagagacgactcccgagacgcgtattctcgtggcctaccgagctacgagggacagcgtacgtactacgttgactacgtcgaagtgaacgtcgaggcaagggacggacgaggctagaacttattacgagtaacaaagtagtaacgacgtaaggtacgtaacggttactacgtaggtttcgggtacggttcgggacgggtaacgggaccgtaaggtccgtacggtaacccgtacgtacggaccgaacggacccgagggtcccgtaccccgg

SEQ ID NO: 88661 - DNA, 598 bp, Homo sapiens
  misc_feature: GYAE6OF01EB8R8.21.8.A08.1.454.CMB.1.raw
  modified_base (221)..(221): a, c, t, g, unknown or other
  misc_feature (221)..(221): n is a, c, g, or t
  modified_base (358)..(358): a, c, t, g, unknown or other
  misc_feature (358)..(358): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatggacggccagtcgacgacactccgggatcccctggagagattctctcgccctcagctacgaggacnggtcgccaccttgactatcgaggtcgggcccgtagggtcggacgagtagaaggtcgtacgtaacttaacttagtttagtaccgacaccgagaactaggttagtcggtactagtacgggtaggggttacgttcgggacgggtaacgggaccgtaaggttcgtaccggttccgttgggaccgacggacccgaaggtcccgttacccggtaccccccgtcggtcctaccgttccgttaccccg

SEQ ID NO: 88662 - DNA, 671 bp, Homo sapiens
  misc_feature: GYAE6OF01DG2CM.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggaacaaacggccaggatcacctgctctgganattcattgaccaaaagatatacttgttgttccagcagagtcaggccacggcccctgtacgtggtcatccagtgacggccagtcgacgacaccgtccgggactcccgagagtacgtatttcctcgtcgtccctcccaggacctcgaacgggacaggtcggaccctaccgtttgaacttactacgtacgggtcggggaccccgtagggtacggacggtagtacggaacgtcgtagtaacttaacgttacgtttacgttaaccgaccgaacctagtacgtaaggttaggtcggtactaacggttcgggtaaggggttacgttcggggacgggtaacgggtacccgtaagggttaccggacccggtttcggttacgggtaccgacggtacccccggtaagggtcccgtacccggtaccccccgttggttaccctccgttccgtttccccccg

SEQ ID NO: 88663 - DNA, 652 bp, Homo sapiens
  misc_feature: GYAE6OF01ETAFH.21.8.A08.1.454.CMB.1.raw
tcagtcgtcgctcgcacgaccggtgctcgattttagcatactctacagggggtcgtgtgggctccaggaggcagagctctgggaatctcaccgatggcctggacccctctcctgcctccccctcctcactttctgcacagtctctgaggcctcctatgagctgacacacgccaccctcggtgtcagtgtccccaggaccaaacggccaggatcacctgctctacggagtattcattcgaccaaaagaatatacttgttggttccagcaagaagttacaggaccacggcccctgtactggtcatccatgaggccagtcgacgacacgtccgggactcccgtaggagtagtacttcgtctcgcccttccgacgctacggagggactacggtcggaccctacgttgacttatcgtagggtccgggacctagggtacgacgtagacggaacgtacgtagtaacttactagtttcgttaccgctaaccgtagtactagttaacggtacggtactaggttacggtagggggttactaccggggacggtaacgggtaccttaacgggttcggtaacccggttccgtttagggaccgaacggtaccccgaaggaccgttccggacccccggttacggtacctcccgttccgttaccccgg

SEQ ID NO: 88664 - DNA, 562 bp, Homo sapiens
  misc_feature: GYAE6OF01B624T.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacactccgggatccctgagagtattctctgccctccagctcgagggacaggtcggcccacgttgactatcgaggtcgggcccgaggtggacgagtggaagctgtacttactagttgtacgcaccagacagtagtggtctagtcggtaggggttagtcgggacgggagggaccgtaaggttcggtacccggttccgttggaccgacggacccgaagggccgtccggcccccgttacggtccctaccgttccgttaccccg

SEQ ID NO: 88665 - DNA, 723 bp, Homo sapiens
  misc_feature: GYAE6OF01DQSV6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctcgtggagtattcattgaccaaaagatattacttgttcgtccagcaagagtcaggccaggcccctgtactggtcatccagtgacggccaggtcgacgaccacgtccgggactcccgtaggacgtagtactttctccgtcgcccctccgagtcctacggacgggaactacggtcggaccctacgtttgaacttcgtacgacgggtcggggaccctagggtacggacgtagtaggtaacgcgtacgtacttacgttagttcgttaaccgacaaccgtaagaacgtaggttaaggttcggtaccgtaaggttccgggtaacgggggttacgttaccggggaccggggtaaacgggtaaccggttaaacgggtttaccgggtaacccggtttcccgggttagggttacccggaaccgggtaacccccggttaaaggggccccctttccccggggtaccccccccggtttacggggttacccccttaacccgtttcccccggtttaccccccggg

SEQ ID NO: 88666 - DNA, 691 bp, Homo sapiens
  misc_feature: GYAE6OF01CREI7.21.8.A08.1.454.CMB.1.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccaccctggtgtcagtcgtcccaggaccaaacggcaggatcactgctcngganatcatgacaaagatatacttgtgtcagcagaagtcaggccacggccctgtactggtcatcagtcgacgcagtcgacacacgtccgggactccgtaggacgtacgtattccgtctcgccctaccgagtcctacggaggggtaactaggtccggaccctaccgtttacggaaccttacgtaccgtacgggtacggggaccccgtaaggggtacggaacggtagtacgggaacgtcgtaacgtaacttacgttacgttacggtaccgacctaaccgtaacggaacgtaaggtaacggtacgggtacgtacggttaaccgggtaggggggttacgttccggggtaaccgggaacggggtaaccgtaacgggttaccggtaccccgggttccgttaggggtaccgaaccgggtaccccgaaagggtcccgttacccgggtacccccctacgggttccctaccgtttcccgttcccccgg

SEQ ID NO: 88667 - DNA, 780 bp, Homo sapiens
  misc_feature: GYAE6OF01BUGEA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggactccacctgctcgtggagattcattgaccaaagatatacttgttgttccagcagaagtcgaggccacggcccctgtactggtcactccatggacggccaggtccgacgaccaccgtccgggactcccgtagacgagtactttcgtctcgccctccgagtcctacggaaggactaggtcgggacccctaccgtttacgaaccttagtccgtaacgggttccgggggaccccgtaggggtacgggaacgtaagtacggaaacgtccgttacgtaaccgtttaacgtttacgttttacggtttaacccgaccgtaacccgtaacggtaaccgtaagggtttaacgggttacgggttaccgtaacgggtttaccgggtaacggggggggtttacgttacccggggggtacggggtaaaccgggggtaacccgttaaacggggtttccggtaacccccgggtttccggtttacggggttaacccgacccgggtaccccggtaaaccgggtccccgttaccccgggtcccccccgttaccgggttaccccttacccgtttccccggtttaccccccggg

SEQ ID NO: 88668 - DNA, 663 bp, Homo sapiens
  misc_feature: GYAE6OF01DZYB2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctctcactttctgcacagtctctgaggcctcctatgagctgacacagccaccgtcggtgtcagtcgtcccgaggacaaacggccaggatcacctgctcgtggatattcattcgaaccaaaaagatatacttgttcggttaccagcaagaacgtcgacggccacggcccctgtactggtcactccagtggacggccaggtcgacgactaccgtccgggatcccgtaggagagtacttctctcgccctcgacgctacgacgggactaggtcggaccctaccgttgaaccttagtcgacgggtccggggacccgtagggtacggaacgtagtacggaacgtctacgtaacgttacgttaagtttcgtaacgcaacgagaacgtaggttagtcggtacgtagttacgggtaacgggggttacgtacggggacgggtaacgggtaacgtacggtttccgggacccgtttaccggttgggaccgtaccggtaacccggtaacggtcccgttacccggtacccccgttaggttccctccgttcccgttaccccgg

SEQ ID NO: 88669 - DNA, 818 bp, Homo sapiens
  misc_feature: GYAE6OF01D02UM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggaccaaacggccaggactcacctgctcgtggagtattcattacgaaccaaaagtaattattacttggtttcggtccagcagaagtcaggccacggcccctgtactggtcatccagtcggacggcctaggtacgaccgaccgtaccgtaccgggacttcccgtagacgtacgtactttccgtactcggtccctacccgagtcccgtacggaacgggtacctagggtccgggaccctaccgtttagaaccgtttacgtaccggacggggttaccgggggaccccgtaaggggtacgggtaaaccggtaggtaacggtaaacggtccgttaacggtaaccgtttaacgttacggtttttaccggtaacccggtaaccctaaaccggtaacgaacccggttaaagggttaacgggttacggggttaacctaacgggtttaccggggttaacgggggggtttacgtttacccgggggaacggggtaaccggggttaaccgtaaacggggtttaccgtacccccggggttttcggttaccgggtaacccgtaccgggacccgtaacgggtcccgttaccccgggtaccccccgttacgggttaccctacccgtttcccggtttaccccccgg

SEQ ID NO: 88670 - DNA, 671 bp, Homo sapiens
  misc_feature: GYAE6OF01BYYX4.21.8.A08.1.454.CMB.1.raw
  modified_base (353)..(353): a, c, t, g, unknown or other
  misc_feature (353)..(353): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggagtacttcattcgaaccaaaaagtaatattactttgttcggttccagcaagaagtcaggccaggcccctgtactgcatccatgacgccagtccgacgacacgtccgggactcccgtagagagtacttctctcnccctcagcctacggacgggactaggtccggacccctacgtttcgaaccttacgtaccgtaggggttaccggggaccccggtagggtacgggaacggtaagtaggaacggacttacggaacctttaacgttaagtttacgtaaccgtaccaacccgaagtaacgtaacgttaggtacggtactacggtacggtagggggttacgttcgggaacgggaacggtacgttaacggtccggtaccggttccgtacggtaccgacggacccgtaacgggtcccgttacccggcccccgtaggtccctaccgttccggttccccg

SEQ ID NO: 88671 - DNA, 737 bp, Homo sapiens
  misc_feature: GYAE6OF01DW1UU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattcgaccaaaagatatacgttgttggttccagcaagaacgtcacggccacggcccctgtactggtcatccagtgaggccagtcgacgacaccgtccgggactcccgtgacgagtactttccgtctcggccctacccgagtccgtacggaacgggacacgggtcggacccctaaccgtttcgaaccgttataccgtagggttccgggggaccccgtaaggggtacggggaacggtaagtacggaacgtaccgttacggtaacctttaaacgttacgttttacggttaacccggacctaaccgaaggacgtaacggttaagggttcggtaactacggttaccgggtaagggggggttaacgttccgggggaaccgggtaacggggtaacccgttaaagggtttccggtaaccccggtttccgtttacgggtcccgtaaccggaccccgtaaacgggtcccgttcccgggtccccccgttaccggggttcccctaaccgttccccgttaccccg

SEQ ID NO: 88672 - DNA, 719 bp, Homo sapiens
  misc_feature: GYAE6OF01B0S1X.21.8.A08.1.454.CMB.1.raw
  modified_base (223)..(223): a, c, t, g, unknown or other
  misc_feature (223)..(223): n is a, c, g, or t
  modified_base (339)..(339): a, c, t, g, unknown or other
  misc_feature (339)..(339): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccacccgtcggtgtcagttcgccccgaggacaaacggccaaggatcacctgctctgganattcaattgactaaaaagatatacttgttgtaccagcaagaagtcaggccaggccctgtactggtcatcatgagccagtcgacgacacgtccggactcccgagagacgtatttccncgtcgccctcgaagccgtacaggggacctaggtcggacctaccgttagaaccttgtacgacggtcggggacccgaagggtacggaacggtagtaaggaaacgcgttacggtaaccttaaccgttaagtttacgttaaccggaccgtaacccgaagggtaactaacgggttaacggttacggtaacgtacgggttaacgggtaacggggggttacgttacggggacccggggtaaacgggaaccggttaaaccgggttacgggtaacccgggtttcccggtttagggacccggtaacccggtaccccgggtaaacgggttccccgtaccccggtacccccccgttacgggttacccctaccgtttccccgtttacccccgg

SEQ ID NO: 88673 - DNA, 734 bp, Homo sapiens
  misc_feature: GYAE6OF01DB7DJ.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccgaggaacaaacggccaggatcacctgcttcgngggatattcattgaaccaaaagtaatattacttgttggttccagcaagaagtcaggccacggcccctgtacgtggtacattccagtgacgaccagtcgaacgacaccgtaccgggactcccgtagacgagtacttctctcgccctacagctacgagggacacgtcgggacctaccgttagaccgttagtccggaagggttccggggaccccgtaaggggttacgggaaccgtaggtaacggtaaacggtcgttaacgtaacctttaacgttaagtttacggttaaccgacgaacccgacggtaacgtacgggttaaggtcggtacctaacggttacgggtaacggggggttaacgtccgggggtaccggggtaaacgggtaacccgttaaaggggttaccgaccccgggtttacccgtttcgggtaacccgtaccgggaccccgttaacgggtcccgtaccccgggtaccccccggttaccggtcccttaaccgtccccggtttacccccgg

SEQ ID NO: 88674 - DNA, 746 bp, Homo sapiens
  misc_feature: GYAE6OF01CDF3Y.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgacgcctcctatgagctgacacacgcccaccctggtntcagtcgtcccaggacaaacggccaggactcactgctcgtggatattcattagaaccaaaagaattattacgttggttggttccagtcaagaagtcgacggccacggcccctgtactggtcatccatgacggccagtaccgaacgacctacgtccgggactcccgtagacgagtacttctctcgtccctcacgtctacgacggacacgtccggacctaccgtgaactactcggacggtcggggaccgtagggtagggaacgtaggtacgaacggtcgtacgtaaccgttaacgttagtttacgttaaccgggaccctaaccgtaacggtaacggtaacggttaacgggtacggttaacccgggtaaaggtttaccgggggtaaagggggggttttaacccgtccgggggggttaaccggggaaccggggtaacccggttaaacggttacccgggtaaccccggtttcggttacccgggtccgtaaacccggacccgggtaaaccggtcccgtacccccgggttcccccgttaccgggtcccttaaccgttccccgtttaccccccggg

SEQ ID NO: 88675 - DNA, 699 bp, Homo sapiens
  misc_feature: GYAE6OF01BXWZJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggacaacggccaggactcacctgctcgtggagtattcattcgaaccaaaaagtaatattacttgttacggttccagtacaagaagtcgaggccacggtcccctagtacgtggtacatccatcgacgcagtccgacgacacgtccgggactcccgtagacgtagtacttctctcgccctaccacgtccgtacgacgggacaggtcgacctacgttagacttacgtcgtacgggtcgggaccgtagggtacggacgtagtacggaacgtcgtacgtaacttacgttacgttacgttacgacctaaccgaagtacgtaaggttaggtcggtaacgtagttacgggtaagggggttactacggggacgggtaacgggtaaccggttacgggtttaaccggtaccgggtttacccgttacgggtacccgtaaccggaccccggtaaacgggtccccgttcccggttaccccccggttacggtacccttacccggttcccgtttaccccccggg

SEQ ID NO: 88676 - DNA, 575 bp, Homo sapiens
  misc_feature: GYAE6OF01AO7EG.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctgccctccagctcgagggacaggtcggccaccttgactatcgaggtcggggcccagggtggacgatgaagctagactactattgttacgcacagacagtagtggtcagtcgagggggttatcgggacgggacgggaccgtaaggttcggaacccggttccgttagggtccgtacgggaccccgtaaacgggtcccttaccgggtcccccccgttacgggttcccctaaccgttcccgttccccgg

SEQ ID NO: 88677 - DNA, 560 bp, Homo sapiens
  misc_feature: GYAE6OF01APWEV.21.8.A08.1.454.CMB.1.raw
  modified_base (221)..(221): a, c, t, g, unknown or other
  misc_feature (221)..(221): n is a, c, g, or t
  modified_base (522)..(522): a, c, t, g, unknown or other
  misc_feature (522)..(522): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattcgaccaaaagatatacttgttggttccagcagaagtcaggccaggcccctgtactgtcatccatgaggccagtcgacgacacgtccgggatcccgtgacgagattctctcgccctccagctcgaggacaggtcgcctacttgacctatcgaggtcgggaccctagggtcggacgagtacggaaacgtcgtacgaacttactagtttcgttaccgcaaccgagacaagttagtcggtactagtcgaagggggttattcgggacggtagggacctaggtcgtaccgtcgtaggtcncggcccgaaggcctccgacccctggctccgtcgtcccg

SEQ ID NO: 88678 - DNA, 627 bp, Homo sapiens
  misc_feature: GYAE6OF01C8I7M.21.8.A08.1.454.CMB.1.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggaccaaacggccaggatcacctgctctgganattcattgaccaaagatatacttgtgtccagcagagtnaggccaggcccctgtactggtcatccatgacgcagtcgacgacacgtccgggactcccgtagagtagtattcgtctcgccctcgaggtctacgagggactagtcgaccaccttgacgtatcgaggtcggggaccctaggggtcgaacgtagtaggaaacgtcgtagtaaccgttactaagtttcgttacgacctaacgaacgtacgtaaggttagtcggtaactacgtacggtaaggggttacttcggggaccggtaacgggtaccgtaagggttaccggacccgttcggttaacggtccaccgggacccgtaaggggcccttcccggaccccccgttaggttaccctaccgttcccgttccccgg

SEQ ID NO: 88679 - DNA, 548 bp, Homo sapiens
  misc_feature: GYAE6OF01EAQZC.21.8.A08.1.454.CMB.1.raw
  modified_base (221)..(221): a, c, t, g, unknown or other
  misc_feature (221)..(221): n is a, c, g, or t
  modified_base (513)..(513): a, c, t, g, unknown or other
  misc_feature (513)..(513): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgtcagcagaagtcaggccaggcccctgtactggtcatccatggaggccagtcgacgacacgtccgggactcccgtagagagtactttctctcgccctccgagtcctacgagggacaggtcggccaccgttgacttagtcgagggtcggggcccagggtggaacgagtagaagctagacttatagttgtaccgcaccagacagtagtggtctagtcggaggggttactcgggcgggaggaccgtaaggttcgaccgtcgttggacncgaccgaggctccgccccgtgtcctctccgtcccg

SEQ ID NO: 88680 - DNA, 522 bp, Homo sapiens
  misc_feature: GYAE6OF01BY1H2.21.8.A08.1.454.CMB.1.raw
  modified_base (320)..(320): a, c, t, g, unknown or other
  misc_feature (320)..(320): n is a, c, g, or t
  modified_base (424)..(424): a, c, t, g, unknown or other
  misc_feature (424)..(424): n is a, c, g, or t
  modified_base (511)..(511): a, c, t, g, unknown or other
  misc_feature (511)..(511): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaaagatatacttgttggttccagcagaagtcaggccaggcccctgtactggtcatccatgagccagtcgacgacacgtccggatcccngacgagtacttctctcgccctcagctacgaggactaggtcgcctaacttgactatcgtagtcgggccgaggtcggacgagtgaagctagactagtagttgtacncacagactagtagtgtctagtcggagggtatcggacggaggacgaagtgaccgtcgtgcgcgaccgaagccgtcgccccgtggtccncgtcgtacccg

SEQ ID NO: 88681 - DNA, 769 bp, Homo sapiens
  misc_feature: GYAE6OF01BMO2I.21.8.A08.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctggtgtcagtcgtccccgaggaccaaacggccaggactcacctgctctaggatattcattgaaccaaaagtaatatacttgttcggttaccagcaagaacgtcacggccacggcccctgtactggtcatccatgacgcagtcgacgacncgtccggactcccgtagagtagtacttcgcgtcgccctacgagtcctacggagggactaggtcggtaccctacgttacgacttacgtacggtacgggtccgggacccgtaggggttacggaaccgtaaggtaggtaaccggtccgttacggtaaacctttaacggttaacgtttaccggttaacccgaccgtaacccgtaaggaacggttaacggtttacggttacggtacccgttaagggtaccggggttaacggggggttacggttacccgggggacggggttaaaccggggtaacccgttaaacggggttacccggttaccccgggtttaccggtttacgggtaacccggtacccggaacccccggttaacgggtcccccggttaccccggttaccccccccggttagggttaccccctaacccggtttccccggttaccccccg

SEQ ID NO: 88682 - DNA, 535 bp, Homo sapiens
  misc_feature: GYAE6OF01E4LRZ.21.8.A08.1.454.CMB.1.raw
  modified_base (322)..(322): a, c, t, g, unknown or other
  misc_feature (322)..(322): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (490)..(490): a, c, t, g, unknown or other
  misc_feature (490)..(490): n is a, c, g, or t
tcagtcgtcgctcgcacgaccggtgctcgatttagcatactctacgagggggctgtgggctcaggaggcagagctctgggaatctcaccatggcctggacccctctcctgctccccctcctcactttctgcacagtctctgaggcctcctatgagctgacacagccacctcggtgtcagtgtccccaggacaaacggccaggatcacctgctctggagattcattgccaaaagatatacttgttggtccagcagaagtcaggccaggcccctgtactggtccattccatgagccagtcgacgacactccgggatccctgacngattctctgccctccagctcgagggacaggtcgcccacttgactatcgacggttgggcccagggtcggacgatgaagcngactactattgtancccacagacngtagnggtacagtcgtaggggtattcgggcggagggacctaaggttcgtaccgtccgttggtccnggccccaaggtcccgtcgccccctaggtcctacgtccgttacccg

SEQ ID NO: 88683 - DNA, 737 bp, Homo sapiens
  misc_feature: GYAE6OF01CF2ZV.21.8.A08.1.454.CMB.1.raw
  modified_base (133)..(133): a, c, t, g, unknown or other
  misc_feature (133)..(133): n is a, c, g, or t
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctcggacccctctcctgcctcccctctcactttctgcacngtctctgacgcctctatgagctgacacacgccctaccgtcggtntcagtcgtacccgaaggacaacggcaggactccacctgctcgtaggactattcagttcgaaccaaaaagtactattacgttggttcgtaccagcaaggtacgtcgacggccacggcccttgtacgtgtcatccagtcgacgccagtcgacgacctcgtccggatccgtagagactcttcgtcgcgtcctcgacgtctacggaggtctaggtccgtacctacggttagaccgttacgtacggtacgggtaccggggacccgtaaggggtacggaaacggtagtaacggaacggtcgttacgtaaccgtttaacgttacgtttaccgtaacgaacccgtaccgtaacgtaccgtaagggttacggttacggtaaccgtacggtttacggggtacggggtttaccggtaccggggtacggggtaaccgggtaacccgttacgggttaacccggtacccggtttaccggttacgggttaaccccgaacgggttaccccggtaaacgggtcccgttaccccgggtcccccggttaccggtcccttcccgttcccgtttacccccg

SEQ ID NO: 88684 - DNA, 640 bp, Homo sapiens
  misc_feature: GYAE6OF01BXZ2D.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaacggccaggatcacctgctcgtggagtattcattcgaccaaaagatatacttgttgttccagcaagagtcaggccacggtccctgtactggtacatccagtcggacggccaggtccgacgaccgtaccgtccgggactcccgtaggagtacgtacttccgtctcgccctccacggtccgtacggacgggactacggtcggaccctaccgttagactacgtacggtcgggtccgggccgtagggtacggacgtagtaggaacgtctaggtacttacgttagttacgtaccgacacgtagacgtaggtacgtcggtactaggtacggtaggggttacgtacgggacgggacgggtaaccgtacgggttccggtacccgttcggttaggaccgaccggacccgtaaggcccgtcccgaccccggttacggcctaccgttccgttacccccg

SEQ ID NO: 88685 - DNA, 557 bp, Homo sapiens
  misc_feature: GYAE6OF01BRI8S.21.8.A08.1.454.CMB.1.raw
  modified_base (220)..(220): a, c, t, g, unknown or other
  misc_feature (220)..(220): n is a, c, g, or t
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagtatattacttgttggttccagcagaagtcaggccaggccccctgtactggtcatccatggagccagtcgacgacactccgggatcccgngagagattctctcgccctcagctacgaggacagtcggacctaccgttgactactcgaggtcggggcccgagggtcggacgagtgaagccgtagtacttactatttacgtaccgcaccgagacagtagtggtctagtcggtaggggtattcgggacgggaggaccgtaagtcggtacccgtcgttggacgtcgcccgaagccgtcccgccccgtcgcctacctcgttaccccg

SEQ ID NO: 88686 - DNA, 800 bp, Homo sapiens
  misc_feature: GYAE6OF01DY9C3.21.8.A08.1.454.CMB.1.raw
tcagtcgtcgctcgcacgaccggtgctcgatttagcatactctacgaagggggctggtgggctcaggaggcagagcgtcgtgggaactctcaccatggcctggaccccgtctccctgccttccccctccgtcacctttctgtcacagtctctgacgggcctcctatgagctgacacacgcccacccgtcggtcgtccacgtcggtccccgaggacaaaccggccaaggactccacctgctctggaagattcgattgaccaaaagatattacttgttggttccagcagacgtcacggccacggcccctgtactcgtcatccaatggacggccacgtcgacgacaccgtccgggactcccgtgtacgtagtactttcctacgtcgtcccgtaccgaacggtccttaccgaacgggtacctacgggttaccggtacccctaacccggtttaccgggaacccttaacgttcccggtaaacggggttcccgggggaccccgtaggggttacggggaaaccggtagttaacggaacgtccgttaggtaaccgtttaacggttagttttacggttaaccgaccgtaaccgaacgttaaccgaaggttacggttaccgggttacgtacggttaccggggtaacgggggttacgttaccgggggaacgggttaaccgggtaaccgtaaacgggtttccggaacccgggttccggtttacgggtacccgttacggaccccccggtaagggtccccgttcccggtacccccccgttcgggttacccctacccgtttcccgttacccccggg

SEQ ID NO: 88687 - DNA, 568 bp, Homo sapiens
  misc_feature: GYAE6OF01EG9RR.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagaatatacttgttgttccagcagaagtcaggccaggcccctgtactggtcatccatgaggccagtcgacgacactccgggatccctgagagattcctctcgccctccagctacgagggacaggtcggccctacgttgaacttatcgaggtcggggcccgagggtcggacgagtagaagctagacttactagttagttacgcaccgagacagtagtgtctagtcggtaggggtagtcgggacggtacgggaccgtaacggttcggtaccgttccgttggtcgacggacccgaaggcccgtaccggcccccgtcggtccctccgtccgttccccgg

SEQ ID NO: 88688 - DNA, 704 bp, Homo sapiens
  misc_feature: GYAE6OF01CVVMD.21.8.A08.1.454.CMB.1.raw
  modified_base (230)..(230): a, c, t, g, unknown or other
  misc_feature (230)..(230): n is a, c, g, or t
  modified_base (554)..(554): a, c, t, g, unknown or other
  misc_feature (554)..(554): n is a, c, g, or t
tcagtcgtcgctcgcacgaccggtgctcgatttagcatactctacagggggctgtgggctcaggaggcagagctctgggaatctcaccatggcctcggacccctctcctgctcccctcctcactttctgcacagtctctgacggcctctatgagctgacacagcccacccgtcggtgtcagtcgtccccgaaggacgaaacggccaggactcacctgctcgtagggactnttcagttacgaaccaaaaagtaattattacgttttggttacggttaccagcgaagtaaacgtcgacggcccgacggtccccgttggtaacgtcggtaccacttccgagtcggacggccgaaggtccgaacgacctacgtaccgggcttcccgagggaacgtaacgtctttaccgtcgtccgtcccgtacgaacgtccgacgggaacggacgtacgttcggaccctacgttagactacgcgtacgggtcgggacccgtaggggtacggacgtaagtcgaacgtctagtaccttagttagttacgtaccgactacggaagtaccgnggtaagtcggtactaggtacgggtagggttagtccggggaacgggacggttaaccggaggttccggaaccggtttcggtacggacgaccggtacccgaacggtcccgtacccggttcccccgtcgggtacctcccggtccgttcccccgg

SEQ ID NO: 88689 - DNA, 797 bp, Homo sapiens
  misc_feature: GYAE6OF01DE0KO.21.8.A08.1.454.CMB.1.raw
  modified_base (129)..(129): a, c, t, g, unknown or other
  misc_feature (129)..(129): n is a, c, g, or t
  modified_base (180)..(180): a, c, t, g, unknown or other
  misc_feature (180)..(180): n is a, c, g, or t
  modified_base (785)..(785): a, c, t, g, unknown or other
  misc_feature (785)..(785): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgacggcctctatgagctagacacacgcccacccgtcggtntcagtcgtacccaggacaaacggccagactcactgctcgaggatacttcattacgaaccaaaaagtattacgttacgtttggttcggttaccagaccgaaggtaagtccgaacggaccgtaaccgggcccccttgtaaccgtggtacctacggttaccagttacggaaccggacccgtaacggtacggaaccaaccgtaaccggtacccggggaacttaccccgtagggaacgtaacgttaaccgtttcctccgtccgtacccctcccgtaagccgtaaccgggaacgggtaaccgtacgggtaccgggaccccttaacccggttagtaaaccttacggtacggtaaccggggttccgggggaccccgtaaggggttacgggaaacggtagtaacgggaaacgttcggtaacgtaccgtttaaacgttagtttaccggtaaccgaccgtaacgacgtaacgtaggtaccggtggttaccgtaggtacgggtaggggttaccgtaccgggaacgggacggaaccgtaggtcccgtacggtacccggtaccgaggtacccgaccggtacccgtaaccgggcctccccggtaccccgtccggttaccnccggtttccccg

SEQ ID NO: 88690 - DNA, 684 bp, Homo sapiens
  misc_feature: GYAE6OF01DCKLX.21.8.A08.1.454.CMB.1.raw
tcagtcgtcgctcgcacgaccggtgctcgatttagcatactctacagggggtgggctcaggaggcagagctctgggaatctcaccatggcctcggacccctctcctgcctccccctcctctactttctgcacagtctctgacggcctcctatgagctgacacacgccctacccgtcggtgtcagtccgtaccccgaaggaaccaaaccggccaaggactccaccgtgctcgtagggatattcattcgaaccaaaaagtattatactttggttcggttccagcaagacgtcgacggccacggtccctgtactggtactactccgagtcgacggccaggtacgacgacaccgtccgggactcccgaggacgaagtcttctctcgcctcgagctacgagggcaggtcgacctacttgactagtcgaggtcgggaccgagggtacggacgagtagaacgcgttacgacgttaacgttagtttacgtaaccgacgtaaccgaacggacgtaaggttacggttacggtacgtacggtacgggtaagggggttacgttacgggacgggtaacgggtacgtaaacggttcggtaacccggttcggttacggtccgaaccggtacccgaacggtcccgtacccggtacccccgtcggttaccctaccgttcccgttcccggtccccgtccccg

SEQ ID NO: 88691 - DNA, 708 bp, Homo sapiens
  misc_feature: GYAE6OF01ARSA1.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctgganattcattgaccaaaagatatacttgttgttccagcagagtcaggccaggcccctgtactggtcatccatgagccagtcgacgacacgtccgggatcccgtgagagtattctctcgccctccagtcctcgaggactaggtcggccctacgttgaccttatccgtagggttccggggccccgtaagggtacgggaacggtagtacggaaacggtccgtacggtaaccgttaacgttaacgtttacggttaacccgaccgtaacccgtaacgggtaaccgtaaggttaacggttcgggtaccgtaacggttaccggggtaaggggggttaaccgttaccgggggaacggggtaaccggggtaacccgttaagggtttacccgggtacccggtttacccgtttacggggtaccgtaccgggtaccccgtaaacgggtcccgttacccggtaccccccgttacgggttcccctaccgttcccgttacccccgg

SEQ ID NO: 88692 - DNA, 696 bp, Homo sapiens
  misc_feature: GYAE6OF01DYRYK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggaccaaacggccaggactccacctgctctggatattcattcgaaccaaaagattatacgttgttcggttaccagcagacgtcaggccaggcccctgtactggtcatccagtgacgccagtccgacgactaccgtccgggactcccgtagagagtactttccgtctcgccctacgacgtcctacggaggtactacgttcggaccctacgttagaccttagtcgacgggtcgggacccgagggtacggaacgtagtacggaagtccgtacgtaccttaacgttacgtttacgtaccgacctaaccgtaagtaacgtaggttaacggtacggtacctaaggttaccgggtaaggggttacgttacggggacgggtaaaccgggttaccgaaacgggtttcggtacccggtttccgttagggtacccgaaaccggtccccggtaaagggtcccttaccccgggtacccccgttacccgggtaccttaccccgttccgtttacccccgg

SEQ ID NO: 88693 - DNA, 572 bp, Homo sapiens
  misc_feature: GYAE6OF01B3VMN.21.8.A08.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgcttcttttaagaggtgtccagtgtcaggcgcaactgggtggagtcgtgggggagcagtggtccagcctggggaggtccctgagcctctcctgtgcagcgtctggattcagtatcggcttccttgccatcggcacgtcgggtccnccgaggcctccgaggccgaagggggctagggaggtggggtggcgtatttagtcgttggtatggagtggggaagtgaggagtattattatcgagtactcggtagaacgggtccgattcacctatctacagacgacatcgaccaacaaccacactgtactactacaaacgtcgaccggtctagacgacgaccggacgacgacggtatagtgtacttacgtagacgtgtcgttggtacgtaggttcgggaccgtacgggtacccgtggtacccg

SEQ ID NO: 88694 - DNA, 512 bp, Homo sapiens
  misc_feature: GYAE6OF01EUYLN.21.8.A08.1.454.CMB.1.raw
  modified_base (503)..(503): a, c, t, g, unknown or other
  misc_feature (503)..(503): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacactccgggatccctgagagattctctgccctcagctcagggacagtggccaccttgactatcagtgggccaggtggacgatgaagctgactactattgttacgcaccagacagtagtggtcagtcgtaggggtatcggacgggagggaccaaggttcgaccgtcgttggcagcccgaaggcctcgcccctggtccncgtcgtccg

SEQ ID NO: 88695 - DNA, 610 bp, Homo sapiens
  misc_feature: GYAE6OF01DDHZN.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgcttcttttaagaggtgtccagtgtcaggcgcaactggtggagtcgtgggggagcatggtccagccgtggggaggtccctgacgcctctcctgtgcagcgtcgtggattcgagtatcggcttcctttgccatgcacgtcgggtccaccgaggctaccgaggcgaagggggtctgggaggtcgggtggcgtattagtcgtaggtatggagtagggaagtgagagtattaattattacaggtactcggaggacgggtaccgtactccaacctatacctacaagaagaacaatacgaccaaacgaaaccactacttacgtaacttcttaacaaagtccggaaccggtaccgtaggacgacgaccgacggaacgacgactatgttaacgttacgtagtaacggtgttacgtttggtacgtaggttacgggaccgtaacgggtacccgtcggtacccg

SEQ ID NO: 88696 - DNA, 641 bp, Homo sapiens
  misc_feature: GYAE6OF01A2E8Z.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactgtcatccatgaggccagtcgacgacactccgggatccctgagagattctctgccctccagcctcgacgggacaggtcggccctaccgttgaacttatcgagggtcggggacccgtagggtcgggaacgtagtagaacggcctagtaccttaacgttacgtttacggttacccgacaaccgaagtaacgtaacgtaggtacggtacctaggttcggtaagggggttacgttccggggacgggaacggggtaaccgtaagggtttccggtacccggttccgttagggtacccgacggacccccggaaagggtccctcccgggtacccccccgttacggtccctaccgttcccgttacccccgg

SEQ ID NO: 88697 - DNA, 603 bp, Homo sapiens
  misc_feature: GYAE6OF01BVILE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggaccaaacggccaggatcacctgctctggagattcattgaccaaaagaatatacttgttggttccagcagaagtcaggccaggcccctgtactggtcatccatgaggccagtcgacgacactccgggatccctgagagattctctgccctccagcctcgagggacaggtcggccaccgttgactagtcgaggtcggggcccgagggtcgggacgagtaggaagccgtagaacttacttagtttacggttaccgacaccgagacgtagtagtggtacagttacgaggggttacgtcgggacgggacgggtacctaaggttaccggtacccggttccgtttacgggtacctacggaccccgaagggtcccgtacccggtaccccccgttacgggttcccaccgttccgttccccgg

SEQ ID NO: 88698 - DNA, 653 bp, Homo sapiens
  misc_feature: GYAE6OF01BC610.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcatcctatgagctgacacagcccaccctcggtgtcagtcgtcccaggacaaacggccagatcactgctctggatattcattgaccaaaagtatatacttgttgttccagcagaagtcacggccacggcccctgtactggtcactccagtgacggccagtccgaacgacctaccggtccgggactcccgtagacgagtacttcctcgtcgtccctacgagtcctacggacgggactacgggttccgaccctaccgttcgacttacgtacgtacgggtcgggtacccgagggtacggaacgtagtacggacgtacgtacgtaaccttacgttagttacgttacgacctaaccgtagaaccgtaggttacggtcgtacgtagttacgggtaggggttacgtcgggacgggtaacgggtaaccgtaacggttccgtaccggttcgttacggtaccgacggtaccccgaacgggtcccgttcccggacccccgttcggtcccgtccgttcccgg

SEQ ID NO: 88699 - DNA, 687 bp, Homo sapiens
  misc_feature: GYAE6OF01CX212.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaacacacgcccaccctcggtgtccagtcgtcccaggaccaaacggccaggatcacctgctcgtggagattcattcgaccaaaaagatatacttgttgtccagcagaagtcaggccaggcccctagtactggtcatccatgacgccagtcgacacacgtccgggactccgagacgacgtacttctctccgtaccctaccgagtcctacggaagggacaggtccggaccctacgttacgactagtcgacgggtcgggacccgtagggtcggaacgtagtacggaaacgtgtacgtaaccttaacgttacgtttacggtaaccgaccaaccgtaagaaccgtaggttaacggtacggtacgtaaggtacgggtaacgggggtttacgtaccggggacgggtaacggggaaccgttaaacgggttaccggaacccggttccggtttacgggaccgtaaccgggtaccccgaaacgggtccgttaccccggccccccggtttacgggtccctaacccgttcccgttacccccgg

SEQ ID NO: 88700 - DNA, 899 bp, Homo sapiens
  misc_feature: GYAE6OF01BVIVK.21.8.A08.1.454.CMB.1.raw
tcagtcgtcgctcgcacgaccggtgctcgatttagcatactctacgtagggggctgtgggctcaggaggcagagctcctgggaatctcaccagtccggcctggaccctctcctggctcccctcctcactttctgcacagtctctcgaggtcctcctatgacgctgacaccagcccaccctcggtcgtcctagtcgtccccaggactaaccggccagggatccacctgcctactggagtactttcgacgttcgacctaaaagaatattacctttaggttggttaccctagtactaagtaaggttcacggtccacgggaccccctagtaccgtggtaccacgttaccaattcgaacggtcccaggtttccggaaccggtaccaccgtacccggggtattcccccgtaggaacggtacgggtactttacccgttacgtttaccgtaacgttcccgtaaggccgtttaccgaaggggaccctaagggttcgggaacccctaaccgtttacggaacctttacgtccgtaaggttcccgggggacccctaagggttacggggaacccgttagtcggtaaacggtcccgttacggaaccgtttaaccgtttaacgttttaccgggtttaacccgtacccgttaacccgtaacgggtaaccgtaacggttacggttaaaccggggttaccgttaaacgtttcccggtttaaaccggggggggtttacctttaacccggggggtaccgggtaaacggggggtaaaccccggtaaacgggttttaccggggtaaccccgggtttccgtttaacggggtaccccggaacgggtaacccccgtaaacggggttcccgttacccgggtcccccccgttacggggttcccaacccgttcccgtttaaccccgg

SEQ ID NO: 88701 - DNA, 804 bp, Homo sapiens
  misc_feature: GYAE6OF01A4IGN.21.8.A08.1.454.CMB.1.raw
tcagtcgtcgctcgcacgaccggtgctcgatttagcatactctacagggggcgtgtcgggctccagggaggtccagagctctgggaatctcaccatggcctggacccctctccttctccccctctcacctttctgcgactaggtctcgtgaggtccttcctattgacgtcttagacacagccacccgtcggtgtcagtcgtcccgagggacaggacggccaaggtactcaccgttggcctctgcagacttggactgaccaaagaatagtcgtcttattacgaacctaactagaacgctacggaccacggtccccgttgtacgttagtcgtaacgtagtaagtaaacgtacgtacgttggacgaaccggtcctagtaacgagtacgtcccgtaggaacgtacgtactttccgtacgttacggtacctacccggacgtaccgtacggaacgggtaccgaaccggtacgtacggtaccgtacgttacgaaccgttacgaccggtaacgggtacccggggacccgtaaaggggtaaccggtaacggtaacgttacgggtaacgtccggttaacgtaaacccgtttaagttaaggtttaccggtaacccgacccgtaaaccgaacggtaacgtaacgggttacggttaccggttacgtaagggttaccggtaagggggttaccttaccggggtaacgggtaacgggtaaccggttaaggggttacccgtacccggttcgtttaccggaacccgtaaccgtacccggtaaccggtacccgttacccggtcccccggttggttaacccccg

SEQ ID NO: 88702 - DNA, 584 bp, Homo sapiens
  misc_feature: GYAE6OF01E39A1.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatcacctgctctggagattcattgaccaaaagatatacttgttgtccagcagaagtcaggccaggcccctgtactggtcatccatgacggccagtcgacgacacgtccgggactcccgtggagagtattctctcgccctccagcctcgaggacaggtcggaccctaccttgaccttatccgagggtcggggcccgtagggtcggacgagtagaagtcgtagactactagttacgtaccgcgacagacgagtagtgtacgagtacggaggggtatcgggacggacgggaccgtaaggtcggtaccggttccgttggtaccgtcggacccgaagggtcccgtacccggtccccccgtcggtccctcccgtccgttccccgg

SEQ ID NO: 88703 - DNA, 721 bp, Homo sapiens
  misc_feature: GYAE6OF01DGNXC.21.8.A08.1.454.CMB.1.raw
  modified_base (146)..(146): a, c, t, g, unknown or other
  misc_feature (146)..(146): n is a, c, g, or t
  modified_base (275)..(275): a, c, t, g, unknown or other
  misc_feature (275)..(275): n is a, c, g, or t
  modified_base (709)..(709): a, c, t, g, unknown or other
  misc_feature (709)..(709): n is a, c, g, or t
tcagtcgtcgctcgcacgaccggtgctcgatttagcatactctactagggggtcggtggtagggctcaggaggtcgacgagcgtactgggaatactccacactggccttcggaccccttctcctgccttcccctctcgactttccngccacacgtccgtctaggtcggtcccttcgtaatcgagtcctacgacaccaccgtcctacccgttggtctaccgaggtcgaacccgaggaccaaccggccaggactccggacctggcctcgtggaattntttcgacttcgaacctaaaagacttagtaccttagttaacggttccagccaaggacgtccgaggcctacggcccctagtactggtacatccgagtcgtacggccgacgtcgacgccgaccgtcggaactcccgaggacgagtacgtttcgtcgtcggacctccgacgtccgtacgacggaccacggttcgacctaacgttcgaacttacgtacggacgggtccggggtaaccgtagggttacgggtacgttaacgtaggtaacgcctaaggtaaccttacgttacgtttacggtaccgacaccgtacgacgttaaggttcgggtacggtaacgaggtacgggtacggggtacttcgggaacggaaacgggtactacggttcggaccgttcgtacggactacgcccgtaggtccctccgtaccccgttgtacccncttcgttcccgg

SEQ ID NO: 88704 - DNA, 749 bp, Homo sapiens
  misc_feature: GYAE6OF01BP3L1.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagattcattgaccaaaagatatacttgttgtccagcagagtcaggccaggcccctgtactggtcatccatgaggccagtcgacgaccacgtccgggactcccgtagacgagtatttcctacgtcgccccttaccgacgtcccgtacggaacggggacctaggttccgggccctaacccgtttagaaccttagtaccgtaacggggttccgggggaccccgtaggggtacgggtaacggtaacgtacggtaaacggtccgttaggtaaccgtttaacgtttaacgttttacggttaacccggaacctaacccgaaacgttaacgtaacgggtttaacggttacgggtacctaacggttaccgggttaacggggggtttaacgtccggggtaacggggaacgggtaacccgttaagggtttcccgggtaccggttcccggtttagggacccgttaacggaccccggtaaaggtccccgttacccggtccccccgttacgggtccttaaccccggttccgtttccccccggg

SEQ ID NO: 88705 - DNA, 553 bp, Homo sapiens
  misc_feature: GYAE6OF01EOMY8.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagaatatacttgttggttccagcagaagtcaggccaggcccctgtactggtcatccatgaggccagtcgacgacacgtccgggatcccgtgagagattctctcgccctccagctcgagggacaggtcggccctaccgttgaccttatcgaggtcggggcccagggtggacgagtgaagctgacttactattgtacgcaccagacagtagtggtactagtcgaggggtagtcgggacgggaggaccgtaggttcggaccgttcgttgggtacacggcccgaaggccgtccggcccccgttcggtctaccgtcgttccccg

SEQ ID NO: 88706 - DNA, 703 bp, Homo sapiens
  misc_feature: GYAE6OF01EITA4.21.8.A08.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagcatactctacagggggtgggctcaggaggcagagctctgggaatctcaccatggcctggacccctctcctgcctccccctcctctactttctgcacagtctctgaggcctcctatgagctgacacacgcccacccgtcggtntcagtcgtcccaaggacaaacggccaggactccacctgctcgtggatattcattcgaaccaaaaagattattacgtttggttacggttccagcaagaagtcgaggccacggtccctgtacgtggtctactccagtcggacggccaggtaccggacgactaccggtccgggtactcccgtagagtagtacttcctctcgccctccgagtcctacggaacggtacgtaggtcggaccctacgttacgaacttacgtacggtacgggtccggggtacccgtaggggtacggaacggtaagttacggaacgtccgtacgtaaccgttaacgtttagtttaccggttaaccgacctaaccgaagtacgtaaggttaggtcggtacgtacgtacggggtaggggttacgttacgggacgggaacgggtaaccgtacggttacgtacccgttcgttcggacgtaccggaccgtacggcccgttcccggcccccgtcggtaccctaccgttccgttcccgttcccctacccccg

SEQ ID NO: 88707 - DNA, 897 bp, Homo sapiens
  misc_feature: GYAE6OF01C6HWZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccacccgtcggtgtcagtcgtaccccgaggaacaaacggccaggactccacctgctcgtagggaatatttacgattacgaaaccctaaaaaagtaacttaagttaaccgttttggtttacgggttacccaaggaccaaggtaaacgttccgaacgggccctaacggggtaccccccttaggtaaccgttcgggttacctaacgtttacccgaagttacggaaccggacccgtaacggtacccggaaaccggaacccgtaacccggttaccccggggtaacctacccccggttaggaaacggtacggttaaccttttccgtccgtaccggtacccccttaccggaacggtccttaaccgggaaacggggtaaccgtaacgggtcccgggaaccccttaaccgtttacggaacccgtttagtaccggtaacggggttacccggggaccccgtaaggggtacggaaccggtaagtaacggaacggtcgttaacggtaaccgtttaacgttaacgtttacggttaaccgaccctaaccggtaacgtaacgttaacggttacgggttacggttaaccgtaaggttaccggggtaaagggggttacgttaccgggggaacgggtaacgggtaacccgtaaagggttccggtaacccggttccgttacgggacctaccggtaccccgaagggtcccgtacccggccccttacgggtccctaaccgttccgttaccccg

SEQ ID NO: 88708 - DNA, 677 bp, Homo sapiens
  misc_feature: GYAE6OF01BH44Q.21.8.A08.1.454.CMB.1.raw
  modified_base (221)..(221): a, c, t, g, unknown or other
  misc_feature (221)..(221): n is a, c, g, or t
  modified_base (346)..(346): a, c, t, g, unknown or other
  misc_feature (346)..(346): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccagtgacggccagtccgacgaccacgtccgggactcccgtagacgtacgtattcctntcgccctccagtcctacgaaggggacctaggtcggaccctaccttggaaccttagtcgtaggtccggggacccgtagggtaggacggtagtacggaaggccgtaggaaccttaacgttagtttacgtttaaccgcctaacccgaaggtaacgtaaggttaaggttcggtacctaagttcgggtaaggggggttacgttaccggggacgggtaacggggtaacccgtaacgggtttacggaccccggtttcgtttacgggtacgtaccgggacccgtaacgggtcccgttccggtccccccgttacggtccctaccgtcccggttcccccgg

SEQ ID NO: 88709 - DNA, 556 bp, Homo sapiens
  misc_feature: GYAE6OF01B305D.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagagtcaggccaggcccctgtactggtcatccatgaggccagtcgacgacacgtccgggatccctgagagattctctgccctccagcctacgaggggacaggtcggcccaaccgtttgaccttatcgagggtcggggccccgagggtcgggacgagtaggaagcgtgaacttactattcgttacgcaccagacaggtagtggtctagtcggagggggttactcgggcgggagggacgtaaggttcgaccgtcgttggtcgacgcccgaaggctcgcccccgtggtcctcgtcgttcccgg

SEQ ID NO: 88710 - DNA, 565 bp, Homo sapiens
  misc_feature: GYAE6OF01BQJW6.21.8.A08.1.454.CMB.1.raw
  modified_base (220)..(220): a, c, t, g, unknown or other
  misc_feature (220)..(220): n is a, c, g, or t
  modified_base (444)..(444): a, c, t, g, unknown or other
  misc_feature (444)..(444): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttgtccagcagaagtcaggccaggcccctgtactggtcatccatgaggccagtcgacgacacgtccgggatcccgtagacgagatttctctcgccctccagtcctacgacgggacaggtcggaccctaccgttgacctatcgacggtcggggaccgagggtcggaacgagtaggaagctagacttacttagttgttacncacagacagtagtgtactagtcgtaggggtactcgggacggaggacctaggttcgtacccggttcgtggacacggacccgaaggccctccggcccccgttcggtcctccgttccgtacccg

SEQ ID NO: 88711 - DNA, 546 bp, Homo sapiens
  misc_feature: GYAE6OF01BBYDN.21.8.A08.1.454.CMB.1.raw
  modified_base (357)..(357): a, c, t, g, unknown or other
  misc_feature (357)..(357): n is a, c, g, or t
  modified_base (432)..(432): a, c, t, g, unknown or other
  misc_feature (432)..(432): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatccactgctctggagattcattgaccaaaagatatacttgttggtccagcagaagtcagccaggcccctgtactggtcatccatgacgccagtcgacgacacgtccgggatcccgtgagagtacttcgtctcgccctccagctcgaggacngtcgacctacgtgactatcgaggtcgggaccgtagggtcggacgtagtagaacgcgtagactagtacgttgtacncgacacgacgagtagtgcgtagtacgtaggggtacttcgggacggtacgggacctaggtcgaccgttcgtaggtcgacgccgaacggctaccgcccctcggtctcgtcgtcccg

SEQ ID NO: 88712 - DNA, 601 bp, Homo sapiens
  misc_feature: GYAE6OF01ESNBL.21.8.A08.1.454.CMB.1.raw
  modified_base (221)..(221): a, c, t, g, unknown or other
  misc_feature (221)..(221): n is a, c, g, or t
  modified_base (340)..(340): a, c, t, g, unknown or other
  misc_feature (340)..(340): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattcgaccaaaagatatacttgttggttccagcagaagtcaggccaggcccctgtactggtcatccatgacggccagtcgacgacacgtccgggatcccgtagagagactttccnctcgccctccgagtcctacgagggacaggtcggaccctacgttgactatcgaggtcggggaccgagggtcggacgtagtaggaacgtcgtagactacgttagtttcgtaccgcaacccgagacctaggtagtcggtactagtacggtagggggttacttcggggacgggtacgggaccgtaggttccgtaccggttcgttacgggcgacggacccgaaggtccgtcccggcccccgttacggtcctacccgtcttaccccg

SEQ ID NO: 88713 - DNA, 532 bp, Homo sapiens
  misc_feature: GYAE6OF01EXW2R.21.8.A08.1.454.CMB.1.raw
  modified_base (256)..(256): a, c, t, g, unknown or other
  misc_feature (256)..(256): n is a, c, g, or t
  modified_base (323)..(323): a, c, t, g, unknown or other
  misc_feature (323)..(323): n is a, c, g, or t
  modified_base (403)..(403): a, c, t, g, unknown or other
  misc_feature (403)..(403): n is a, c, g, or t
tcagtcgtcgctcgcacgaccggtgctcgatttagcatactctacagggggtgggctcaggaggcagagctctgggaatctcaccatggcctggacccctctcctgctccccctcctcactctctgcacaggctctgaggcctcctatgagctgacacagcccaccctcggtgtcagtcgtcccccaggacagacggccaggatcacctgctctgcagatggactgaccaaaagaaatatgcttattggtaccaanagaagccagccaaggcccctgtgttagtgatatataaagacactgagaggccctgagagactcccgngacgcgtacttctctggcctccagctcgagggacagcagtcacgttgacttatcagtgaacgtcaggcagagacgagctnactattactgtacaaacgtagtacgaacagttagagtatactagttgggtagttcgggacggtaagggaccgaaggcgtcggaccgttaccgagggtcgacgacccgaaaggtccgtcgtaccccccgg

SEQ ID NO: 88714 - DNA, 613 bp, Homo sapiens
  misc_feature: GYAE6OF01CGP3J.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcactgtctctgaggcctcctatgagctgacacagcccaccctcggtgtcagtgtccccaggacaaacggccaggatcacctgctctggagtattcattgaccaaaagatatacttgtcgttcagcagaagtcaggccaggcccctgtactggcatccatgacggccagtcgacgacacgtccgggatcccgtgagagtattctctcgccctcagtcctcgagggacagtcggaccctaccgttgacttactcgacggtcgggccgagggtacggacgagtaggaacgcgtacgtaacttacgttaagtttcgttaccgtacctaaccgaagtaacgtaggtaacggttcggtacgtacgtacgggtaggggttacggttcggggacgggtacgggaaccgtaacggttcggacccggttcgttcggtacgtaccgacccgaaggtcccgtccgtacccccgtcggtacctcgtcccgttcccgg

SEQ ID NO: 88715 - DNA, 541 bp, Homo sapiens
  misc_feature: GYAE6OF01BRNQZ.21.8.A08.1.454.CMB.1.raw
  modified_base (218)..(218): a, c, t, g, unknown or other
  misc_feature (218)..(218): n is a, c, g, or t
  modified_base (316)..(316): a, c, t, g, unknown or other
  misc_feature (316)..(316): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgtggttccagcagagtcaggccaggcccctgtactggtcatccatgagccagtcgacgacactccgggatcccngagagattctctgcctccagcctcgaggacaggtgcccaccgttgactatcgagtcggggcccagggtcggacgagtgaagctgactattattgtacgcaccagacagtagtggtcatcgaggggttacttcgggacgggtagggaccgtaggttcggacccggttcgttcgggtcacgccccgaagggccttccggcccccgttcggccctccgttcgttcccg

SEQ ID NO: 88716 - DNA, 544 bp, Homo sapiens
  misc_feature: GYAE6OF01E2M5P.21.8.A08.1.454.CMB.1.raw
  modified_base (298)..(298): a, c, t, g, unknown or other
  misc_feature (298)..(298): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggagcatggtccagccgtgggaggtccctgagcctctcctgtgcagcgtctggattcagtatcggcttcctttgccatgcacgtggggtcccnccgaggcctccgagggcgaagggggctgggagtggggtggcgtatttagtcgtggtatggagtgggaagtgagagatattatcagctcgtaggaacggcattcacatctcagagacaatcgaccaaacaacacatgtactacttacaagtcgaccgcctagacgacgacgaggacacggtctagtagtattacgtgtacgtgtcgtttggcgtaggttcggggacctacgggtacccgtggtaccg

SEQ ID NO: 88717 - DNA, 560 bp, Homo sapiens
  misc_feature: GYAE6OF01BHMFL.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattcgaccaaaagatatacttgttggttccagcagagtcaggccaggcccctgtactggtcatccatgagccagtcgacgacacgtccgggatcccgtgagagtattctctcgccctccgagcctacgagggacacgtcggccctacgttgactacgtcgaggttcggggaccctagggtaggacgagtggaaacgtcgtagacttacgttagttcgtaccgcaccgagactagtagtggtcagtcggaggggtacgtcgggcgggtaggaccgtaggtcgtaccgtcgttggacgtacgacccgaggcctccggcccccgtgcctccgtcgtcccg

SEQ ID NO: 88718 - DNA, 622 bp, Homo sapiens
  misc_feature: GYAE6OF01B02L7.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagaatatacttgttggttccagcagaagtcacggccaggcccctggtactggtcatccagtgacggccagtccgacgacaccgtccgggactcccgtagacgagtacttccgtctcgcccttaccgacgtcctcgagggacaggtcggcctaccgttgacctatcgaggtcgggaccgagggtacggaagtagtacgaagtcgtagtacgtacttagttacgtaccgacactaacgacgtaggtacgttgtacgtagtacggtagggggttacgttcgggacgggtagggtaaccgtaggttacggtacccggttccggttaggtacgtaccggacccggaaggtcccgtaccggtcccccgtacggttcctaccgttcccgttaccccg

SEQ ID NO: 88719 - DNA, 661 bp, Homo sapiens
  misc_feature: GYAE6OF01EG40I.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggactcacctgctctggagattcattcgaccaaaagatatacttgttcgttcagcagatcaggccaggcccctgtactggtcatccatgacgccagtcgacgacacgtccggatcccgtagacgagtacttctcgtcgccctccgagtcctacgacgggactacggtccggaccctaccgttagaccttacgtcgaagggtccgggggaccctagggtacggaccgtagtaggaaacgtccgttaggtaacctttaccgttagtttaccgtaaccgacccgttaaccgacgtaaccgaggttaacgtcggtacgtacgtcgggtaaggggttcgttacggggacggtaacgggtaccgtaacggttcgtacccggttccgttgggtaccaccggacccgtaacggcccgttacccggtccccccgttaggtacccctacccgttccgttacccccgg

SEQ ID NO: 88720 - DNA, 683 bp, Homo sapiens
  misc_feature: GYAE6OF01D03Q3.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcactgctctgganattcattgaccaaaagaatatacttgttgttccagcagagtcaggccacggcccctgtactggtcatccagtggacgccaggtccgacgacaccgtccgggactcccgtagagtagtactttctctcgccctccgacgtcctacggacgggactaggtcggaccctaccgttgtaaccttacgtacgtacgggtccgggacccgtagggtacgggacgtagtacggaagtctagaaccttacgttagtttacgtaccgactaaccgagtaacgtaacggttaggtacggtacgtaggttacgggtaacgggggttacgttacgggggaccgggtaaacggggtaaccggttaacgggtttccgggtacccggtttccggtttagggtacccgaccgggtaccccggaacggtcccgtccccggtccccccggtacggttaccctccgttcccgttacccccgg

SEQ ID NO: 88721 - DNA, 673 bp, Homo sapiens
  misc_feature: GYAE6OF01BQ2KM.21.8.A08.1.454.CMB.1.raw
  modified_base (218)..(218): a, c, t, g, unknown or other
  misc_feature (218)..(218): n is a, c, g, or t
  modified_base (334)..(334): a, c, t, g, unknown or other
  misc_feature (334)..(334): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcactgctctgganattcattgaccaaaaagatatacttgttggttcagcagaagtcaggccaggcccctgtactggtcatccatgagccagtcgacgacacgtccgggatcccgtagagtagactttcnctcgccctcgagtcctacgacgggacaggtcggtaccctaccgttgaccttagtcgacggtcggggcccgtagggtcggacgtagtacggaaagtcgtacgtaacttaactagtttacggttaaccgcctaaccgaagtaacgtaaggttaacggtacgggtacctaaggttaccgggtaaggggggttacttaccgggggacgggtaaccggggtaacccgtaaacgggttaccggtacccggtttccggttacgggtaccgtaccgggtaccccgtaacgggttccccgtacccccggtttcggtaccctacccgttccgttcccggttaccccccg

SEQ ID NO: 88722 - DNA, 564 bp, Homo sapiens
  misc_feature: GYAE6OF01AVK5H.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggcaggatcacctgctctggatattcattgaccaaaagattatacttgttggttccagcagagtcaggccaggcccctgtactggtcatccatgacggccagtccgacgacacgtcccgggatccccgtagagagtacttctctcgccctccagctcgagggacagtcggcctaccttgactatcgaggtcgggccgaggtggacgagtagacgctagtactactattagtacgccacagactagtagtggtactagtacggtagggtagtcggacgggacgggtaccgtaggttcggaccgttccgttaggccgtacgacccgtaaggcccgtccggtcccccgtcggtcctaccgtcgttccccgg

SEQ ID NO: 88723 - DNA, 629 bp, Homo sapiens
  misc_feature: GYAE6OF01BSWX4.21.8.A08.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacacgcccaccctcggtgtcagtcgtccccaggacaaacggccaggatcacctgctcngganattcattcgaccaaaagatatacttgttgttcagcagaagtcgagcacggccctgtactggtcatccagtgacgccagtcacgacacgtccgggatcccgtagagagtacttctctcgcctccagcctacgacgggacaggtcggaccctacgttgaactatcgaggtcgggccgtaggtacggacgtagtagaacgtactacgtaacttacttaacgttacgttaaccgacaaccaacgaacgtaaggtaaggtaggtacgtaacgtacgggtaggggttacggttacgggacgggtaacggaaccgtaaggttaccggtaaccgttcggttacgggaccgtaccggacccgtaaggcccgttacccggtaccccccgtaggtccctacgttcccgttaccccgg

SEQ ID NO: 88724 - DNA, 722 bp, Homo sapiens
  misc_feature: GYAE6OF01AI96X.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccaccctcggtntcagtcgcccaggacaaacggcaggactcacctgctcgtggatattcattcgaccaaaagatatacttgtcgtccagcagaacgtcacggccacggtcccctgtaccgtggtacactccagtgacgccagtccgaacgaccaccgtccgggtaactcccgtaggacgtaacgtcttccgtctccgtcctccgaacgccgtacggaacggggacctagggtccggtaccctaccgtttcgaacttaacgtccggtaagggtccggggacccgtaaggggtacggaacgtagttacggaacgtctacgtaacttacttaagttcgtaaccgaccgtaacgagtaacgtaggttacgtcggtacgtaacggtcgggtaaggggttacgtaccggggacggtaacgggtaacgttaacgggttaccggtaacccggtttaccgttagggtaacccggaacccggtaaccccggtaacgggttcccccgttaccccgggttaccccccggttaccgggttaacccgttcccgttcccggtttaccccccgg

SEQ ID NO: 88725 - DNA, 711 bp, Homo sapiens
  misc_feature: GYAE6OF01A5QG7.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatcacctgctctgganattcattgaccaaaagatatacttgttggtccagcagaagtcaggccagcccctgtactggtcatccatgagccagtcgacgacaccgtccgggactcccgtagagagtacttctctcgccctccgagtctcgagggactaggtcggccctaaccttggaaccttatccgagggttacggggacccgtagggtggaacgtagtaggaagcgtacggtaacttaacgttagttacggttaacgaccaaccgtaacggaacctaagggttaacgggttcggtacgtaacggtacgggttaaggggggttaacgttaccgggggacggggtaacggggtaacccgttaaacgggtttacggtaaccccggttttacccggttaggggttacccgtaacgggtaaccccccggtaaagggtacccccgttacccgggtacccccccccgggttaccgggttaccccgttacccggttcccgtttacccccgggg

SEQ ID NO: 88726 - DNA, 673 bp, Homo sapiens
  misc_feature: GYAE6OF01C9YU0.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctggtgtcagtcgtccccaggacaaacggccaggatcacctgctctgganattcattgaccaaaagatatacttgttgtccagcagaagtcaggccaggccctgtactggtcatccagtgacggccagtcgacgacacgtccgggactcccgtaggagagtactttctctcgccctccgagtctacgagggactaggtcggccctacgttgacttagtcgtaggtcggggaccgtagggtacggacgtagtaggaaacgtccgtagtaaccttaacgttagtttacggtttaaccgacctaaccgtaagtacgtaaggttacggtacgggttacgtaaggttaccgggtaagggggttacgttcggggacgggtaacggggtaacccgtaaagggtttccggtaacccggtttaccgttagggtaccgtaaccggaccccgtaaacgggtcccgtacccggtaccccccgttacgggttacccaccgttcccgttaccccgg

SEQ ID NO: 88727 - DNA, 750 bp, Homo sapiens
  misc_feature: GYAE6OF01C150H.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctggatattcattcgaccaaaagatatacttgttgtccagcagagtcaggccagcccctgtactggtcactccagtcgacgccagtccgacgacaccgtccgggactcccgtagagagtacttctctcgccctccgagtctacgacgggacacggtcggaccctaccttaggaccttacgtacgacgggttccggggacccgtagggtacgggaacgtagtacgaacggtccgttacgtaaccgtttaacgttaagtttacggttaaccgtacccgaaccgtaacggtaacgtaagggtttaacggttcggttacgaacggttacggggttaacggggggtttaacgttccgggggaaccggggtaaaccggggtaacccgttaaacggggttttacccggggtaaacccggtttcccgggtttaccggggtaacccggtaacccgggaaccccggttaaaccggggccccgtttccccggtaccccccccggtttcgggttaccccgtaccggttccccggtttacccccggg

SEQ ID NO: 88728 - DNA, 544 bp, Homo sapiens
  misc_feature: GYAE6OF01D9TDB.21.8.A08.1.454.CMB.1.raw
  modified_base (340)..(340): a, c, t, g, unknown or other
  misc_feature (340)..(340): n is a, c, g, or t
  modified_base (402)..(402): a, c, t, g, unknown or other
  misc_feature (402)..(402): n is a, c, g, or t
  modified_base (535)..(535): a, c, t, g, unknown or other
  misc_feature (535)..(535): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggacgattcattgaccaaaagtaatatacttgttggttccagcagaagtcaggccaggcccctgtactggtcatccatgaggccaggtcgacgacacgtccgggatcccgtgagagtacttcncgtcgccctccagctacgacgggacaggtcggacctaccttgactactcgaggtcgggaccngggtggacgatagaagctgacttatagttgttaccgcaccagacagtagtggtacagtcggtaggggtactcgggaggacggacgtaggttcgaccgtcgttgtcgacgcccgaggcctcggccccgtggtcncgtctcccg

SEQ ID NO: 88729 - DNA, 668 bp, Homo sapiens
  misc_feature: GYAE6OF01EES36.21.8.A08.1.454.CMB.1.raw
  modified_base (125)..(125): a, c, t, g, unknown or other
  misc_feature (125)..(125): n is a, c, g, or t
tcagtcgtcgctcgcacgaccggtgctcgatttagcatactctacagggggtgggctcaggaggcagagctctgggaatctcaccatggcctggacccctctcctgctccccctcctcactttcngcacagtctctgaggcctcctatgagctgacacagccaccctcggtgtcagtgtcccaggacagacggccaggatccacctgctctgcagatggactgaccaaaagaaatatgacttattcggtaaccaacagaacgccgaggccaggtcccctgtgtagtgatataataaagacacgtagagacggcctacaagagactcctggagtcgtattcgtcgtcggcctccgagcgtacgacggggacaggactaacggtctaacggtttacgactaacgttaccgaaggttacggtaaacgttacccgaagggaccgtaagggaacgggaacggagggacttacggtaacctttaagttaacgtacgtaacaaaaccgtaaggttaacgaacgtaggtaacggtaacggttaaccgttacgtacggtttggggttacgggttaccgggggtcgggaaaccgggtaccgaaacgggtcgttacggtaacccgttacgtaacgggtacaccggacccggaagtcccgtcccgcccccgttacccggg

SEQ ID NO: 88730 - DNA, 711 bp, Homo sapiens
  misc_feature: GYAE6OF01C4KQF.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacacgcccacccgtcggtgtcagtcgtccccgaggaacaaaccggccaggatccacctgctcgtggagtattcattcgaaccaaaagatatacttgttcgtcagcaagagtcgaggaccacggcccctgtacgtggtacatccagtcgacggccacggtacgacgacgaccgtccgggaactcccgtagagtacgtcttccgtctcgaccctacgacggtcctacggaacgggacctacgggtccggacccttaccgttacggaaccttacgtaccggtacgggtccggggacccggtagggtacggaacgtaacgtaggaacgtcgtacgtaacttacgttaacgtttacggtaaccgaccgaacgaacgtaacgtaggttacggtcggtaacgtacggtacgggtaacggggttacgtacggggacgggtaacgggtaccgtaacggttccggtacccggttcggttacgggtaccgaccgggtacccggtacggtaccccgtcccggtacccccgttcgggtaccctaccgttcccggttcccccgg

SEQ ID NO: 88731 - DNA, 785 bp, Homo sapiens
  misc_feature: GYAE6OF01AUXOG.21.8.A08.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccagggatcacctgctctggagattcattcgaccaaaagtatatacttgttggttccagcagaagtcaggccaggcccctgtactggtcatccagtgacgccagtcgacgacacgtccgggatcccgtaggagagtactttcnctacggtccctccgaaggtccgttacgaaggggtacctaagggttccggtaccctaccgtttagggaaccttacgttaccggtaacggggttacccggggggaccccgttaacggggttaccgggtaaccggtaacggttacgggtaaacggtaccgttaccgggtaaaccgtttaaaccgttaacgttttaaccggtttaaccccgaccgttaaaccccggtaacgtaacccggttaaagggtttaaccgggttcgggttaacccgtaacggttaccgggtaacggggggtttacgttacccgggggacggggtaaaccggggtaacccgtaaacgggttaccggtacccggttcccggttagggtccgtaaaccggaccccggtaaagggtcccgtacccgggtacccccggttacgggtaccctaccggttccgttaccccgg

SEQ ID NO: 88732 - DNA, 774 bp, Homo sapiens
  misc_feature: GYAE6OF01C3V5F.21.8.A08.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccacctggtgtcagtcgtcccaggacaaacggccaggatcacctgctctggatattcattcgacaaaagatatacgttgttggtcagcagaagtcacggcacggtccctgtactggtcatccatgacgccagtcgaacgacacgtccgggatcccgtaggaagngtaactttcctcgtcgtacccctccgtaaggtcttacgaacggggactacgggttccgggacccctaaccgtttaggaaccctttaacgtccggtacgggttaccgggggaccccgaagggggtttacgggaaaccggtaagttacgggaaacggtaccgttaacgggtaacctttaaacgtttaacgtttaccggtttaaaccggaccctaaccggaacggtaacgtaaacggtttacggtacgggttactaacggttcgggttaaacggggggtttaacggttccggggaacggggtaacgggtaaacccggtaaagggtttaccggaacccggtttaccgggttacggttacccggtaaccgggtaacccccgtaggggtaccccgttccccggtacccccccggtttaggtaacccgtaccccgttccgtttaacccccggg

SEQ ID NO: 88733 - DNA, 569 bp, Homo sapiens
  misc_feature: GYAE6OF01BYBLY.21.8.A08.1.454.CMB.1.raw
  modified_base (219)..(219): a, c, t, g, unknown or other
  misc_feature (219)..(219): n is a, c, g, or t
  modified_base (320)..(320): a, c, t, g, unknown or other
  misc_feature (320)..(320): n is a, c, g, or t
  modified_base (355)..(355): a, c, t, g, unknown or other
  misc_feature (355)..(355): n is a, c, g, or t
tcagtcgtcgctcgcacgaccggtgctcgatttagcatactctacagggggtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatccacctgctctgganattcattgaccaaaagatatacttgttggtccagcagaagtcaggccaggccctgtactggtcatccatggaggccagtcgacgacacgtccgggatcccngagagtacttctctgccctccagcctcgagggacngtcggcccacctttgactatcgagggtcgggcccgtagggtggaacgataggaatcgtaggtactacgttatttcgttacgcaccagacagttagtgtacagtcgtagggggttattcgggcggacggacctaggttcgaccgtccgttggctaggcccgaaggccctcggtccccccgtgggtccctacttccgtccgttccccctacccccg

SEQ ID NO: 88734 - DNA, 519 bp, Homo sapiens
  misc_feature: GYAE6OF01A98NL.21.8.A08.1.454.CMB.1.raw
  modified_base (220)..(220): a, c, t, g, unknown or other
  misc_feature (220)..(220): n is a, c, g, or t
  modified_base (491)..(491): a, c, t, g, unknown or other
  misc_feature (491)..(491): n is a, c, g, or t
  modified_base (512)..(512): a, c, t, g, unknown or other
  misc_feature (512)..(512): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactggtcatccatgacggccagtcgacgacacgtccgggatcccgtagagagattctctgccctccagcctcgagggacaggtcggccctaccgttgacttatcgaggtcggggcccaggtggacgagtgaagctagactactagttacgtacgcaccagacagtagtgtcagtcgaggggtatcgggcggaggacagtcgaccgtcgtggcncgccgagctcgcccctgtccnctctccg

SEQ ID NO: 88735 - DNA, 661 bp, Homo sapiens
  misc_feature: GYAE6OF01CROJQ.21.8.A08.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngtctctgacgcctctatgagctgacacacgcccacccgtggtgtcacggtcgtccccgaggaacaaccggccaggactcacctgctcgtggagattcattcgaaccaaaagatatacgttgttcgtaccagcagaacgtcgacggccacggtcccctggtacctggtaccatccagtcggacgccacggtcgaacgacaccgtccgggaactcccgtaggaagacgtaacttccgtcgtaccgtccctaccgagtcctacggaacgggactacgggtcgaccccttagttcggacttacgtaccggtacgggtccggggacccgtagggtacggaacggtagtacggaaagtcgtagtaaccttagttacgttacggttaccgacaacgacgtacgaaggtgtcggtacagtcgggtagggttacgtcgggacggtaacggaaccgtacggttacgacccgttcggttacggaccgacgacccgaaggcccgtccgtaccccgttacgccgtccgttccgttccccg

SEQ ID NO: 88736 - DNA, 618 bp, Homo sapiens
  misc_feature: GYAE6OF01EFUOV.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcacctgctctgganattcattgaccaaaagatatacttgttgttccagcagaagtcaggccaggccctgtactggtcactccagtgacggccaggtcgacgacaccgtccgggactcccgtagagagtacttctctcgcctcagcctcgaggacaggtcggccctacgttgaacttatcgagggtcgggacccgagggtcggacgtagtagaagcgtagacctattagtttgtacgacaccgagacgtagtagtcggtacagttacgggtaggggttacgttcgggacgggacgggaccgtaaggttaccggtacccggttccggttcgggtaccgacggtaccccggtaacggtcccgtcccggccccccgttcggtaccctacccgtttccgttcccggttcccccgtcccccg

SEQ ID NO: 88737 - DNA, 703 bp, Homo sapiens
  misc_feature: GYAE6OF01DCNVH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtggtgtcagtcgtccccgaaggaccaaaacggccaggactccacctgctcgtggatattcattgaccaaaagatatacttgttgtccagcagaagtcacggccacggcccctgtactggtcatccatcgagccagtcacgacaccgtccgggactcccgtagagtagtctttctccgtacgcccctccgaacgccgtcgaacggggactacggtccgggacccctaccgtttacggacttaacgtccgaagggtccggggaccccgtaaggggtacgggaacggtaagtaaggaaaccgtcgttaacggaacctttaacgttaagtttacggtttaaccgaccctaaccgaacgtaacgtaggtacggttaggtaccgtagttacgggtagggggttaacgttccggggacgggtaacggtaccggtaaaggttccggtaaacccggtttcgttacgggaccgtaccggaccccgtaagggtcccctaccgggtccccccgtacggtacccttccgtcccgttacccccgg

SEQ ID NO: 88738 - DNA, 646 bp, Homo sapiens
  misc_feature: GYAE6OF01A6T18.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtgganattcattgaccaaaagatatacttgttgtccagcagagtcaggccacggcccctgtactggtcatccatggacgccagtcgacgacaccgtccgggactcccgtgagagtactttctctcgccctccgagtccgtacgacggggacaggtccggccctaaccgttcggaacttagtcgtagggtccggggaccccgtagggtacggaacggtagtacggaagtccgtagtaactttaacttagtttacggttaccgccaacccgagaactaagggttaagtcggtacgtagttacgggtagggggttacgttaccggggcgggtaacgggaccgtaacggttcggtaacccggttccgttggaccgacggacccgaacgggtccgtacccggtccccgtacggtcccgtcgttcccgttcccgg

SEQ ID NO: 88739 - DNA, 602 bp, Homo sapiens
  misc_feature: GYAE6OF01EHF2E.21.8.A08.1.454.CMB.1.raw
  modified_base (304)..(304): a, c, t, g, unknown or other
  misc_feature (304)..(304): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgcttcttttaagaggtgtccagtgtcaggcgcaacgtggtggagtcgtggggggagcagtggtccagcctggggacggtccctggagcctctcctgtgcagcgtctggattcagtatcggcttcctttgccatgcacgttgggtccnccaggcctccgaggcgaaggggctgggagtggggtgcgtattatcgtggtatggatgggaagtgagagattattatcagtacgtcggagaacgggcctattccacctatcctacagacacaatcgaccaaacaacacactgtactctacaaagtcgaccgtctagacgacgaccgaggaccgacggtacttagtacgttaacgtttacgtaggttacggtacggttccgttttacgggtacgttacggtttccggggggaacccttaaccgggggtaaccccgttggggttaaccccg

SEQ ID NO: 88740 - DNA, 571 bp, Homo sapiens
  misc_feature: GYAE6OF01AX3F1.21.8.A08.1.454.CMB.1.raw
  modified_base (219)..(219): a, c, t, g, unknown or other
  misc_feature (219)..(219): n is a, c, g, or t
  modified_base (560)..(560): a, c, t, g, unknown or other
  misc_feature (560)..(560): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagatatacttgttgttccagcagaagtcaggccaggcccctgtactggtcatccatgaggccagtcgacgacacgtccgggatcccgtagacgagtactttctctacgccctccgagtcctacgacgggactaggtcggcctaccgttgacttactcgacggtcgggccgaggtcggacgagtagaacgcgtagactactagttacgtacgcacgagactagtagtggtactagtacggtaggggttacgtcgggacgggagggtaccgtaaggttcgtaccggttccgttaggcgacggcccgaaggccgtccgccccgtggtccncgtccgtcccg

SEQ ID NO: 88741 - DNA, 547 bp, Homo sapiens
  misc_feature: GYAE6OF01AMNEG.21.8.A08.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacacgtccgggatccctgagagattctctcgccctccagcctcgagggacagtcggccacttgactatcnggtgggcccgaggtcggacgatgagctgactactattgtacgcacagacagtagtggtcagtacgaggggttatcgggcggagggaccgtaggttcgaccgttccgttggaccgacggaccccgtaaggcccgttccggccccccgttcgggtcctaccgttccgttacccg

SEQ ID NO: 88742 - DNA, 663 bp, Homo sapiens
  misc_feature: GYAE6OF01CIGV2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcgatgtcagtcgtccccaggacaacggccaggatccactgctcgtaggagtattcagttcgaccaaaaagattaatactttgttggttccagcagaagtcaggccaggcccctgtacgtgtcatccatgacgccaggtcgacgacacgtccgggactcccgtggagtacgtacttccgttacgtcgtccctaccgtagccgtacgagggacctagggtcggaccctaccgttgaaccttcgtcgaggtcgggggacccctaggggtacggtaccgtagtacggaacgtcgtagtaccgttacctagtttacggttaaccgcaaccgtacgacgtaaggttaggcggttacgacgttacggtacgggggttacgttcgggacgggaacgggtaccgtaaggtttaccggcccggttccgttagggtcccggaacgtccccgggtaaaggtcccgttacccggtcccccgttacgggtcctccccggtttcccg

SEQ ID NO: 88743 - DNA, 593 bp, Homo sapiens
  misc_feature: GYAE6OF01EDXRG.21.8.A08.1.454.CMB.1.raw
  modified_base (220)..(220): a, c, t, g, unknown or other
  misc_feature (220)..(220): n is a, c, g, or t
  modified_base (472)..(472): a, c, t, g, unknown or other
  misc_feature (472)..(472): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggactcacctgctctgganattcattgaccaaaagatatacttgttgtccagcagagtcaggccaggccagtgtactggtctatccagtgaggccagtccgacgacacgtccgggatcccgtgagagtattcctcgtcgccctcgagctacggacgggacaggtcggaccctacgttagactagtcgaggtcgggacccgagggtacggacgtagtaggaacgtctacgtactacttagttacgtacgccaacgacgacgtagtagtggtnagtcggtaggggttacgtcggggacgggtaacgggacgtaggttcgaccgttcgtcggtcacggcccgtaacggccgtaccggtcccccgtacgtacctaccgttccgttccgttcccccg

SEQ ID NO: 88744 - DNA, 778 bp, Homo sapiens
  misc_feature: GYAE6OF01ECO14.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgcccaggacaacggcaggatcacctgctctggagattcgattcgaccaaaagattatacgttgttggttccagcagaagtcaggccacgcccctgtactggtcactccagtcgacggccagtcgacgacacgtccgggatcccgtagacgacgactttccgtctcggccccttccgacgtccgttacgaacggggtacctacgggttccggaccctaacccgtttcgaaccttacgtacggtaacgggttccgggggaccccgtaggggttacgggaaccggtaacgttacggaaacggtccgttacggtaacctttaacgttaagttttacggtttaaccggacctaacccgaacggtaaccgtaagggttacgggttacgggttaccgtaacggtttaccgggtaacggggggtttaacgtttaccgggggaccggggtaacggggtaacccgtaaagggtttccgggaaccccggtttaccggtttaccgggttaccggtaacccgggtacccccggtaaacggggtccccgttacccgggtaccccccccgtttacggggttccccttaacccggttcccgtttaccccccgg

SEQ ID NO: 88745 - DNA, 702 bp, Homo sapiens
  misc_feature: GYAE6OF01CP8H8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggacaaacggcaggatcacctgctcgtggagtattcattgaaccaaaagatattacgttgttcggttccagcagaagtcaggccacggcccctgtactcggtacactccatcggacgccagtcgacgaccaccgtcgggactcccgtgacgacgtacttctctacgtccctaccgaagccgttacggaagggtacctgggtccggacccctaccgttacgacttacgtcgtagggtccgggaccccgagggtacgggaacgtagtacggaacgcgttagtaaccgtaacgtttacgtacggttaaccgaccgtaacccgaagtaacgtaaggttacggttaggtactacggttacggggtaagggggttaacgttccgggggacgggtaacgggtaaccgttaacggttaccgggtacccgtttcggttacgggtacgacccggtacccgaaacgggtcccgtcccggtaccccccggttggttacccgtcccgttccggtttacccccgg

SEQ ID NO: 88746 - DNA, 657 bp, Homo sapiens
  misc_feature: GYAE6OF01EBFGI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggcctcctatgagctgacacacgcccaccgtcggtgtcagtcgtcccaggacaaacggcaggactcactgctctggatattcattcgacaaaagtatattacgttgttcgtacagacaaggaacgtcgacggccacggcccctagtacgtcggtcactccagtcggaccggcacggtccgaccggacctaccgtccgggtactcccgtaggagtaacgtactttccgcgtcgccctcgacgtccgtacggacgggtacacggtcggaccctacgttagaccttagtccggtagggtccggggaccgtagggtacggaacgtagtacggtaacgtcgttagtaaccttacgttaacgtttcggtaccgaccgtaacctagacgtaagttaggtcgtacacggttacgggtaggggttacgttcgggacggtacggacggtacgttcggtaacccgttcggtagtaccgacgtacccgacggtcctccgtccccgtagtcctccgttccgttcccg

SEQ ID NO: 88747 - DNA, 807 bp, Homo sapiens
  misc_feature: GYAE6OF01CUCZ6.21.8.A08.1.454.CMB.1.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacgcctctatgagctagacacacgccctaccgtggtctcagtcgtccccgaaggaaccgaaaccggccaggactccacctgctcgtggatntcattcgaacaaaagtatnttagttgttcgtaccagcagaacgtcgacggccgacggtccctagtcgtcgtcatccagtcggacggccaggtccgaacgaccgtaccggtcccgggactcccgtaggaacgtagtacctttctccgtcgtaccctaccgacgtcgtacgggaacgggtacgtacggttaccggaaccccttacgttacgtaaccttagtaccggtaacggggtcccggggacccgtaaggggtacgggaacgtagtaacggaacgtcgtaacgtaaccgttaacgttacgtttacgtaccgaccgtaacgtaacggtaacgttaggtaacggttcggttaacgtacggtaaccggggttaagggggttaccggttaccggggacgggggttaaaccggggtaaccggttaaaccggggttacccggttaacccggggtttacccggtttacggggacccggtaaacccgggtaccccggtaaacccgggtcccccggttaaccccgggttccccccggttaccgggtttaccccgtaccccggtttccccggtttaccccccgg

SEQ ID NO: 88748 - DNA, 532 bp, Homo sapiens
  misc_feature: GYAE6OF01BP5VP.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggccctgtactggtcatccatgaggccagtcgacgacacgtccgggatccctgagagattctctgccctcagcctcgagggacaggtcggcctaccgttgactatcgacgggtcggggacccgagggtcggacgagtgaagctagactacttattgttacgcaccagacagtagtgtcagtcggaggggttatcgggacgggagggaccagttcgaccgttcgttggtcagcccgaggctcgcccctcgtcactctcgtccctacccg

SEQ ID NO: 88749 - DNA, 543 bp, Homo sapiens
  misc_feature: GYAE6OF01A2SJT.21.8.A08.1.454.CMB.1.raw
  modified_base (401)..(401): a, c, t, g, unknown or other
  misc_feature (401)..(401): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgacggccagtcgacgacactccgggatccctgacgagtattctcgtcgcctccagctcgagggacagtcggcctaccttgactatcgaggtcggggcccagggtggaacgtntggaagctgaacttatagttgttacgcacagacagtaggtggtacagtcggaggggttacttcgggcggagggaactaggttcgacgttccgttggcgacgcccgaaggcctccggtccccgtacggtccacgtcgtccccg

SEQ ID NO: 88750 - DNA, 638 bp, Homo sapiens
  misc_feature: GYAE6OF01C2YVF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccaccctcggtgtcagtcgtccccgaaggaccaaacggccaggactcacctgctctggatattcagttcgaaccaaaaagattattacgttgttcggttaccagcaagagtcgacggccgacggcccctgtacgtggtcatccagtgacggccagtccgacgaccaccgtaccgggactcccgagacggtagtactttctctcgccctcacgctcgaggacacggtcgcctaccgttgacttgcgacggtcggggaccaggggtcgaacgtataggaacgtcgtagtacttacgttagttacggttaccgactaccgaagtactaggttacggtgtacgtagtcgggtaaggggttacgttcggggacgggtacggtaaccgtaaggttccggacccggttacgttcgggtacgaccggacccggtaaggcccgtaccggtcccctacggtacctcccgttccgttaccccg

SEQ ID NO: 88751 - DNA, 624 bp, Homo sapiens
  misc_feature: GYAE6OF01D4VJN.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatcccgtgagagacttctctcgccctccagctacgagggacaggtcggcctaccgtttgacttagtcgaggttcggggacccgagggtacgggacgagtaggaacgcgttagaacttacttagtttacgttaccgcaaccagacaaggttagtcggtacgtagttcggaagggggttacgttaccgggacggggaacgggtaacccgtaagggttcggtacccggttccgtttacgggtaccgtacggaccccgtaagggcccgttcccggaccccccggttcggtcccgtaccgttcccgttaccccgg

SEQ ID NO: 88752 - DNA, 768 bp, Homo sapiens
  misc_feature: GYAE6OF01DHXFB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctggtgtcagtcgtccccaggaacaaacggccaggactcacctgctcgtggagtatttcattcgaaccaaaaagtaatacttacgtttggttcggttacccaagtccgaaggtaacgtcgaacgggcccgaaccggtcccccttaggtaccgttgggtaccctacgttacccaagttcggacggtacccgacggttaccggaaccgtaaccgtaccggttacccggggaacttcccccgtaggaacgtacgtacctttccgtccgtaccgtcccttaccgacggtccctacggacggggtactacgggttccggaccctacgtttagaccttacgtaccgtaggggtccgggacccgtagggtacggaacgtagtacggaacgtcgtacgtacttaacgttagttcgtaccgacctaacgtacgtaacgtagttacggtacggtactacggttacgggtaggggttacttcggggaccgggtaagggtacccttaggtacggtacccgttccggttagggaccgtaccggacccgtaaggtccccgttacccggaccccccgttacgggtacccttcccgttccggtttacccccgg

SEQ ID NO: 88753 - DNA, 844 bp, Homo sapiens
  misc_feature: GYAE6OF01D2M1S.21.8.A08.1.454.CMB.1.raw
  modified_base (123)..(123): a, c, t, g, unknown or other
  misc_feature (123)..(123): n is a, c, g, or t
  modified_base (169)..(169): a, c, t, g, unknown or other
  misc_feature (169)..(169): n is a, c, g, or t
  modified_base (212)..(212): a, c, t, g, unknown or other
  misc_feature (212)..(212): n is a, c, g, or t
tcagtcgtcgctcgcacgaccggtgctcgatttagcatactctacagggggtgggctcaggaggcagagctctgggaatctcaccatggcctggacccctctcctgctcccctctcactttcngcacagtctctgaggcctcctatgagctgacacagccaccctggtntcagtcgtcccaggacaaacggccaggactcactgctctgganattcattcgaccaaaaagtattatacgtttggttacggttccagacgaagaacgtcacggccacggcccctgtactggtacatccatcggagccagtcgacgacacgtccgggactcccgtaggacgacgtacttccgtctcgcccttacgacgtcctacggacgggacaggttaccggaccctaaccgtttaggaaccttacgtaccgtacggggtacggggtaccccgtaaggggttaccgggaacggtaacgtttaacgggaaacggtacgtaaccggtaaccgtttaacgtttaacgtttacggttaacccggtacctaaacccggtaacggtaaccggttaacgggttaacgggttacgggttaccgtaacgggttaccggggttaaacggggggtttaacgggttaccgggggtaaccgggggtaaccgggggttaaacccgtaaacgggtttacccgggtaacccgggtttacccggtttaaccggggttaaccgtacccgggttaaccccggaaaccgggttccccggttaccccgggttaccccccccggttacccgggtttaccccgttaaacccggtttccccggtttcccccgggtttccccccggtttaccccccccgg

SEQ ID NO: 88754 - DNA, 691 bp, Homo sapiens
  misc_feature: GYAE6OF01CA9XG.21.8.A08.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (337)..(337): a, c, t, g, unknown or other
  misc_feature (337)..(337): n is a, c, g, or t
  modified_base (395)..(395): a, c, t, g, unknown or other
  misc_feature (395)..(395): n is a, c, g, or t
  modified_base (533)..(533): a, c, t, g, unknown or other
  misc_feature (533)..(533): n is a, c, g, or t
tcagtcgtcgctcgcacgaccggtgctcgatttagcatactctacaggggtgggcgtcaggaggcagagctctgggaatctcaccatggccgtcgacccgtcctcctgctccccctccctcactttctgcacagtcgtcctgaggccctcctatggaggctgaccactagccacccctcgggtgtcgaacgtggtcccccaagggaccaaaacggcccngggtatccacccttggctacgttggaaggatttctattacgaccaaaaacgtaaattnttaccgttgtttcggttcgacgagacgtaaggtacgacgggtacccgaccggtcccggtnttaccgtgtacgatccgagtgacggccgagtcgacgacgaccttcgggcgtacccgtnggatattctcgtgcctccagccgtacggaggacgacgtcggccaaccgttgattacgcgtacggtcggggaccacgggtagggcgaacgttgaagcgtacgtacgtacgtattaccgttcgtaacgccgaacgtaacnggttaaacgtggtccgtagagggtacggtaaggggttcgtaacggggcgggtaacgtacgggtacgtacccgttacggttccggtcgaccgttacccggacggtccctcgggtaccccgtcccgttaccggccttccgttcccgtccgttacccccgg

SEQ ID NO: 88755 - DNA, 849 bp, Homo sapiens
  misc_feature: GYAE6OF01CXVEK.21.8.A08.1.454.CMB.1.raw
  modified_base (173)..(173): a, c, t, g, unknown or other
  misc_feature (173)..(173): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgagcctcctatgagctgacacacgccacctggtntcagtcgtcccaggacaaacggccaggactcacctgcctcgtaggagtacttcattacgaaccaaaaagtattacttacgtttggttcggttaccagtacaagtaagtaccgaacggcctaccgggcccccttaggtaccgttacggtacctaacgtcccctaaaggttcggaacgggtacccgaacggtttcccgggaaacgtaacccggtaacccggttccccgggggtaaaccttacccccggttagggaaggtaacgttaaccgtttccgttaccggtccggttacccccttacccgtaacggtcccttaccgggaacgggggtaaccctacgggtttaccggaccccgttaacccgtttttcggaaccgtttacgtaccggtaacggggttcccgggggaccccggttaaggggtacgggtaacggtaacggtacggaaacggtccgtacgtaaaccgttacgttacgtttacggtaccgtaccgaacccgaagtacgtaaggttacgtacggttacgtagtacgggttaaggggttacgttacggggaccgggtaacgggtaccgtaacgggttacggtaccccggtttacgttgggtaccgtaaccgggcccgtaacggtcccgttcccggtacccccgttggtacccctaccgttccgttacccccgg

SEQ ID NO: 88756 - DNA, 770 bp, Homo sapiens
  misc_feature: GYAE6OF01B2O6R.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggtcacggagtcacctacgtntctcggaggattactacttagtaccaaaacgaaaagtaattaactttacgtttgggtttaccgtacgacgtaacgaaggtaacgtacggaccgaccggaccccgtccgtacgtacggtcgtactaccacgtgtacggaccgacgtacggtaccggaaccaccgtaccgggaccgtaccctccgaggaaggaatttcctcctcgtccctccctagaccgtccgtaacgggaacgggtacgtacgggtcccgtaccccttacgtacgtacttaccgtacgggtacggggggtccccggaccggtagggggtacggaacgtcggtaaagggtccttaccggtaacgttaaccgtaagttttacggttaacggtacccaaccgtaaccgaacgtaagggtaagttcgggtaccgtacgttacgggtaacggggggtagggtttaccgggccggggaaggggtacccggaacgtttaacgggcccggtttaccgttcgggtacggacaccccggtacggacgtcctacccccggtccggtcgttacctcgtttccccg

SEQ ID NO: 88757 - DNA, 695 bp, Homo sapiens
  misc_feature: GYAE6OF01A204S.21.8.A08.1.454.CMB.1.raw
  modified_base (220)..(220): a, c, t, g, unknown or other
  misc_feature (220)..(220): n is a, c, g, or t
  modified_base (326)..(326): a, c, t, g, unknown or other
  misc_feature (326)..(326): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacagcccacccgtcggtgtcagtcgtccccaggaccaaacggccaggactcacctgctcgnggagattcattcgaccaaaagatatacgttgttgttccagcagaagtcacggccacggtccctgtactcggtcagtccagtcggacggtccgacgtcggacgaccnccgtccggactcccgtagacgtgtacttctcgtcgcctccgagtccgtacgaacgggacacggtaccgccctaacttcgtacttacgtcgtacgggtccggggaccgtaggggtcggaacggtagtacggacgtcgtacgtaccttaacgttacgtttacgtaccgtaccaacgaagtaacgtaggttacgttcggtacgtacggttacgggtaacgggggttagttccggggacgggtaaccgggtaaccgtacgggtttaccggtaccccgggttacggtttcggaccggtaaccgtacccgggtaacgtcccggttaccccggtcccccgttcgggttaccctaccggttccccgttacccccggg

SEQ ID NO: 88758 - DNA, 624 bp, Homo sapiens
  misc_feature: GYAE6OF01BN9TM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggactcactgctcgtggagtattcattcgaccaaaagattatacttgttgttccagcaagaagtcacggccacggcccctgtactggtcatccagtcggacggccgagtaccgacgacaccgtcccgggactcccgtagacgagtacttcgtctcgccctacacgctacgacggactacgtcgacctacgttagactatacgacgggtcgggacccgtagggtacggacggtataggaacgcgttagaacttacgtagtttcgtacgactacgagtacaagttaggtgtacgtacgtaccggtaaggggtacgtcgggacgggacgggtaaccgtaggttacggaccgttcggttacggtacgtccgacccggacgtccgtcccggaccccgttacggtccctaccgttcccgttaccccgg

SEQ ID NO: 88759 - DNA, 550 bp, Homo sapiens
  misc_feature: GYAE6OF01B3EO1.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggaccaaacggccaggatcactgctctgganattcattgaccaaaagatatacttgttggttccagcagaagtcaggccaggcccctgtactggtcatccatgaggccagtcgacgacactccgggatccctgagagattctctgccctccagctcgaggacagtcggcctaccttgacttagtcaggtcggggccagggtggacgagtgaagctgactatattcgtacgcacgagacagtagtggtacagtcgaggggttagtcgggacgggagggaccgtaaggttcggacccggttcgttgggtacgacgccccgtaaggcctccggccccccgttggtccctcgttccgttcccgg

SEQ ID NO: 88760 - DNA, 672 bp, Homo sapiens
  misc_feature: GYAE6OF01DRI8N.21.8.A08.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagtattcattgaccaaaagaatatacttgttggtcagcagaagtcaggccacggccctgtactggtcatccagtgaggccagtcgacgacacgtccgggatcccgtgagagtattctctcgcctccagcctcgaaggacnggtcggcctaccttgactatcgacggtcggggacccagggtacggacgagtagaacgctaggacttacgttagttacggttaccgacaaccgtagaccgtagggttaggtacggtacaggttaccggtaggggggttactttcggggacggggtacggggaaccgtaagggttccgggtacccggtttccggtttaccgggtaaccgtaaccgggaccccggtaaacggggttccccgttaccccgggtcccccccgtttacgggtacccctaccgtttacccccgtttcccggtttcccccccgttacccccccg

SEQ ID NO: 88761 - DNA, 603 bp, Homo sapiens
  misc_feature: GYAE6OF01BQ8T5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgacggcctcctatgagctgacacagcccacccgttcggtgtcagtcgtccccaggaccaaacggccaggactcacctgctcgtgggatacttcattgaccaaaaagaattatacttgttggttccagcaagaagtcgacggccacggtccccttggtacctggtaccagtccagtgacggccagtcgaacgacaccgtccgggatcccgtaggacgagtattcctcgtcgccctcagctacgagggacagtcggcctacgttcgactacgtcgacggtcgggaccgtagggtacgggacgagtggaatcgtagtacctacgttagttacgtacggctaccgacgacgtagttaggtacgtactagtacggtaggggtacgtcgggacggacgggtacgtagttcggtaccgttcggtgccgacgtcccgacggcgtcccggcccctaggtccacgttccgtccg

SEQ ID NO: 88762 - DNA, 556 bp, Homo sapiens
  misc_feature: GYAE6OF01CFCIP.21.8.A08.1.454.CMB.1.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (544)..(544): a, c, t, g, unknown or other
  misc_feature (544)..(544): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaacggccaggatcacctgctctggagattcattgaccaaaagatatacttgttggttccagcagaagtcaggccaggcccctgtactggtcatccatgacggccagtcgacgacacgtccgggatcccgtgagagtactttcnctcgccctccagctcgaggacnggtcgcctacttgactagtcgaggtcgggcccagggtcggacgagtgaagctagactactattgtaccgcaccgagactaggtagtcggtactagtcggagggggttactcgggacgggtagggaccgtaaggttcgacccggttcgttggcgtacggcccgaaggcctccggccccctggtccnccgttcgtcccg

SEQ ID NO: 88763 - DNA, 703 bp, Homo sapiens
  misc_feature: GYAE6OF01A668W.21.8.A08.1.454.CMB.1.raw
tcagtcgtcgctcgcacgaccggtgctcgatttagcatactctacagggggctgtgggctcaggaggcagagctctgggaatctcaccatggccgtggacccctctcctgcctccccctcctcactttctgcacagtctcgtgaggcctcctatgagctgacacagcccaccctcggtgtcagtcgtccccaggaccaaacggccaggatcacctgctctggagtattccattcgaccaaaagattatacttgttcggttccagcagaagtcaggccaggcccctgtacctggtcatccatgacgccagtcgacgacaccgtccgggactcccctaggacgtagtatttccgtctcggcccttccaggtcctacgacggggaccacgggtcggacccctaccgtttcgaccgttatccgtacggttcggggaccccgtagggttacgggacgtagtacgaacggtctacggtaaccttacgttactttacggttaaccgtaccaaccgtaacggactaagggttaacgttacggtacctagttaccggtaagggggttacgttccggggtacgggaacgggaacccgttaaacgggttaccggtacccgggttccgtttaggggtaccctacgggaccccggtaacgggtcccgttaccggacccccccgttcgggtcccctaccgtcccgtttacccccggg

SEQ ID NO: 88764 - DNA, 550 bp, Homo sapiens
  misc_feature: GYAE6OF01ENDQZ.21.8.A08.1.454.CMB.1.raw
  modified_base (222)..(222): a, c, t, g, unknown or other
  misc_feature (222)..(222): n is a, c, g, or t
  modified_base (435)..(435): a, c, t, g, unknown or other
  misc_feature (435)..(435): n is a, c, g, or t
tcagtcgtcgctcgcacgaccggtgctcgatttagcatactctacagggggctgtgggctcaggaggcagagctctgggaatctcaccatggcctggacccctctcctgctctccctcctcactttctgcacagtctctgaggcctcctatgagctgacacagcccaccctcggtgtcagtcgtcccccaggaccaaacggccaggatcacctgctctgganattcattgaccaaaagatatacttgttggttccagcagaagtcaggccaggcccctgtactggtcatccatgaggccagtcgacgacaccgtccgggactcccgtgacgagtacttctctcgccctcagcctacgagggacaggtcggccctacctttgactatcgaggtcggggcccagggtggacgagtgaacgctgactactattgtacncaccagacgagtagtgtctagtcgaggggtagtcgggcgggacgggaccaggttcgacccgttcgttcggtccacgtcccgaacggcctccgtcccccgtcggtcctccgtcccg

SEQ ID NO: 88765 - DNA, 701 bp, Homo sapiens
  misc_feature: GYAE6OF01A06LO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggatattcattgaccaaaagatatacttgttggttccagcagaagtcaggccacggcccctgtactggtcatccatgacgccagtcgacgacacgtccgggactcccgagacgagtacttcctcgtcgcccttcgacgtcctcgaagggacctagggtcggaccctaacctttgaaccttaacgtccgagggtccggggaccccgtagggtacgggacgaaggttacgaaacggtcgttagaaccttaacttacgtttacggttaaccgaccgtaaccgtaacggaaccgtaaggttacggttacggtacgtaacggtacggggttaacggggggttacgttaccggggacggggtaaacggggtaacccgttaagggtttacccggaacccggtttcccgttagggtacccgaaccggaccccggtaaggtcccgttacccggtacccccggttcggtaccctacccggttccgttcccccggg

SEQ ID NO: 88766 - DNA, 681 bp, Homo sapiens
  misc_feature: GYAE6OF01CG2PA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaacggccaggactcacctgctcgtggagtattcattgaaccaaaagaatatacttgttggtccagcagaagtcaggccacggcccctgtactggtcactccagtcgacggccagtccgacgacacgtccgggactcccgtagacgagtacttctctcgccctccgagctacgaggacagtcgacctacgttgactatcgaggtcgggcccgaggtcggacgtagtacggaagtcgttagaacctttaacgttacgtttacggttaacccgacctaaacccgtaacggtaaccgtaagggttaacggttcggtaaccgtaacggttaccgggtaaggggggttacgttccgggggaacggggtaacggggtaacccgtaaagggttccggtaacccggtttccggttagggtaccgtaccggaccccggtaacggtcccgttacccggtccccccgttcggtaccctaccgttcccgtttaccccg

SEQ ID NO: 88767 - DNA, 575 bp, Homo sapiens
  misc_feature: GYAE6OF01DL9BB.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcactgctctgganattcattgaccaaaagatatacttgttggttccagcagaagtcaggccaggcccctgtactggtcatccatgaggccagtcgacgacacgtccgggactcccagagagtacttcgtcctcgccctccagcctacgaggacaggtcggccctacgttgactatacgaggtcggggaccctagggtaggacgagtagaagctagacttacttagttcgttacgcaccagacgagtagtggtctagtcggaggggttacgtcgggacgggaaggtaaccgtaggttacggacccgttcgttgggacctcggacccgaaggtcccgtccgacccccttcggtacctccgttccgttccccg

SEQ ID NO: 88768 - DNA, 538 bp, Homo sapiens
  misc_feature: GYAE6OF01B25Q2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccctgagagattctctcgcctccagctcgaggacagtcgccaccttgactatcgaggtcgggccagggtcggacgagtgaagctagacttatagttgtacgcacagacgagtagtggtctagtcggtaggggttatcgggcgggaggaccgtaaggttcgacccgttcgttggtcacgacccgaaggcctccgcccccgttcggtcctaccgtcgtcccg

SEQ ID NO: 88769 - DNA, 646 bp, Homo sapiens
  misc_feature: GYAE6OF01CXR3G.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctgganattcattgaccaaaagatatacttgttgttccagcagaagtcaggccaggcccctgtactggtcatccatggacgccagtcgacgactacgtccgggatcccgtagagacgtacttctctcgtccctaccgagtcctacgaacgggactacgggttcgaccctaccgtttgaacttacgtacgtaacgggtccggggacccgaagggtacgggacgagtagaacgtcgtagaacttacgtagttcgttaccgacaccgagacgtagtaggtcgtacgtagtacggtaggggttacgttcgggacggtaaacgggaccgtaaaggttcggtaccccggtttacgttacggtaccggacggtaccccgtaaacgggcccgttacccggtacccccgttagggtaccctacccgttccgttacccccgg

SEQ ID NO: 88770 - DNA, 632 bp, Homo sapiens
  misc_feature: GYAE6OF01D68RQ.21.8.A08.1.454.CMB.1.raw
  modified_base (580)..(580): a, c, t, g, unknown or other
  misc_feature (580)..(580): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggaccaaacggccaggactcacctgctcgtggatattcattgaaccaaaaagtaatactacttgtttggttccagcaagaagtcaggccacggcccctagtactggtcatccagtgacggccagtcgacgacaccgtccgggactcccgtaggacgacgtactttcctacgtcgcccctaccgagtccgtacggaggactaggtccgaccctacttggaccttatcgaggtcgggcccgaggtcgggaacgtagtacggagtccgtagtacttacttagtttagtaccgacgaccagtacgtaagttacggtggtactagtacggtaggggttacgttacgggacgggacggtaaccgtaaggttccggtaccggttccgttgggtacncggacccgacggccgtccggcccccttcgggtccaccgttccgttaccccgg

SEQ ID NO: 88771 - DNA, 949 bp, Homo sapiens
  misc_feature: GYAE6OF01DNGEP.21.8.A08.1.454.CMB.1.raw
tcagtcgtcgctcgcacgaccggtgctcgatttagcatactctacagggggctgtgggctcaggaggcagagctctgggaatctcaccagtggcctggacccctctcctcgctccccctctcactttctgcacagtctctgacggtcctcctatgagctgacacacgcccacccgtggtgtctacgtcgtccccgaggaaccaaacggccaggactccacctgcctcgtggacgtacttcagttacgaaccaaaagtaactaattacgtttggttcgttacccagaccaaggtaacgtacgaacggcccgaaccggtcccgttacgtaccgttacggtacctaccgttaccgagttccggaacggtaccgtacggtaccgaacggaacccgtaaccggtccccggggtactaccccggtaggtaaccgtaagttccgttaccttacgtccgtacccgttacccgaacggtccgtaccggacgggtaacggtaccgtaccggtacccgttaaccgttacggaacctttacgtaccgggtacggggtaccgggtaaccccgggtaggggttaccgggaacgggtaaggttaaccgggaacggttaccgttaaccgtaaacccgttttaacgttaaccggttttacggtttaccccggaaccgtaaccggggtaacgtaaccgggttaacggttaacgggttaccggggttaaccttaaagggttcccgggggttaaaacggggggtttacggttacccggggggaacgggggttaaacccgggttaacccggttaagggggtttaaccccggtacccgggttttaaccgggttacccgggtaaacggtaaccccgggtacccgggttaaacggggccccctttacccgggttaccccccggggttaaccgttaccccgttacccgttacccgggttttaaccccccccggg

SEQ ID NO: 88772 - DNA, 699 bp, Homo sapiens
  misc_feature: GYAE6OF01BDKD1.21.8.A08.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctctatgagctgacacagcccaccctcggtgtcagtcgtccccaggacaaacggccaggactccacctgctcgtggagtattccattcgaaccaaaaagtatattacttgttcggtccagcagaagtcaggccaggccctgtacnggtcatccagtgacggccagtcgacgacacgtaccgggatcccgtagacgagtacttcctccgtcgcccctaccacgtcctacggaacgggactacggtcggaccctacgttcgaaccttagtccgtaacgggtccggggacccgtagggtcggacgtagtacggaacgtcgtacgtaccttacgttagttacggttaccgacctaaccgaacgtacgtaaggttaggtacggttactaaggtcgggtaacggggggttagttacccggggacggggtaccgggtaaccgtaacgggtttcccgggtaacccggttccggtttacggggactaacccggcccggtaaacggtcccgtaccccgtcccccgtcggtacccttacccggttccctcccgttccccccgtaccccg

SEQ ID NO: 88773 - DNA, 719 bp, Homo sapiens
  misc_feature: GYAE6OF01CFP8M.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcgggtcgtcgacggtccgtaccccgaagggaaccaaaaccgggccaaggactccaccgtgctcgtggagtattcagttacgaaccaaaagattatacgttgttggtacaagcagaagtcgacggccacggcccctgtactggtacactccagtcgacggccagtaccgaacgacaccgtccgggactccgagacgagtacttccacgtcgaccctcgacgtcgtacggacggtacacggtcgaccctacgttacgaacttacgccgtacgggtccgggacccgtagggtacggtacgaagtaggaacgtcgtacgtaaccttaacgttacgtttacgtaacccgtacgaacgtaacggtacgtaaggttacggttacggtacgtaacggttacgggtaacgggggtttaacggtaccggggaacggggtaacgggtaaccgtaacgggttaccggtaacccggttccggttaggtaccgacccggtacccgaacggtcccgttacccgcccccggttagtcccgtacccgttcccgttacccccg

SEQ ID NO: 88774 - DNA, 755 bp, Homo sapiens
  misc_feature: GYAE6OF01DAD37.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctagacacagcccacccgtcggtgtcagtcgtcccccgaaggaaccaaaacggccgaggactccacctgctcgtaggagtattcattgaaccaaaagaatatacgttgttacggtccagcagaagtcgaggccacggcccctgtacgtggtcaactccagtcgacggccaggtaccgacgaccgtaccggtccgggactcccgtaggacgtagtactttccgtaccgtccgtacccctacgtacgtaccgtacgggaaggggacctacgggtcccggtacccttaacccgtttacgaaccttacgtacggtacggggtcccggggtacccggtagggtacgggaacgtacgtacgggtaaacgtccgtagtaacctttaacgttacgtttacgttacccgaacctaaccggtaacgtaacgtacggtttaaggtccggttaacgtacggtaccggggtaacggggtcttacgggttaccggggacggggtaaccgggtaacccgttagggtaccgtacccgggttcgttacgggtacccgaaccggtccccggaaggtccccgtcccgtacccccggttacgtcccgcccgtttccccgg

SEQ ID NO: 88775 - DNA, 577 bp, Homo sapiens
  misc_feature: GYAE6OF01D32ZY.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaaagatatacttgttggttccagcagaagtcaggccaggcccctgtactggtcatccatgaggccagtcgacgacacgtccgggatccctgagagattctctgccctccagcctcgagggacaggtcggccctaccgttgaacttatcgaggtcggggacccgagggtcggacgagtaggaaagcgtagacttacgttatttgttaccgcaccagacagtagtggtactagtacggaggggttagttcgggacggtagggaccgtaaggttcggtaccgttccggttggtccgacgaccccgagggccgtccggtcccccgtacggtccctacgtccgttcccgg

SEQ ID NO: 88776 - DNA, 615 bp, Homo sapiens
  misc_feature: GYAE6OF01CXSIS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctagtactggtcatccatgagccagtcgacgacacgtccggatcccgtgagagacttctctgccctcagctcgaggacaggtcgccacgttgacttatcgaggtcggggcctaggtggacgagtgaacgcgtacgacttaacgttacgttacggttacgaccaaccgtaaggaacgtaggtaacggtcggttacctaggttaccggtagggggttaacgtcggggacgggtacgggtaccgtaaggttacggtacccggttccgttagggttaccgaacggtccccgtaagggtcccgtaccggtaccccccgttcggtaccctaccgttccgttccccgg

SEQ ID NO: 88777 - DNA, 753 bp, Homo sapiens
  misc_feature: GYAE6OF01D1ODF.21.8.A08.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagcatactctacagggggtgggctcaggaggcagagctctgggaatctcaccatggcctggaccctctcctgcctccccctctcactttctgcacagtctctgacggcctcctatgagctgacacacgccaccctggtgtcagtcgtcccaggacaaacggccaggactcacctgctcgnggatattcattgaaccaaaagtatatacgttgtcggtccagcaagaagtcgaggccacggtccctgtactggtccatccagtcggacgccaggtccgaacgacctcgtccgggactcccgtggacgtaacgtctttcgctacgccctacgagtcctcgaacgggacctaggtccggtacccaccgtttaggaacctacgtcggtaacggggtccggggaccccgtaggggttacgggaacccgtaaggtacggtaaacggcgttaacggtaacctttacgtttaggtttaacggttacccgaactaacccggtaaggtaacctaagggttacggtacggttaaccgtacggttacggggttaacgggggtttacgttaccggggacggggaacgggttaaaccgtagggtttaccggacccgtttcgggttacgggtacccaacgggtaccccgtaaggggtccccgttaccccggaccccccgtttacggtacccgttacccgtttcccggtttccccgttccccccgtaacccccggg

SEQ ID NO: 88778 - DNA, 773 bp, Homo sapiens
  misc_feature: GYAE6OF01CRNBZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctggtgtcagtcgtccccaggacaaacggccaggactcacctgctctggagtacttcattagaaccaaaaagtaatattacgttgtttcggttccaagtcaaggtaacgtcgacggccgacggtcccctagtacgtcggtacacgttccagtcggacggccaggtaccgacgactaccgtccgggacttcccgtagaacgagtactttccgtactcgtccctaccgacgtccgtacggaacgggacgtacgggtccgggaccccttaaaccgtttcggaacgtttaacgtaccggtacggggtccggggggtaaccccggtaggggtccggggaaacgtacggtaacggaacggtccgtacgtaaccgtttaacgttaacgtttcggttaacccgaccgtaacgaacgtaacggtaaggttagggtacggtacgtaacgtacgggttaacgggggttacgtacgggggaccggggtaaacgggtaccgttaaacgggtttacgggtaccccggtttccggttaggtacccgaaccgggtacccgtaaacgggtcccgttaccccggtccccgtcgggtaccctccgttcccggttacccccg

SEQ ID NO: 88779 - DNA, 713 bp, Homo sapiens
  misc_feature: GYAE6OF01D70GP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggactcacctgctcgtggatattcagttacgaaccaaaaagtaattattacgttgttggttccagcagaagtcaggccacggcccctgtactggtcatccagtgacggccagtcgacgacacgtccgggactcccgtagagacgtacttcctctcgtccctccgagtcctacggaagggacacggtcggaccctacgttagactagtcgagggtccggggacccgtagggtacggacgtagtaggaacgtcgtacgtaacttaacgttagtttacggttaaccgacgtaacctaacgacgtaaggttacggttacggtacgtaacgttaccggggtaaggggttaccgttacgggggaccgggtaacgggtaacccgttaacggttccgggtaccccggtttccggtttacgggtacccgtaaccgggtacccccggtaaagggtccccgtaccccggttacccccccggttaccggtaccccgttacccgttcccgtttaccccccgg

SEQ ID NO: 88780 - DNA, 596 bp, Homo sapiens
  misc_feature: GYAE6OF01D9V17.21.8.A08.1.454.CMB.1.raw
  modified_base (221)..(221): a, c, t, g, unknown or other
  misc_feature (221)..(221): n is a, c, g, or t
  modified_base (579)..(579): a, c, t, g, unknown or other
  misc_feature (579)..(579): n is a, c, g, or t
tcagtcgtcgctcgcacgaccggtgctcgatttagcatactctacagggggctgtgggctcaggaggcagagcggtctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgacaaaagaatatacttgttggttcagcagaagtcaggccaggccccctgtactggtcatccagtgaggccagtccgacgacaccgtccgggactccctggagagtacttctctcgccctccagcctacgaggacaggtcggacctaccttgactatcgaggttccgggaccagggtacggagagtaggaagcgtagactacgttgtagttaccgcacagactaggtagtggtactagtacggagggggttattccggggagggacggtaaccgtaagggttccgacccggttccttagggtaccgaccggtaccccgaaggcccgttccggaccccccgttacggttccnccgtttccgttccccgg

SEQ ID NO: 88781 - DNA, 688 bp, Homo sapiens
  misc_feature: GYAE6OF01DZBRL.21.8.A08.1.454.CMB.1.raw
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccaccctcggtgtcagtgtccccaggacaaacggccaggactcacctgctctggagtattcattcgaaccaaaagaatatacttgttgtccagcagaagtcaggccaggcccctgtactggtcatccagtcgaggccaggtcgacgacacgtccgggactcccgtagacgagtactttcnctcgccctaccagctcgaggacncgtcggcctacgttcgactacgtcgacgggtcgggaccgtagggtcgggaacgagttacggaaacggtccgttacgtaaccgtttaacgttaacgttttacggttaccgtacctaaccgtaacggaacgtaagggttaacgggttcggtacgtaagttacggggtaagggggtttacgtttaccggggaacggggaacgggtaacccgtaaacgggtttccgtaccccggttccggtttgggacccgtaaccggaccccgtaacgggcccggttccccggccccccggtttaccgggcccttccgttcccgtttcccccgg

SEQ ID NO: 88782 - DNA, 674 bp, Homo sapiens
  misc_feature: GYAE6OF01DNOEX.21.8.A08.1.454.CMB.1.raw
  modified_base (174)..(174): a, c, t, g, unknown or other
  misc_feature (174)..(174): n is a, c, g, or t
  modified_base (342)..(342): a, c, t, g, unknown or other
  misc_feature (342)..(342): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagccaccctggtntcagtcgccccaggacaaacggccaggactccacctgcctcgtggatattcattcgaaccaaaaagatattacgttgttacggtccaagcaagaacgtcgacggccacggcccctagtactggtacatccatcgagccagtccgacgacacgtccggactccgtaganacgtacttctctcgcctccagctacgacggtacaggtcgacctacttgaacttcgtacgtaacgggtccggggaaccgtagggtacggaacgtagtaacgaaacgtccgtaggtaaccttaacgttagttacgttaaccgctaacccgaagtacgtaaggtaggttacggtacgtaacgtcgggtaacggggttacgttccggggaacgggttaaccgggtaaccgtaacgggtttccggaacccgggtttccgttagggtacccgaaccggacccggtacggtacccgttcccggtacccccgttgggtaccctcgttcccgttacccccg

SEQ ID NO: 88783 - DNA, 654 bp, Homo sapiens
  misc_feature: GYAE6OF01AIXF2.21.8.A08.1.454.CMB.1.raw
  modified_base (170)..(170): a, c, t, g, unknown or other
  misc_feature (170)..(170): n is a, c, g, or t
  modified_base (344)..(344): a, c, t, g, unknown or other
  misc_feature (344)..(344): n is a, c, g, or t
tcagtcgtcgctcgcacgaccggtgctcgatttagcatactctacagggggtgggctcaggaggcagagctctgggaatctcaccatggcctggaccctctcctgctcccctctcactttctgcacagtctctgaggcctcctatgagctgacacacgccaccctcggtntcagtcgtcccaggacaaacggccaggatcacctgctctggatattcattcgaccaaaagtattatactttggttcggttccagcagaagtcgacggccacggccctgtactcggtcactccagtggacgccacgtcgacgacaccgtccggactcccgagagagtacttctcncgtcctccgagtcctacgacggacctaggtcggaccctacgttacgacttacgtacgtacggggtccgggacccgtagggtcggaacgtgtacggaacgtctacgtaaccttacgttacgtttcggtaaccgacctaaccgtaacgtacgtaagtacggttcgtacgtaacggtacggggtacggggttacgttacggggacgggaacgggtaccgtaagggttccggaccgttacggtacggtcgaacggtaccgacggtccgtaccggccccgttacgtacctacctccggtccgttccccgtccccg

SEQ ID NO: 88784 - DNA, 704 bp, Homo sapiens
  misc_feature: GYAE6OF01B1O3T.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaacggccaggatcactgctcgtggatattcattacgaaccaaaagaatattacgttggttcggttaccagcaagaacgtcgacggccacggccccttgtacctggtcatccagtcgacggccagtccgaacgaccaccgtacccgggactcccgtaggaagtaggtactttcctcgtcgacccttccgagtccgtacgaacgggactacggtacggcccctacgttagaaccttagtaccgaggtacggggacccgtagggtacggaacgtacgtacggaagtcgtacgtaacttacgttagttacggttaccactaaccgacgtaacgtaggttaacgtcggttacgagttaccgggaaggggttcgttacgggacgggtaacggggtaacgtacgggttaccggtaccggttccggttagggtaccgtaccggccccggtaaacgggtcccgttaccccggtaccccccggttaccgggtacccttaccggttccccgtttaccccggg

SEQ ID NO: 88785 - DNA, 617 bp, Homo sapiens
  misc_feature: GYAE6OF01EFR5L.21.8.A08.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaacggccaggactcacctgctctggagattcattgaccaaaagatatacttgttggttccagcagaagtcaggccaggcccctgtactggtcatccagtggacgccagtcgaacgacacgtccgggatcccgtagagagtacttctctgccctcagctcgagggacnggtcgcctacttgactatcgaggtccggggccagggtcggaacgtagtaggaacgtcttacgtaacttacgttacgtttacgttaaccgaccgtaaccgagaacgtaggttacggtcggtacgtagttcgggtaagggggttatccggggacgggaacgggtaacgtacggttcggtacccggttcgttaggtaccgacgacccgtacggtcccgtcccggacccccgttcggtcctccgttcccgttccccgg

SEQ ID NO: 88786 - DNA, 636 bp, Homo sapiens
  misc_feature: GYAE6OF01BEQUO.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacacgccaccctcggtgtcagtcgtcccaggacaaacggccaggatcacctgctctggagtnttcattgaccaaaagatatacttgtgttcagcagagtcacggccacggccctgtactggtcatccatggacgccagtcgacgacgaccgtccgggactccctgagagtacttcgtctcgccttccagtccgtacgaacgggactacggtcggaccctaccgttgaacctatcgtacgggtccggggcccgtaagggtcgggacgtagtacggaacgtcgtagtaaccttacgttaagtttcgtaacgaccaccgaagtactagtacggtcgtacacggttacgggtaaggggttacgttcggggacgggacgggtaaccgtaaggttcgtacccggttcgttacggtccgaccgacccggtacggcccgtccggtcccccgtaggtccctaccttccgttcccgttccccgtaccccg

SEQ ID NO: 88787 - DNA, 565 bp, Homo sapiens
  misc_feature: GYAE6OF01EUU2K.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtgtccccaggacaaacggccaggatcacctgctctggagattcattgaccaaaagatatacttgttggttccagcagaagtcaggccaggcccctgtactggtcatccatgacggccagtccgacgacaccgtccgggatcccgtgagagtattctctcgccctccagtctcgagggacaggtcggaccctaccgtttgacttagtcgacgggtcggggcccgagggtcgggacgagtaggaagtcgtagactacttagtttcgtacgcaccgagacgagtagtggtcagtcggagggtagtcggacggacggacgtagtcgtaccggtcttggtacgcgacccgaaggtccgtccgtcccccgttggtccctccgtccgttcccg

SEQ ID NO: 88788 - DNA, 626 bp, Homo sapiens
  misc_feature: GYAE6OF01CXYVO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttggttccagcagaagtcgaggccaggcccctgtactggtcatccatgaggccaggtcgacgacacgtccgggactcccgtagagagtattctcgtcgccctccagcctcgaggacaggtcggcctaccttgacttagtcgtaggtcggggacccgagggtcggacgagtagaagcgtagaccttaattagttacgttaccgccaaccgaagaacgtaggttaaggtcggtctagttcggaagggggttacttcggggacgggtaacgggtaccgtaaaggtttcggaaccccggttccggttcgggtaccgaaccggccccggtaaaggtccccgttccggtacccccccgttcgggtcccctcccgtttccgttccccgg

SEQ ID NO: 88789 - DNA, 553 bp, Homo sapiens
  misc_feature: GYAE6OF01BIRJO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggccccctgtactggtcatccatgaggccagtcgacgacacgtccgggactccccgtgagacgtattctctcgccctccagctcgagggacagtcggccaccgttgactagtcgtaggtcggggacccgagggtcggacgagtgaagcgtagactacgtattgtacgcacagactagtagtgtcgtagtcgaggggtagtcggcgggaggacgaggttacggtaccgtccgttggtcacggacccgaaggccgtcgacccccgtggtcctacgtccgttcccg

SEQ ID NO: 88790 - DNA, 985 bp, Homo sapiens
  misc_feature: GYAE6OF01AX9ME.21.8.A08.1.454.CMB.1.raw
  modified_base (190)..(190): a, c, t, g, unknown or other
  misc_feature (190)..(190): n is a, c, g, or t
tcagtcgtcgctcgcacgaccggtgctcgatttagcatactctacaggggtgggcgtcgaggaggcgagagctctgggaatcgtcaccatggcctggacccgtcctcctcgcctccccctcccttccacctttcctcgtccacacgtctctgacggccctcctactgagctgacacacgccacctcggtntcagtcgtacccgaggacaaaccggccaaggatccgacctcgctcgtcggatacgttacacgttgaacccgtaaaaagtaacttaattaaccgttttgggttacgggtttaccctaagggaccgtaaaggtaaacggttacccgaagggacccggtaacccgggtcccccgtttacgggttaacgtttccgggggtcctaaaccttacccgtaaacggttggggaaccgggtacccgacgggttacccggaaacccggtaacccggtacccggttaccccggggggaccctttacccggttacgggaacgtaaaccggtttactccggttaccgttaccggccccctttacccggaaagtcccggtaccggtaacgggtaccgtagggtcccgggttaacccctaccgtttcggaaacccttagttaccggggaccgggttaccggggggtacccggtaacggggtaccggtaacggtacggttaacggaacgggttacctacgggttaacctttaaccggtttaacggttttaccgaaccggtttacccaaacccggttaaacgggtaacgttacccggggttaagggtttacggtaacggtcccggttaacggggtaacggggggttttcggaacccggggtacgggggtaaacgggaccgtttaacgggttacccggtccgggtttaaccggttccgggaccgtaccccgggtaagttacccggggcccttacccgggacccccggttcggaaccccgtttacgtccccgttccgggtttccccccgccccg

SEQ ID NO: 88791 - DNA, 640 bp, Homo sapiens
  misc_feature: GYAE6OF01BXFLJ.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttcagcagaagtcaggccaggcccctgtactggtcatccatgacggccagtcgacgacacgtccgggactcccgtgacgagtacttctctcgccctaccgagcctcgagggacagtcggcctacttgactagtcgaggtcgggacctagggtcggaacgtagtacggaagccgtagtaaccttaacgttagttttacggttaacccgactaaccgaacgtaacgtaaggttaggttacggtacgtaagttacgggtagggggttaacgttcggggaccggggtaacgggtaccgtaagggttccgggtacccgttccgttagggtaccgacggacccgtaacgggtccgtacccggtccccccgttcggtacccttccgttccgttccccg

SEQ ID NO: 88792 - DNA, 664 bp, Homo sapiens
  misc_feature: GYAE6OF01C6YJ8.21.8.A08.1.454.CMB.1.raw
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctctatgagctgacacagcccaccctcggtgtcagtcgtccccgaggaacaaaacggcaggactcacctgctctggatatcattgaccaaaagatatacttgttgtccagcagaagtcagccaggccctagactggacatccagtgacgccaagtcatgacaccgtcggactcccgngagagattcnctgcactcaagctacgagggacagtcgacctacgttgactagtacgaggtcggggacccgtaggtacggaacgtaagtacggaacgtacgtacgtaaccgttaacgttacgtttaacggttaaccgaccgtaaccgaaacgaaccgtaaggttaacgggtacggttacgtaacgttagggtaacgggggtttaacgtaccggggtaacgggtaccgggtaaaccgtaaagggtttacccgtaacccggttccggttacgggttaaccgaaccggaccccggtaaacgggtaacccgttcccggttaccccccgtcgggttcccgttaaacccg

SEQ ID NO: 88793 - DNA, 703 bp, Homo sapiens
  misc_feature: GYAE6OF01C7NFH.21.8.A08.1.454.CMB.1.raw
  modified_base (371)..(371): a, c, t, g, unknown or other
  misc_feature (371)..(371): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcacgtcgtaccccgaggaaccaaaccggccaggactccacctgctcgtaggatattcattacgaaccaaaagacttatacgttgttcggtaccagcaagacgtcgacggccacggtcccctgtacgtggtacactcagtggacgcagtccgaacactaccgtccggactccgtagacgagtcttcctcgcnccctacagtccgtacggaggactacggtccggacctacgttagacttacgtcgaacgggttccgggacccgtaggggtaacggacgtagtaacggaacgtccgtaacgttaaccgttaacgttaagtttaccgtaccgtaacccgaacgtagaacggttaacggtaggttccgtaacgtacggtacggggtaacggggttaacgtccggggaacgggtaaccgggtaaccgttacgggtaccggtcccggtttaccggttaggacccacgggtaccccgacgggttcccgtccccggtaccccgtccggtcctcccgttccgttaccccccg

SEQ ID NO: 88794 - DNA, 756 bp, Homo sapiens
  misc_feature: GYAE6OF01ETDSP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagattcattgaccaaaagatatacttgttggttccagcagaagtcaggccacggcccctgtactggtcatccagtgacggccaggtccgacgacacctccgggactcccgagagagtacttctctgccctccgagtctacgagggactaggtcggaccctaccgttcgaccttagtacgacgggttcggggccccgtaggggttcggaaccggtaagtagggaacgtaccgtagtaaccttaacgttacgtttacggttaaccgaccgtaacccgtaggtaaccgtaagggtttaacggttaccgggttacgtaacgttaccggggtaagggggggtttaacgttacccggggggaaccggggtaacgggggtaaaccccgttaaaggggtttacccggttaacccccgggtttacccggtttacgggggttaccccaacggggttaacccccccggtaaagggtaccccgggttccccggtaccccccccgttacccggggttacccttaacccccggttcccgttttccccccggg

SEQ ID NO: 88795 - DNA, 675 bp, Homo sapiens
  misc_feature: GYAE6OF01ECFKK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacattctctgaggcctcctatgagctgacacagcccaccctcggtgtcagtcgtccccaggacaaacggcaggatcacctgctctggagattcattgaccaaaagatatacttgttgttccagcagaagtcaggccacggcccctgtactggtcatccagtggacggccagtacgaccgactaccgtccgggactcccgtagagagtactttccgtcgtcgccctccacgcctacgagggactaggtcggccctaaccgttgacttagtcgagggtccggggcccgtagggtacggaacgtagtacgaaacgttcgacctttacttagttcgtttaccgcctaacgacgaacgtagttaggttacggtactaacgttcggtaagggggttacttcggggacgggtaacgggtaacccgtaacgggttccggtaacccggtttccggttacgggtacccgtaacggccccgtaaacgggtcccgttaccccggtacccccggttaccggtacccgtacccgtttcccgttcccggttacccccccg

SEQ ID NO: 88796 - DNA, 639 bp, Homo sapiens
  misc_feature: GYAE6OF01D1FK5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccgaggaaccaaaccggccaggactccacctgctcgtggagtattcattcgaaccaaaagaattatacgttgttggttaccagcaagaagtcaggccacggcccctgtacgtggtcatccagtgacggcagtcgacgacacgtccgggactcccgtagagtagtacttctctcgccctcagcctacgaggacgagtcgacctacgttgactagtcgaggtccgggaccgtagggtcggaacgagtaggaagtcgtacgtacgttaactacgtttacgtaccgacctaacgaagaacgtaggtagtcggtacgtagtacgggtaggggtacgttacggggacggtacgggtaaccgtacggttacggtacccgttcggttacggtacgaccggacccgtaaggtccccgttacccggtccccccgttacggtcctcccgttcgttcccccg

SEQ ID NO: 88797 - DNA, 510 bp, Homo sapiens
  misc_feature: GYAE6OF01EPHT2.21.8.A08.1.454.CMB.1.raw
  modified_base (221)..(221): a, c, t, g, unknown or other
  misc_feature (221)..(221): n is a, c, g, or t
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgccctccagctcgaggacagtcgccacttgactatcaggtcgggcccaggtggacgatgaagctgacttactattcgtacgcaccagacagtagtggtcagtcgaggggtatcgggnggaggactagtgaccgtcgtggcncgccgaggcctcgcccctggtccncgtcgtcccg

SEQ ID NO: 88798 - DNA, 375 bp, Homo sapiens
  misc_feature: GYAE6OF01D781Y.21.8.A08.1.454.CMB.1.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (340)..(340): a, c, t, g, unknown or other
  misc_feature (340)..(340): n is a, c, g, or t
  modified_base (374)..(375): a, c, t, g, unknown or other
  misc_feature (374)..(375): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtggtgtcagtcgtcccgaggaacaacggccagatcactgctcngganattcattgaacaaagatatacttgttcgtccagcagaagtcaggaccacggcccctagtcgtggtcatccagtcgacgctacgtcgacgacacgtccgggatcccgtagagtagtcttacncgtcgcctcgagcccgtacgaacgggactacggnn

SEQ ID NO: 88799 - DNA, 566 bp, Homo sapiens
  misc_feature: GYAE6OF01CB12H.21.8.A08.1.454.CMB.1.raw
  modified_base (373)..(373): a, c, t, g, unknown or other
  misc_feature (373)..(373): n is a, c, g, or t
  modified_base (554)..(554): a, c, t, g, unknown or other
  misc_feature (554)..(554): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctcgtggagattcattgaaccaaaagatatacttgttgttccagcaagaagtcaggccaggcccctgtactggtcatccatgacgccaggtcgaacgaccaccgtccgggacttccccgtagacgagtacttcctctcgtccctccgagcctacgaggacngtcgcctaacgttgactatcgaggtcgggccagggtcgacgtataggaactcgtagacttacgttagttacgtaccgcaacgagactagtacgtgtactagtcggaggggttactcgggacggaggactagtcggaccgttcgtaggtcacgcccgaaggccctccgtccccgtacggtcncgttccgtcccg

SEQ ID NO: 88800 - DNA, 685 bp, Homo sapiens
  misc_feature: GYAE6OF01D5OCI.21.8.A08.1.454.CMB.1.raw
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttggttccagcagaagtcaggccaggcccctgtactggtcatccagtgagccagtcgacgacacgtccgggatccctagagagattcncttgccctcagctacgagggacngtcggccctacgttgaaccttatcgaggtcggggacccagggtcggaacgagtaggaaacgtcgtacgtaacttacgttagtttacggttaccgaccgtaaccctaaggaaccgtaagggttaacggttcgggtacgtaagttaccgggtaaggggggttacgtttaccggggaccgggtaaacggggtaacccgtaaagggtttaccgggtaccccggttaccggttttacgggtacccgtaaacccgggaccccgtaaacggggtccccgttacccggtaccccccccgttacggggtaccccttacccgttccccgtttacccccgg

SEQ ID NO: 88801 - DNA, 832 bp, Homo sapiens
  misc_feature: GYAE6OF01CHWTP.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgcttcttttaagaggtgtccagtgtcaggcgcaacgtggtggagtcgtgggggagcagtggtccagccgtggggacgtccctgacgcctctccgtgtcgcaggccgttcgtggtacttcgaggttactccgggtccttccgtttgaccctagtcgcctacggtcggggtcccgccgacggtcctaccgagggccggaagggggtccgtaggggaggttggggtcggaccgtagtttacgttcgttgggtatggaagttgggaaagttggaaaggtagtaatttaacgtttacgttacgaacggtaccgttaccgggtagggtaaaccggggtcccgtaactttacccgaaccgttacgttaccctaacccggaaaggtaaccggaaacctaaacgttacccgaaaccccgtaaaaccaacccgtaaacctaccgtttaacgttaacctttaacccgttaacgaaaccgtttaccgggaccccgggtccgtacgggaaacggaccgggacccggaacgggtaaccgaccggggttaaccttacgttaacggtttaaacctttacggttacggttaaccggttaacgggtttcgttttaaccggggtaccgtttaacggggtttcccggggggaacccgtaacccggggggttaaacccccgttggggttaacccccg

SEQ ID NO: 88802 - DNA, 541 bp, Homo sapiens
  misc_feature: GYAE6OF01D8BMS.21.8.A08.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgacacagccaccctcggtgtcagtgtccccaggacaaacggccaggatcacctgctctggagattcattgaccaaaagatatacttgttgtccagcagaagtcaggccagcccctgtactggtcatcatgaggcaggtcgacacactccgggactcccgtagagagattctcgtcgcctccgagcctacgagggacaggtcggccctaaccgttgaactatcgacggtcggggaccctagggtggaacgagtaggaagctagactactagttgttaccgcaccagacgagtagtgtcatcggaggggtntcgggaggagggacctaggttcgaccgtcgttggtcacgacccgagccgtccgccccgtggtcctcgtcgtcccg

SEQ ID NO: 88803 - DNA, 568 bp, Homo sapiens
  misc_feature: GYAE6OF01D1DEK.21.8.A08.1.454.CMB.1.raw
  modified_base (221)..(221): a, c, t, g, unknown or other
  misc_feature (221)..(221): n is a, c, g, or t
  modified_base (375)..(375): a, c, t, g, unknown or other
  misc_feature (375)..(375): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcaggccaggcccctgtactggtcatccatgaggccagtcgacgacacgtccgggatcccgtgagagtattctctcgccctcagctacgagggacaggtcgcctacttgaactntcgaggtcggggacccgagggtaggacgagtagaagctagacttactagttcgtacgcacagacgagtagtgtactagtacggtaggggtatcgggacgggacgggacgtaggttcgaccggttccgttaggtccgacggacccgaacggtccgtccggtaccccccgtggtccctaccgttccgttaccccg

SEQ ID NO: 88804 - DNA, 791 bp, Homo sapiens
  misc_feature: GYAE6OF01A0NB2.21.8.A08.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagtattcattcgaacctaaaaaatttnttgttttttacggacctagcaagaagtcaggccacggccctgtgttggtcatccatgaggacgaggagaccgacccgtccgggactcccgtaggagacgtacttcgtcgtcggcctccgaaactcggacggggacggtcggaccgtacggttgtacgtttcgtacggtacgggtcgggggccccgtaggggtcgggtaacgggtagtaggaacggtcgttacgtaacgttaccgttaacgttacgttaaccgtacgtaacggtaccgaggtaaccgaggtactaacgggttacgggtacctaacggttaccggggacggggggtccgttaacggggtttccggggaccggggtaacgggggtaccccggttaaggggtttacccgggtaaccccgggttacccgggttaacgggtacccggtaaacccgggtaccccgggaaaccggggttccccgttacccggggtaccccccccggtttacgggttacccccgtaaccccggttttccccgtttccccgggtttcccccccggttcccccccg

SEQ ID NO: 88805 - DNA, 873 bp, Homo sapiens
  misc_feature: GYAE6OF01BJ4KX.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtacccaggaccaaacggccaggactcacctgcctcgtaggagtattcattcgaaccaaaaagtaatattacgttgttacggttaccagacaaggaagtcgacggccgacggcccctgtacgtcggtcatccagtggacgccagtccgacgaccacgtaccgggactcccgtagacgtacgtacttccgtcgtcgtccctcgaaggtcccgtacggaacggggtaacctacgggtacccgggaccccttaaccgttacggtaaccgttacgttaccggtaacgggggttccggggtacccccggtaaggggttaccgggaaaccggtaaggtacggtaaacggtcccgttaagggttaacccgtttaacgtttaacggttttaccggttaacccggtaaccgtaacccgtaaacggtaacccggttaagggttaaccgggttacgggttaaccgtaacgggtttaaccggggttaacggggggtttacggtttaccggggggaccggggttaaaccggggtaacccgttaaacgggggtttacccgggtaaccccgggttttaccgggtttaccggggtacccggtaaaccggttacccccgggtaaaccggggttcccgttacccccgggttaccccccggtttacccggttacccgtttaccccggttcccgtttaaccccccggg

SEQ ID NO: 88806 - DNA, 539 bp, Homo sapiens
  misc_feature: GYAE6OF01A1PT2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgacgccagtcgacgacactcgggactcccgtgagagactttctctcgccctccgagcctacgagggacaggtcggacctaccgttgacttatcgaggtcggggaccctagggtcggacgagtaggaagtctgaacgttactagttgtaccgcaccagactagtagtggtctagtcggtaggggtattcgggacggaggtaccgaggtcgacgtcgtggtcacggcctagcgtcgcccctgctcgtctccg

SEQ ID NO: 88807 - DNA, 589 bp, Homo sapiens
  misc_feature: GYAE6OF01CUC20.21.8.A08.1.454.CMB.1.raw
  modified_base (446)..(446): a, c, t, g, unknown or other
  misc_feature (446)..(446): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctggtgtcagtgtccccaggacagacggccaggatcacctgctctgcagatggactgaccaaaagtaaatatgtacttattacggtaaccaacagaacgccaggccaaggcccctgtcgttagtgaagttataataaaagacactggacgacggccctacagacgactcccgtagagtcgaatttctcgtgcctccagtcctacgaggacaggtcggaccctaccgttagacctagtccgagggtcgggcccgtaagggtggaacgagtagaacgntacgacttactaagttacgttaccgctaaccagacgtagttagtcgtacgtacgtacggaggggttacgtacgggacgggtaggaccgtaaggtcgtaccgtcgttggaccgtacgccgaacgtcgccgtccccgtggtaccc

SEQ ID NO: 88808 - DNA, 587 bp, Homo sapiens
  misc_feature: GYAE6OF01CBXWB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttgtccagcagagtcaggccaggcccctgtactggtcatccatgacggccagtccgacgacacgtccgggatcccgtagagtagtacttctctcgccctccagctcgaggcaggtcgcctacgttgactatcgaggtcgggccgagggtcggacgagtagagcgtagacttactagttcgttaccgctacgagtacgaggttagtcggtactagttcggtaggggttacgtacgggacgggacgggtaaccgtagggttaccgtacccggttccgttacgggtaccacggtacccgaacggtcctcccggtacccccgttcggtcctccgttccgttccccgg

SEQ ID NO: 88809 - DNA, 681 bp, Homo sapiens
  misc_feature: GYAE6OF01DBIBR.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccaccctcggtgtcagtcgtcccaggacaaacggccaggatcacctgctcgtgganacttcattgaaccaaaaagattatacttggttcgtaccagcagaacgtcaggccaggtccctgtactggtcatcatgacgccagtcgacacacgtcgggactcccgtagagagtcttccgtctcgcctacgagtcacggaaggactacgtccgggaccctaccgtttgaaccttgtacggtacgggtccggggacccgtagggtacgggaacgtagtacggtaacgtacgtacggactttaacgtagtttacgttacccgacgtaaccgaacggtactaagggttacggtacggtacgtacggtaaccgggttaagggggttaacggttccgggggaacgggtaacgggtaaccgtaacggttacgggtaccccggtttacggttacgggacgtacccggtacccgtaaggtcccgtcccggacccccgttcgggttaccctcccgttccgtttcccccgg

SEQ ID NO: 88810 - DNA, 619 bp, Homo sapiens
  misc_feature: GYAE6OF01DR1HL.21.8.A08.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggaaccaaacggccaggactcacctgctcgtgganattcattgaccaaaagatatacttgttgtccagcagaagtcaggccaggcccctgtactggtcatccatgacggccagtcgacgacaccgtccgggactcccgtgacgagtacttctctcgccctccgagtcctacgagggacaggtcggaccctacgttgactagtcgaggtcgggaccctagggtcggaacgtagtaggaaacgtcgttagtaaccttaacgttagtttacggttaaccgcctaaccgaagtaacgaggttaggtcggtactagtcgggtaaggggttacgttcgggacgggtacggaccgtaaggttcgacccggttcgttaggaccacggacccgtaagcccgtcccgcccccgttaggtccctaccgttccgttccccgg

SEQ ID NO: 88811 - DNA, 743 bp, Homo sapiens
  misc_feature: GYAE6OF01BUFY8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagattcattgaccaaaagaatatacttgttggttccagcagaagtcaggccaggcccctgtactggtcatccatgacggccagtcgacgacacgtccgggactcccgagagagtctttctctcgccctaccgagtcctacggaacgggactaacgggtccgggaccccttaaccgtttacggtaccttacgtaccggtacggggttcccggggggtaccccgtaaggggttacggggaacgtaagttacgggaaacgtccgttacgtaaccgtttaacgttaacgttttacggttaaccgacccgtaacccgaagtaaccgtaaggttacgggtacggttacgtacggttacgggtaaggggggtttacgttaccgggggaacggggtaacggggtaaccgttaaacgggtttccggttaaccccggtttccggtttacgggtacccgtaccgggaccccggtaaacgggtcccgttccccggaccccccgtttcgggtaccccttaccgttccgtttccccccg

SEQ ID NO: 88812 - DNA, 596 bp, Homo sapiens
  misc_feature: GYAE6OF01B1NUC.21.8.A08.1.454.CMB.1.raw
  modified_base (583)..(583): a, c, t, g, unknown or other
  misc_feature (583)..(583): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttgtccagcagaagtcaggccacggcccctgtactggtcatccagtgacggccagtcgaccgacaccgtccgggactcccgtgacgagtattctctcgtccctccgagcctcgaagggcaggtcgcctaccgttgacttagtcgacgggtcggggaccgtagggtcgggacgaagtggaagcgtagtaccttactagttcgttacgacgaaccgagaacagtaggttggtactacgtacggtagggggttacttacgggacgggaacgggtaccgtaaggttcggacccgttcgttggtaccgacgacccgacggcctccggcccccttaccgggtccnccgttccgtcccg

SEQ ID NO: 88813 - DNA, 594 bp, Homo sapiens
  misc_feature: GYAE6OF01AHAIZ.21.8.A08.1.454.CMB.1.raw
  modified_base (224)..(224): a, c, t, g, unknown or other
  misc_feature (224)..(224): n is a, c, g, or t
  modified_base (349)..(349): a, c, t, g, unknown or other
  misc_feature (349)..(349): n is a, c, g, or t
  modified_base (544)..(544): a, c, t, g, unknown or other
  misc_feature (544)..(544): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggaccaaacggccaggatcacctgctcgtgganattcattcgaaccaaaagatattacttgttggttaccagacagaagtcaggccacggcccctgtactggtcatccatgacggccagtcgaccgacacgtccgggactcccgtagagagtacttcnctcgcctccgagcctcgaggacaggtcgcctacgtgactatcgagggtcgggcctagggtcggacgagtaggaacgcgtacgtaacttacttagttcgtaaccgcaacgagctaaggtaggtacgtactagtcggtaaggggttacgtacggggacggacgggaactaggttccggacccgttccgttgggaccncggaccccgaaggccctcccgccccggttgtccctccgtccgttccccgg

SEQ ID NO: 88814 - DNA, 646 bp, Homo sapiens
  misc_feature: GYAE6OF01DCX3D.21.8.A08.1.454.CMB.1.raw
  modified_base (130)..(130): a, c, t, g, unknown or other
  misc_feature (130)..(130): n is a, c, g, or t
  modified_base (176)..(176): a, c, t, g, unknown or other
  misc_feature (176)..(176): n is a, c, g, or t
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
tcagtcgtcgctcgcacgaccggtgctcgatttagcatactctacagggggctggtgggctcaggaggcagagctctgggaatctcaccatggcctcggacccctctcctgcctccccctctcactttcngcacagtctctgagcctctatgagctagacacagcccaccctggtntcagtctcccaggacaacggccaggntcactgctcgtgganttcattcgacaaagatatactgttcgtanaagcagaacgtcagccagccctgtactggacatccatgacgcagtcgacgtacacgtcggatcccgtagaacgtagacttctctcgtccctacagtctacgaggacgagttccggacctacgttcggaacttagtccgtaacggttccggggacccgtagggtacggaccgtagttaggaaacgtctacggaacttacgttagttcggttaaccgtactaaccgaagtacgtaggttacggttcggtaactagtccgggtaagggtttacggtaccgggacggtaacgggtaccgtaaacgggtttcggaacccggtttccggtagggtacccgacggtaccccgaaaggtcccgtacccggtaccccggttggttaccctaccgttccgtttacccccg

SEQ ID NO: 88815 - DNA, 762 bp, Homo sapiens
  misc_feature: GYAE6OF01AC51W.21.8.A08.1.454.CMB.1.raw
tcagtcgtcgctcgcacgaccggtgctcgatttagcatactctacgagggggctgtgggctcaggaggcagagctctgggaatctcaccatggcctcggacccctctcctcgcctccccctcctcactttctgcacagtctctgacggcctcctatgagctgacacacgcccacccgtcggtgtcagtcgtaccccaaggaccaaacggccaggactccacctgctcgaggagtattcattacgaacctaaaagtattagttacgttggttcggttaccagacgaaggaacgtcgacggccgaccgtccccgtgtacgtgtacacgtccagtcgacgcgagtaccggacaaccgtaccgtaccgggactccgtaggaagcgtacttcctacgtccgtccctaccggagtccgtacggacggaacgtacggtaccggacccttaaccgttcgtaacgttaccgtacgggtacggggtaccggggtaacccgtaggggtaacggaaccgtaaggtacggtaacggtaccgtacggttaaaccttaacgtttacgtttaaccgacccgaccgaaccggtaagaacgttaggtaccggttcggtacgtaacggttacggggtaaggggttaccgtacggggacccgggtaaggtaacccgttacggtaccggtacccggtttccggttacggaccgtacccggacccggtaaccggtcccgttaccccggccccgttacgaccccttccgtttcccgttacccccg

SEQ ID NO: 88816 - DNA, 553 bp, Homo sapiens
  misc_feature: GYAE6OF01BCZC2.21.8.A08.1.454.CMB.1.raw
  modified_base (218)..(218): a, c, t, g, unknown or other
  misc_feature (218)..(218): n is a, c, g, or t
  modified_base (485)..(485): a, c, t, g, unknown or other
  misc_feature (485)..(485): n is a, c, g, or t
  modified_base (543)..(543): a, c, t, g, unknown or other
  misc_feature (543)..(543): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtcccaggacaaacggccaggatcacctgctctgganattcattgaccaaaagatatacttgttggttccagcagaagtcaggccaggcccctgtactggtcatccatgaggccagtcgacgacacgtccgggatccctggagagtattcctctcgccctccagccgtacgacgggaccaggtcggccctaccttgaactacgtcgagggtcggggccccgaagggtcgggacgagtggaacgtctagacttacttattcgttacgacaccgaagacgtagtagtggtctagtcggtaggggtntcgggacggagggactagtcgaccgtcgttgcgcgaccgaggcctcgccccgtgtccncgtcgtcccg

SEQ ID NO: 88817 - DNA, 709 bp, Homo sapiens
  misc_feature: GYAE6OF01CAY63.21.8.A08.1.454.CMB.1.raw
  modified_base (137)..(137): a, c, t, g, unknown or other
  misc_feature (137)..(137): n is a, c, g, or t
  modified_base (154)..(154): a, c, t, g, unknown or other
  misc_feature (154)..(154): n is a, c, g, or t
  modified_base (180)..(180): a, c, t, g, unknown or other
  misc_feature (180)..(180): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctctactttctgcacngtctctgacgcctctangagctgacacacgcccaccgtcggtntcagtccgacccgaggaacaaacggcaggactcaccgtgctgtaggactattcaattacgaacaaaaagtattattacgttgttacggtacagcaagaagtcgacggccacggtcctgtacgtgtacatcagcggacgcagtcgacgacacgtcggactccgagagacgtacttcgcgtcgacccgtacacgtcgtacggaacggtacgtacgggtacccggtacccttaaaccggttcgaaacgttacggttaccggaacgggggttacccgggggtaccggaaggggttacggaaacggtaagtacggaaacggtccgttaagggtaaccttaaacgttacggttaaccgtaaccgaacctaaccggaaaggtaaccgtaagggttacggtacggtacgtaacgggtacgggtaacggggttacgtaccggggaacggggtaacggaaccgttagggtccgtaccggttcgtacggacgaccggacccgaggcccgtaccgacccgttggacctcgtccgttccccg

SEQ ID NO: 88818 - DNA, 576 bp, Homo sapiens
  misc_feature: GYAE6OF01APALD.21.8.A08.1.454.CMB.1.raw
  modified_base (522)..(522): a, c, t, g, unknown or other
  misc_feature (522)..(522): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggccccctgtactggtcatccatgaggccagtcgacgacacgtccgggatccctgagagtattctctgccctccagctcgagggacaggtcggcccaccttgacctatcgaggtcggggcccgaggtcggacgagtgaacgctgactactagttgttaccgcaccgagacgtagttagtggtactagtacggtagggggttacgttcgggacgggacggaccgtaaggttcggtacccgttccgttgggtaccncggaccccgtaaggcccgttccggccccccgttccggcctccgtccgttcccgg

SEQ ID NO: 88819 - DNA, 660 bp, Homo sapiens
  misc_feature: GYAE6OF01AZ04L.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggcaggactcactgctctggagattcattgaccaaaagatatacttgtgttcagcagaagtcagccgaggcccctgtactggtcatccagtgacggccagtccgacgacacgtccgggactccctagagtacgtacttccgtcgtacgccctaccgacggtcccttacggaacggggtactacgggtcggtacccctaaccgtttgaaccgttacgttcgacgggtccggggaccgtagggtacggaacggtagtacgaaggtcctacgtaacttaacttacgtttacggtaccgactaaccgaacgtacgaggttaacggtacgtacgtacgtacgggtaaggggttacggtacgggacgggacgggtaacgtacggttaccggtacccggttcgttaggtaccgtaccgtacccgaacggtccgtcccggtcccccgtaggtccctccgttccgtccccgg

SEQ ID NO: 88820 - DNA, 567 bp, Homo sapiens
  misc_feature: GYAE6OF01D7ET9.21.8.A08.1.454.CMB.1.raw
  modified_base (557)..(557): a, c, t, g, unknown or other
  misc_feature (557)..(557): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatccctgagagatttctctcgccctccagcctcgagggaccaggtcggcccaaccgtttgaccttagtcgagggttcggggacccgtagggtcgggaacgagtaggaagtcgttagaacttaacttagtttgttaccgcaaccgagacgagtaggtggtctagtcgaggggtagttcgggcgggtacggacgtaagttcgaccggtcgttggcgacgcccgaggcctccgccccgtggtccncgtcgtcccg

SEQ ID NO: 88821 - DNA, 640 bp, Homo sapiens
  misc_feature: GYAE6OF01BNOKW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattcgacaaaagatatacttgttgtcagcagaagtcaggccaggcccctgtactggtcatccagtgaggccagtcgacgacacgtccgggatcccgtagagagtattctctcgccctcagtcctcgaggacacggtcgcctacgttgactagtacgaggtcggggaccagggtacggacgtagtagaaacgtcgtagtaacttaacttagttttacggtaccgacctaaccgaagacgtaggttacggtcggtacctaggttacgggtaaggggttacgttcggggaacgggtacgggtaaccgtaacggttcggtacccgttccggtttacggtaccgtaaccgggaccccgtaacgggtcccgttcccggaccccccggttacgggtccttacccgttcccgtttacccccgg

SEQ ID NO: 88822 - DNA, 592 bp, Homo sapiens
  misc_feature: GYAE6OF01EQWAQ.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctcgtgganattcattgaccaaaagatatacttgttggttccagcagaagtcaggccaggcccctgtactggtcatccatgacggccagtccgacgacacgtccgggatccctggagacgtattctctcgccctcagtctcgaggacaggtcggccctacttgactatcgaggtcgggccgtagggtcggacgagtagaacgctgaacttatagttcgttacgctaccagtacagtaggtgtacagttacggaggggttactcggggacgggacgggtaccgtaaggttcggacccgtttcggttggtaccgacggtaccccgtaaggtcccgtaccggtccccccgtacggtcccttaccgttcccgttacccccgg

SEQ ID NO: 88823 - DNA, 637 bp, Homo sapiens
  misc_feature: GYAE6OF01CKD1O.21.8.A08.1.454.CMB.1.raw
  modified_base (391)..(391): a, c, t, g, unknown or other
  misc_feature (391)..(391): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccgaggaacaaacggccaggatccacctgctcgtggagtattcattcgaaccaaaaagtaattattacgtttggtttacggttccaagtcagaagtcgaggccacggtcccctgtacgtggtacactccagtgacggccagtccgacgaccacgtccgggactcccgagagtagtacttcgtctcgccctcagtcacgaggacncggtcgaccctaccgttagacttacgtacgacgggtccggggacccgtaggggtacgaacggtagtagaacgtcgtactaacttacgttagttacgaccgaacgaacgaacgtacgtaacgttaggtccgtagtacgggtacgggttagggttacggtacggggacggtaacgacgttacggtcgttaccgtcggttgactaccggcgtacgcgtccccgtccgtaggtcctccgtccgttccccg

SEQ ID NO: 88824 - DNA, 609 bp, Homo sapiens
  misc_feature: GYAE6OF01DXM0F.21.8.A08.1.454.CMB.1.raw
  modified_base (174)..(174): a, c, t, g, unknown or other
  misc_feature (174)..(174): n is a, c, g, or t
  modified_base (188)..(188): a, c, t, g, unknown or other
  misc_feature (188)..(188): n is a, c, g, or t
  modified_base (313)..(313): a, c, t, g, unknown or other
  misc_feature (313)..(313): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgcttcttttaagaggtntccagtgtcaggcncaagtggtggagtcgtggggggagcagtcggtccagccgttggggacggtccctgacgcctctcctgtgcagcgtctggattcagtatcggtcttcctttgcctatcgctacgtcggggtacccnccgaggcctacccgagggccgtaagggggcctaggggaggtgggtgggtaccgtatttagtcgtggtactggaagtgggaagtgaagtagtatagtttatcagtacgtcgtaggaacggtcctagttacacctatcctacgaagaagacaagtcgaaccaacaacactacttgtacttactacgaaagtcgaccggtacgtggaacgcggtaccgagggaccacggtctagtacgttattacgtgtacgtgttcgttcgtacgtacgttcggggaacctacgggtcctggtacccg

SEQ ID NO: 88825 - DNA, 763 bp, Homo sapiens
  misc_feature: GYAE6OF01CLEGF.21.8.A08.1.454.CMB.1.raw
tcagtcgtcgctcgcacgaccggtgctcgatttagcatactctacagggggctgtgggctcaggaggcagagcttctgggaatctcaccatgcctcggacccctctcctgcctccccctcctctactttctgcacagtctctgacggcctcctatgagctgacacacgcccacccgtcggtgtcagttccgtaccccgaggaaccaaaccggccaggactccacctgcctcgtggagtattcagttacgaaccaaaaagtaattattacgtttggttcggttaccagtacaaggtaacgtcgacggccgaccggtcccctagttacgtcggtactactccagtcggacggccaggtaccgaccgaccgtaccggtccgggactcccgtaggaagtacgttacttccgtactcgtcccctaccgagtcccgtacggacggtacacgggtcggtaccctaccgtttgaacttagtcgtaggggtccgggacccgtagggtcggaagtagtaggaacgtcgttagaacctttaacgttacgtttacggtaccaccgaaccgtaacggtaacgtaacggttaggtacggtactacgggtaaccggggtaggggtttacggtccggggaacgggttaacgggaccgttaaagggttacccggtacccggttacggttcgggtaacccgaaccggtaccccggtaacgggtcccgttcccccgggtaccccccgttagggtacccctaccgtttccccggttccccccg

SEQ ID NO: 88826 - DNA, 545 bp, Homo sapiens
  misc_feature: GYAE6OF01E2OWC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggtccagcagaagtcaggccaggcccctgtactggtcatccatgaggccagtcgacgacactccgggatcccctgagagattctctgccctccagctcagggacagtggccaccttgactactcgaggtcgggcccgaggtggacgatgaagctgactactattgttacgcaccagacagtagtggtctagtcgagggggtagtcgggcgggagggaccgtaagtggacccgttccgttggtccgtacggcccgaaacggccgtccggcccccgtccggtcctaccgtccgttcccgg

SEQ ID NO: 88827 - DNA, 564 bp, Homo sapiens
  misc_feature: GYAE6OF01BPLXP.21.8.A08.1.454.CMB.1.raw
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgacacagcccaccctcggtgttagtgtcccccaggaccaaacggccaggatcacctgctctggagattcattgaccaaaagatatacttgttgtccagcagaagtcaggccacggcccctgtactggtcatccatgacgccagtcgacgacacgtccgggatccctgagagtattcnctgcctccagctcgagggcagtcgcctacttgactncaggtcgggcccgaggtggacgagtagaagctagactactagttcgtacgcacgagacgagtagtggtcagtcgtaggggttagttcgggacggtagggaccgtaaggttacgaccggttccgtagggtccacggcccgaaggtccctaccggtccccccgttcggtaccctacttcccgtccggttccccccg

SEQ ID NO: 88828 - DNA, 697 bp, Homo sapiens
  misc_feature: GYAE6OF01ADJKF.21.8.A08.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagcatactctacagggggctgtgggctcaggaggcagagctctgggaatctcaccatgcctggacccctctcctgctccccctcctcactttctgcacagtctctgaggcctcctatgagctgacacagcccaccctcggtgtcagtcgtcccccaggaccaaacggccaggactcgacctgcctctggagattcattgaccaaaagatatacttgttggttaccagcagaagtcaggccaggccccctgtacgtggtcatccagtgacggccaggtccgacgaccacgtcccgggatcccgtgagacgnttaccgtctacgccctaccgacgcctcgacggacaggttaccgggcctaccgttggaccttagtccgtaagggtcgggtacccgagggttcgggaccgtaaggtcgaaaggtccgtacgtaccgttacgtttagtttaccggtttaacgacccgtaaccgtaacggaacgtaaggtttaccggtaggtacctacggtaccgggtaacgggggttactttaccgggggacggttaacggggaaccgtaacggttccggtaacccgggttcgttccgggaactaccgggacccccgtaagggtcccgttcccggtaccccccgtagggtcccgtacccgtttccgtaccccccggg

SEQ ID NO: 88829 - DNA, 607 bp, Homo sapiens
  misc_feature: GYAE6OF01BQP3E.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccaggacaaacggccaggactcacctgctctggatattcattcgaaccaaaagattatacttgttggtccagcagagtcgaggccacgcccctgtactggtcatccagtggacggccagtccgacgaccacgtcccgggactcccgtgacgagtacttctctcgccctcgagtcctacgacgggactaggtcggaccctaccgttgacttacgtcgacggtcggggacccgtagggtacggacgagtacggaacgtctagtaacttacgttagtttacggtacgactaaccgaagtacgtaggtacggtcggtacgtagtacggtaggggttacgtcgggacggacggtacgtagttacggtaccgtcgtggacgtcgacccgaggccgtccgccccgttggtcctccgttcgtcccg

SEQ ID NO: 88830 - DNA, 863 bp, Homo sapiens
  misc_feature: GYAE6OF01BU7JL.21.8.A08.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagcatactctacagggggctgtgggctcagggaggcagagctctgggaatctcaccatggcctggacccctctcctgctccccctcctcactttctgcacagtctctgacggcctcctatgagctcgacacacgcccacccgttggtntcagtcgtcccgaggaaccaaaccggccaaggactcaccgtgtcctcgtaggatacttcacgttacgaaccaaaaagtaacttaacgttaccgttttaggttcgttaccgagtacgaaggtaacgtccgaacggacccgtacggtcccccgttaggtaccgtcgggttaccaacgttacccgaaggttacggaacggtcccgtaacgggttacccggaaccggtaaccgtaacccggttacccggggtaaccttccccggtaaggtaacgggtacttaacctttccgtacgtcgtaccctcgacgtcgtacggaacggtactacgggtccgaccctacgttacgaccttacgtaccggtacgggtccggggacccgtagggtaccggaacgtagttacggaacgtcgttaaccgtaacgttaccgtttaagtttacgggttaaccgaccgtaaacccgtaaggtaaccggttaacgggtaggtttacggtaacccgttagggttaccggggtaacgggggttcggttacccggggaacgggtaacgggtaaacccggttagggtttaaccccggtacccggttaccggtttacgggaacccggttaccgggaccctaacggggttcccgttacccccggtccccggttaccggtcccgttacgttcccggttaccccccggg

SEQ ID NO: 88831 - DNA, 676 bp, Homo sapiens
  misc_feature: GYAE6OF01COW28.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagattcattgaccaaaagatatacttgtggttccagcagaagtcaggccacggcccctgtactggtcatccatgacgccagtcgacacaccgtccgggatcccgtgagagtacttctcgtcgccctcagctcgaggacaggtcgacctaccgttgacttagtcgtaggtccggggacccgtagggtcggacgtagtacggaacgtcgtacgtaaccgttaacgttacgtttacggttaaccgaccgtaacccgaagtaaccgtaagggttaacggttcgggtaaccgtacgttacggggtaacgggggggtttacgttaccgggggacggggtaaccggggaccgtaaacgggttaccgggtacccggtttccggttacgggtaccgtaccggacccgtaaaccgggtcccgtacccggtaccccccgttgggtacccctccgttccgtttacccccg

SEQ ID NO: 88832 - DNA, 719 bp, Homo sapiens
  misc_feature: GYAE6OF01ETWCD.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcaggccaggcccctgtactggtcatccatgaggccagtcgacgacacgtccgggatcccgtgagagattctctcgccctccgagcctcgagggtacacggtcggccctaccgtttggaaccttagtcgtaggtcggggaccccgtagggtcgggaaccgagtaggaaagtccgtaggtaccttaacgttaagtttacggtttaccgaccgtaacccgaaggtaaccgtaaggttaacggttcgggtaccgtaacggttaccgggttaaggggggttaacggttaccgggggtaccggggtaacggggtaacccggtaaaggggtttaccgggtacccggtttccccggtttaggggttacccgtaaccgggtacccccgtaaacggggtccccgttacccgggtccccccccggttacgggttaccccttaccccgttcccgtttacccccccgggg

SEQ ID NO: 88833 - DNA, 592 bp, Homo sapiens
  misc_feature: GYAE6OF01BKE0X.21.8.A08.1.454.CMB.1.raw
  modified_base (282)..(282): a, c, t, g, unknown or other
  misc_feature (282)..(282): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaacggccaggatcacctgctctggagattcattgaccaaaagaatatacttgttggttaccagcagaagtcaggccaggcccctgtacnggtcatccatggacggccaggtccgacgacaccgtccgggactcccgtagacgacgtattctctcgccctcagtctcgagggacaggcgcctaccgttgacttagtcgagggtcgggccgagggtggacgagtgaacgctagacttacgtagttacgttacgcacgagtacgagtagtcggtactagtcgggtaggggttagttacgggacgggtacgggaacctaggttccgaaccggttccggttaggtaccgacggcccgaacggcccgtccgtcccccggtaggtccctaccgttcccgttacccg

SEQ ID NO: 88834 - DNA, 668 bp, Homo sapiens
  misc_feature: GYAE6OF01A4NUB.21.8.A08.1.454.CMB.1.raw
  modified_base (176)..(176): a, c, t, g, unknown or other
  misc_feature (176)..(176): n is a, c, g, or t
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (376)..(376): a, c, t, g, unknown or other
  misc_feature (376)..(376): n is a, c, g, or t
  modified_base (597)..(597): a, c, t, g, unknown or other
  misc_feature (597)..(597): n is a, c, g, or t
tcagtcgtcgctcgcacgaccggtgctcgatttagcatactctacagggggcgtggtgggctcaggaggcagagctctgggaatctcaccatggcctggacccctctcctgctccccctcctcactttctgcactgtctctgaggcctcctatgagctgacacagccaccctggtntcagtcgtccccaggaccaaacggccaggtactcacctgctctgganattcattgacaaaagatatacttgtggttccagcagaagtcaggccaggcccngtacnggtcatccatgacgccagtcacgacactcgggatcccgngacagacttcnctcgcctcgaagctcgaagggacaaggttcggacccaaccgtttnaacgttacgtccgtaagggtcggggacccgtagggttagggaacccggtaagttagggaagtcggttaagaccgtttaacttaacgtttaggtttaaccggccaacccgaagttaaccgaaggttaacggtaggttccgtaagttaccggaagggggtttacgttacgggcgggtaacgggaccgtaaagggttacgtacccggttccggtttaacggttnacccggtacccggtaaaacggccgttacccgggtacccccttaaccgggtccgtacccgtcgttaccccgg

SEQ ID NO: 88835 - DNA, 778 bp, Homo sapiens
  misc_feature: GYAE6OF01D3XOA.21.8.A08.1.454.CMB.1.raw
  modified_base (121)..(121): a, c, t, g, unknown or other
  misc_feature (121)..(121): n is a, c, g, or t
tcagtcgtcgctcgcacgaccggtgctcgatttagcatactctacagggggctgtgggctcaggaggcagagctctgggaatctcaccatggcctggacccctctcctgcctccccccctnacttctgcacagtctctgaggcctcctatgagctgacacagcccaccctcgatgtcagtcgtcccacggacgaaaacggaccgtacggatcacctcgctcgtggagattcaccttgaccaaaagtaatattacttgttgggttccagacagaagtcgaggccacggcccctgtactcggttcatccagtggacggcctacgtaccggaacgaccgtaccgtcccggggtaactcccctggaagacggtatttccctcgtacggtcccttacccaaggccttaccggaagggggtaacccagggtcgggacccccttaaaccgttttacggaaacgttacgttaccgtacgggggtaccgggggtaaccccggacggggtaaggggtaaccgtaacgtaagggtaaccgaccgttaccgtacgtttaaacccgttagtttacgtttaccggacctaacccaacggaactaaggtacgttacgggtactagttaccggggtagggggttacgtaccgggggtaggaacggggtaaaccgttacggttaccggttacccgggttcctttacggggtaccaacggggtacccccaaggggtacccgtaccccgttaccccccgggtaccggttccttaaaccccgttcccgtttcccccgg

SEQ ID NO: 88836 - DNA, 595 bp, Homo sapiens
  misc_feature: GYAE6OF01DY2Q1.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtgtccccaggacaaacggccaggatcactgctctggagattcattgaccaaaaagtaatatacttgttggttccagcagaagtcaggccaggcccctgtactggtcatccatcggacggccagtccgacgacacgtccgggatccctagacgagtatttctcgtcgccctcgacgtctacgagggacaggtcgacctacttgacttatcgaggtcgggacctgggtacggacgagtagaacgtctagacttactagtttcgttacgcaacgagactaggtacgtcgtacgtagtacggtaggggttatcggggacgggaacgggtaccgtaaaggttcggtaccggttccgttaggtcgacggaccccgtaagggcccgttccggacccccgttggtccctccgttccgttcccg

SEQ ID NO: 88837 - DNA, 689 bp, Homo sapiens
  misc_feature: GYAE6OF01C8M4X.21.8.A08.1.454.CMB.1.raw
  modified_base (125)..(125): a, c, t, g, unknown or other
  misc_feature (125)..(125): n is a, c, g, or t
  modified_base (507)..(507): a, c, t, g, unknown or other
  misc_feature (507)..(507): n is a, c, g, or t
tcagtcgtcgctcgcacgaccggtgctcgatttagcatactctacagggggtgggctcaggaggcagagctctgggaatctcaccatggcctggaccctctcctgcctccccctctctactttcngcacagtctctgacggcctcctatgagctgacacagcccacccgtcggtcgtctagtcgtccccaggaaccaaacggccaggactcacctgctcgtggagtattcattcgaaccaaaagtattatacttgttcgtaccagcagagtcgagccacggccctgtactggtcatcagtcgaggccaggtaccgacgaccacggtccgggaactcccgtaggacgacgtactttcctacgtcgtaccctccgagcccgttacggaacgggactaacggttccgacccttacgttacgaacttacgtcgtacgggtccggggtacccgtagggtacggaccgagtacggaacgtctacgtacttacttagttcgtacgactacgaanactaggtagtcgtactagtcgggtaaggggttacgtcggggacgggtacggtaaccgtacggttacggtacccgttcgtaccggggtacaacccgggtacccgtaacggtccccggttccccgtacccccggttacggtaccccttaccgtttacccttcccggttaaccccccgtcccccg

SEQ ID NO: 88838 - DNA, 804 bp, Homo sapiens
  misc_feature: GYAE6OF01ECXGI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgacgctagaccacacgccctacccgttcggtcgtcgacgtccgtaccccgaaggaaccaaaaccggccgaaggactccaccgtgctcgtaggacgtacttacgtagttacgaacctaaaaagtaacttacttacgtttggttcggttaccagacgaaggaacgtaccgacggaccgaccgggtccccttaggtacgtcggtacctacgttccgtaagttacggaccggtaccgtaacggtaccggaaccgtaaccgtacccgggttacccgggaaccttccccggtaggaagtacgtacctttccgtacgtccggtccctaccgacggtccgtaacggaacgggactacgggtcccggtacccttacgttacgtaccttacgtaccggtacggggtccgggacccggtagggtacgggaacgtacgtaacggaacgtacgtacgttaacttaacgttacggtttacgtaaccgaccgtaaccgtagtaacgtaagggttacggtacggttacgtacgggtacgggtaggggttacggtacggggacgggaacggtaccgtaacggtaccggtccgttccggttacggaccgtaccggacccgtaacggtccgtcccggtaccccgttacgggtcctccgttccgttccccg

SEQ ID NO: 88839 - DNA, 670 bp, Homo sapiens
  misc_feature: GYAE6OF01ADIIJ.21.8.A08.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaacgtggtggagtcgtgggggagcatcggtccagccgtgggacgtccctgacgcctctcctgtgcagcgtcgtggattcgagtactcggtcttcctttgcctatcgcctacgtcgggtccnccgacggcctccgaggcgaaggggtctagggaggtgggtggacgtatttacgcgttggtacgtgagtagggtaagtgaacgagtaattattagtacagtacctcgggtaggaacggggtaccgtacttaccgaaccacttccgtaccgaagaacgtaaacctaacgtacgaacccaaaccgaaccacgtaaccttagtaacttaccgtttaacaaacgtaccggaccccggtacgtaggaccgtacggaccggaacggaaccgacgtacgttagttacgttaacgtttacgtaggtaacgtcgttacgtttacggtacgtacggtcggggaacccggaaccgggttacccgtggtaaccccg

SEQ ID NO: 88840 - DNA, 723 bp, Homo sapiens
  misc_feature: GYAE6OF01BJPFM.21.8.A08.1.454.CMB.1.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (511)..(511): a, c, t, g, unknown or other
  misc_feature (511)..(511): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctcggtgtcagtcgtaccccgaggacaaacggccaggactccacctgctcgtggagtattcagttacgaaccaaaaagtaattattacgtttggttcgttaccagcaagaacgtcgacggccacggccccttgtaccgtggtacattccgagtcggacggccgagtaccgaccgaccgaccgtccgggacttcccgtagaagtgtacttctcncgtccctccgngaccgtcgacgggtacaggtcgaccctacttagtacctacgtacgacgggtcgggacccgtaggggtacggacgacgtaggaagtccgtacgtacttaacgttagtttcgtaaccnccgaacgacgtacgtacgtaggttacggacgtacggtcgggtaaggggttacgttaccggggacgggtaacgggtaccgtaaggttaccggtacccggtttaccgttacgggtaacccggtacccgggtacccgtaaccgggtccccgttacccccgggtaccccccggttacccggtaccccgttacccggttccccggtttaccccccgg

SEQ ID NO: 88841 - DNA, 739 bp, Homo sapiens
  misc_feature: GYAE6OF01CNGLS.21.8.A08.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctggtntcaggtcgtacccgaggaaccaaacggccaaggactccacctgctcgtaggatattacattacgaacaaaagaatattacgttggttcgtaccagcgaagagtcgacggaccaccggtccctagtacgtcgtactacgtccagtcggacgccgaggtaccgaccgacaccggtccgggactcccgtaggacgagtacttcgtcgtcggaccctcgacgtcgtacggaagggactacggtcggtacctaccgttacgacgtacgtcggtacgggtccgggaccgtaggggtacggacgtaagtacggaactcgttacgtaactttacgtacgtttacgtaaccgacacgaaccgtacgtaaggttacggtacgtaccgtaagggttacggggtaaagggggtttaccgtaccgggggaacgggtaacccgggtaaccggttacgggttacccgggaacccggtttgggttacccggtaacccggtaccgggtaaccccgacgggtaccccgttaccccggtccccgggttaccgtaccgttacccggttcccgttacccccgg

SEQ ID NO: 88842 - DNA, 705 bp, Homo sapiens
  misc_feature: GYAE6OF01CCTYE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctcgcctcccctcctcactttctgcacagtctctgacggcctcctatgagctgacacacgcccacccgtcggtgtcagtcgtacccgaggacaaacggcaggactcacctgctcgtggatacttacagttagaacctaaaagattattacgttgttcggttaccagaccgagaacggtcgacgggccgacgggtacccccttaggtaaccgtcggtaccaacgttaccgagtacggacggacccaacggtaccggaaccgaaccgtacccggttacggggaccctacccggtaggaacgtaggttactttacctcgtacggccctaccgacgtcgtacggaacgggacgtacgtaccgggtacctaaccgtagtaacctaacgtcggacgggttccggggacccgtagggtacgggaacgtagaacggtaacgcgttaagtaccttacgttacgttcgtaaccgaccaacgaacgtacgtaggtacgtcggacgtacgtaacgggtggggttacgtcgggacgggaagtaccgtagtcgtaccgtggttacgcgaccgtaccgaggcctaccgccccgtggacctcgtcccgttacccg

SEQ ID NO: 88843 - DNA, 676 bp, Homo sapiens
  misc_feature: GYAE6OF01AWFBL.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctccctcactttctgcactgtctctgaggcctcctatgagctgacacagcccaccctcggtgtcagtcgtccccaggacaaacggccaggatcactgctctgganattcattgaccaaaagatatattgttgttcagcagaagtgagaccagcccctgtactggtcatccatgacgccagtaccgacgacacgtcccgggactccccgtgacgacgcttactctcgcccttccgagtcctcgaggactagtcggccaccgttagaccttacgtcgaggtcgggccccgtagggtacggacgtacgtaggaacgtccgtacgtaacttacctagtttacggtaaccgtccgaacctacggtaacgtaacggttacggttaggtaccgtacgttacgggacgggggttacggttaccgggaccggggtaaggggtaccctaaacggggttaccgtacccgggttacccggtttgggtacccgtacggacccccgtaaccggggtccttaccccggtacccccccggttagggttacccgtacccgttcccgtttacccccgg

SEQ ID NO: 88844 - DNA, 705 bp, Homo sapiens
  misc_feature: GYAE6OF01EQD74.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggaccaaacggccaggatcacctgctctggatattcattgaccaaaagatatacttgttggttccagcagagtcaggccaggcccctgtactggtcatccatgacggccagtcgacgacacgtccgggatcccgtggagagtatttcctcgtcgccctccgagtcctacggaacggggacctagggtccggaccctaaccgtttcggaacttacgtccgaagggtccggggaccgtagggtcgggaacgtaagtaggaacgtcgtacgtaactttaacgttacgtttacggtttaaccgacgtaacccgaacgtaacgtaacggttaggttacggtacgtaaggttacgggtaacgggggttacggttaccggggaccgggggtaacgggtaaccggttaacgggttaccggttacccggttccggtttacgggtaccgtacccggtaccccgtaaacgggtcccgttacccggaccccccggtttacggtaccctacccgttcccgtttccccggg

SEQ ID NO: 88845 - DNA, 766 bp, Homo sapiens
  misc_feature: GYAE6OF01A0TWW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtcggtgtcaggtcgtcccgaggaacaaacggccaggactccaccgtgcttcgtaggatacttcaattacgaacctaaaaaagtattacttacgttggtttacggttacccaagtacgaaggtaacgtcgaacgggccaccggtcccctggttaccgtcggtacactccgagtcggacggccgtaggtaccggacgaccgacccgtaccgggactacccggtagacgtagtacttccgtacgtccgtccctaccgaacgtccgtacggaacgggtaccgtagggtaccggtacccctaacgtttcgtaaccttacgtacggtacggggtacccggggacccgtaaggggtacgggaacgtaaggtacggtaacggtacgttacgtaaccgttaacgttacgtttacgtaccgactaacgtaacgtaacgtaggttaacggttcggtactaggtacgggtacgggggttacgtaccgggacgggtaacgggtacctaacgggttccggtacccgtcggttacgggaccgacggacccggtacggcccggttcccgtaccccggttaccggtacccgtccgttcccgttaccccg

SEQ ID NO: 88846 - DNA, 705 bp, Homo sapiens
  misc_feature: GYAE6OF01B5EYJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtcccaggacaaacggccaggatcacctgctcgtggagtattcattcgaccaaaaagaatatacttgttcggttccagcaagaagtcaggccaggcccctgtactggtcatccagtgacggccagtcgacgacacgtccgggactcccgtagacgagtactttctcgtcgccctccgagtcctacggacgggacaggtcggccctaaccgttgacttagtccgagggtccggggacccgtagggtacgggaacgtagtacggaacgtccgttagaacttaacgttaagtttcggtaaccgaccaaccgtaagacgtaagggttaacgtacggtacgtaacgttacgggtaagggggttacgtacggggaccggggtaacgggtaacccgtaaagggttcccggtaaacccgggtttcccggttaagggtacccgtaaacgggacccccggtaaagggtccccgttacccggttacccccccggttacgggttacccctacccgtttcccggtttacccccggg

SEQ ID NO: 88847 - DNA, 776 bp, Homo sapiens
  misc_feature: GYAE6OF01ETY77.21.8.A08.1.454.CMB.1.raw
  modified_base (238)..(238): a, c, t, g, unknown or other
  misc_feature (238)..(238): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaatttnttgtttttggaccagcagaagtcaggccaggccctgtgtggtcatccatggaggacaggagaccgacccgtccgggatcccgtgagagtacttctcgtggctccgaaactcgaagggtacggtcggaccctaggtttcgaactttccgtacgagggttcgggggaccccgtaaggggttcgggaagggtaagttagggaacggtccgttacggtaaccgtaaccgttaacttacggtttaaccgttacgtaaggccgtaacggaaccgtacgaaccgtagggttacggttaccgaacgttccgggaaggggggtaccgttaacgggtttcccgggggaccggggtaacggggaacccggttaggggtttacccgggtaaaccccggttaccccgggttaacggggttaccccgaacgggtaccccccggtaaaaggggtcccccgttaccccgggtacccccccccggtttccggggttacccctaaccccgttttcccggttcccccggtttacccccccgtttaacccccccccgg

SEQ ID NO: 88848 - DNA, 653 bp, Homo sapiens
  misc_feature: GYAE6OF01EABZG.21.8.A08.1.454.CMB.1.raw
  modified_base (220)..(220): a, c, t, g, unknown or other
  misc_feature (220)..(220): n is a, c, g, or t
  modified_base (358)..(358): a, c, t, g, unknown or other
  misc_feature (358)..(358): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccaccctggtgtcagtcgtccccaggacaaacggccaggactcacctgctctgganttcattgaccaaaagatatacttgttgtccagcagaagtcaggccacggcccctagtacctggtcatccagtcgacggcagtcgacgacacgtccgggactccgtagagagtactctctcgcctcagtctcgaggacnggtcggccctacgttgaactacgtcgaacggtcggggacccgtagggtacggaacgtagtaggaacgcgttacgaacctttactaacgtttacgtaccgactaaccgaacgaacgtaaccgggtaagtacgggttacgtaggttacggttaagggggttacgttaccggggtacgggaacgggtaaccgtaacgggtttaccggtacccggtttaccggtttacgggtacgtaccggacccgaacgggtccctcccggtaccccccgtaggtaccgtcccgtccgtttcccccgg

SEQ ID NO: 88849 - DNA, 817 bp, Homo sapiens
  misc_feature: GYAE6OF01DAM5J.21.8.A08.1.454.CMB.1.raw
tcagtcgtcgctcgcacgaccggtgctcgatttagcatactctacaggggggctgtgggctcaggaggcagagctctgggaatctcaccatggcctggacccctctcctgcctccccctcctcactttctgcacagtctctgaggcctcctatgagctgacacagccaccctcggtgtcagtcgtaccccgaggaaccaaacggccaggactcaccgtgactcgtaggatattcagttacgaacaaaagtatacttcgttgttcgtccaagcgaagtaacgtcgacggaccgccggtaccccttagtaacgttcggtacctaacgtacctaggtacggaccggtacccgtaaggttaccggaacccgtaaccgttacccgggttaccccgggtacgtttccccgaagggtaacgtaacgttaccttttccgtaccgtaccggtacccctaccgtaccggtacgttaaccgggaacgggtaactacggggttcccgtaacccttacccggtttaacgaaccgtttaccgtaccgggtaaccggggttcccggggaaccccggtagggtaacgggtaaccgtaacggtaacgggaacgtacgttaacggtaacgtttaaccgtttacgtttaccgttaaccgacctaacgacgtaaggtacgttacggtacgtacgtacggtacgggtagggttacgttacgggacgggtacgtaacggttacggtaccggtacgttccggtaggtaccggaccgacccggtaaccgggccgttccccggtaccccggttgggtacccttccggtcccgtttacccccg

SEQ ID NO: 88850 - DNA, 672 bp, Homo sapiens
  misc_feature: GYAE6OF01A8ITU.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacagcccaccctcggtgtcaggtcgtcccccaggaccaaaccggccaggactccacctgctctggagattcattgaccaaaagatatacttgtgttccagcagaacgtcaggccacggcccctgtacctggtcatccatcgacgccagtccgacgactaccgtcccgggactcccgtgacgagtattcctcgtcgtccctccgagcctacggacggtacacggtccggacctacccgtttgaaccttagtaccgacgggtccggggtacccggtagggtcgggaccgtagttaggaacgtcgttacgtaccttaacttagtttacgtaccgaccaccgaagtacgtagggtaagtcggtacgtacgttacgggtacgggggttacgtacggggtacgggtagggtacccgtaacggttccggacccgtttccgttacggtacggccgaccccgtaacggtcccgtccccgtaccccccgttaccggtacccttcccgtccgttacccccgg

SEQ ID NO: 88851 - DNA, 643 bp, Homo sapiens
  misc_feature: GYAE6OF01EUEQG.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggaccaaacggccaggactcacctgctcgtggatattcattcgaaccaaaagattatacttgttggtccagcagaagtcaggccacggcccctgtacgtcggtcactccagtggacggccaggtaccgacgaccaccgtccgggactcccgtaggacgtatacttcctcgtcgccctacgagtccgtacgagggacctaggtccggaccctaccgttgtaacctagtcgacgggtccggggaccgtagggtcggacgtagtaggaacgtctagtacttattagttacgtaccgctaaccagtacgtaggttagtcggtacgtagttacgggtaggggttacgtcggggacgggtaacggtaccgtaggttcggtacccggttccggttagggaccgacggcccgaacggtcccgtcccgccccgttacggtcctacccgtccgttcccccgg

SEQ ID NO: 88852 - DNA, 900 bp, Homo sapiens
  misc_feature: GYAE6OF01DN3BF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggaacaaacggccaggatcacctgctcgtggagtattcattacgaaccaaaaagaattacttacttggtttaggttcccagacaaggaacgtcgaacggccgacggtcccccttaggtactcgggtacctaactccgaagttcggacgggaccctacgggtaccggaaccggaaccgtaacccggttccggggtaaccttaccccgtagggaacggtaacggttaaccttttccgttaccgtcggtacccccttaccgaacggtacccttaccgggaaacggggacctacggttaccgggtaaccccttaaccgtttacggtaacctttaacgtccggtaacgggggtccgggggtaccccgtaagggggttaccggggaaacgtacgttaacgggaaacggttaccgttacgggtaacctttaaacgttaacgttttacggttaacccgtaccgtaaacccgtaaggtaaccgttaagggttaacgggttacgggttacgtaaacggttaccgggggtaaacggggggtttaaccggtttacgggggaaccgggggtaaaacggggtaacccgtttaaacggggttaccggttaacccgggtttccggtttaccgggtacccggaaacccggtaccccggtaaacggtacccggttccccggttaccccccggtccgggttaccctcccgtttcccggtttaccccccgg

SEQ ID NO: 88853 - DNA, 748 bp, Homo sapiens
  misc_feature: GYAE6OF01D6MIZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctcgtggatacttcattacgaaccaaaaagtaattattacgtttgttacggttaccagacaaggaacgtcgacggccacggtcccctagtacgtggtacactccagtcggacggcctagtaccgacgaccaccgtccgggacttcccgtaggactagtacttctcgtcgccctccgagtctacggaggacacgtcgacctacgttgacttatcgacgggtcggggacctagggtacggaacgtagtaggaacgtcgttacggtaactttaacgttagttttacggttaaccgccgtaaaccgaaggtaacgtaaggttaacgggttcggtaccgtaaggtttaccggggtaaggggggtttaccgttaccgggggaaccggggtaaaccgggtaaccggttaaacgggttcccggtaacccggtttcccgggtttagggaacccgtacccggtaaccccggtaacgggtccccgttaccccgggttaccccccggttaccgggttacccgtacccgtttcccggtttccccccggg

SEQ ID NO: 88854 - DNA, 648 bp, Homo sapiens
  misc_feature: GYAE6OF01BOTHU.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgcttcttttaagaggtgtccagtgtcaggcgcaactggtggagtcgtgggggagcagtggtccaggccgtggggacggtccctgacgcctctcctgtcgcagcgtctggacttcgagtatcggccttccttgcctatcgcctacgtcgggtcccgccgaggtcctaccgagggacgaagggggctaggggaggtcggggtggcgtaatttagtcggtaggtatggagtgggaagtgaagagtattattagtcagtacctcggtaggaacgggctattccacctatcctacgaagacgaacagtcgaaccaaacaaccactactagttactaccgttaacaagtccggacccggtctagggaacgtacgggacccggaaggacccgtaacgggtcttaaggttacgttaacgttacggtaggtaaccgtggttcgtttacggtaccgtacgggtttcggggaccctaaccggggtacccttgggttaaccccg

SEQ ID NO: 88855 - DNA, 631 bp, Homo sapiens
  misc_feature: GYAE6OF01EECYG.21.8.A08.1.454.CMB.1.raw
  modified_base (159)..(159): a, c, t, g, unknown or other
  misc_feature (159)..(159): n is a, c, g, or t
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagtttcngacacagcccaccctcggtntcagtgtccccaggacaaacggccaggatcacctgctctggagtattcattcgaacctaaaaaatttgttgttttttacggaccagtcaagaagtcacggccacggtccctgtgttggtcatccagtgaggacgaggagaccgacccgtcgggactcccgtgacgagtacttctcgtcggcctaccgaactcgacggggacggtcggcctacggttcgacgtttccgtacgtaagggtcggggacccgtaggggtggaggtagtaggaacgtcgtagtactactacttacgttactcgagcagacagcaggtcgtcagtcggaggggtactaggttcgggacgggacgggacgtacgggttcgaccggttacgtacgggtacgacggacccgacggtccgtcccgccccccgttcggtaccctacgttccgttcccgttccccgtacccccg

SEQ ID NO: 88856 - DNA, 672 bp, Homo sapiens
  misc_feature: GYAE6OF01C3MXZ.21.8.A08.1.454.CMB.1.raw
  modified_base (129)..(129): a, c, t, g, unknown or other
  misc_feature (129)..(129): n is a, c, g, or t
  modified_base (222)..(222): a, c, t, g, unknown or other
  misc_feature (222)..(222): n is a, c, g, or t
  modified_base (369)..(369): a, c, t, g, unknown or other
  misc_feature (369)..(369): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgagcctctatgagctgacacagcccacccgtcggtgtcagtcgtccccaggaaccaaacggccaggatcacctgctctgganattcattgacaaaagatatactgttagtcagcagagtcagcacggccctgtactgcatccatgacggtccagtccgaacgacaacgtccgggactcccgtagacgagacttcgtctcgacctaccacgtaccgtacaaggggtaccncggtggacccctaacgtttcgaaccttaagtacgtaacggggtcgggacccgtagggtacgggaacgtagtaggaaacggtcctaggtaactaacgttaagttacggtacgtaccaacctacgaacgtagtaggttacggtcgtaacgtagggtaacggggttaacgtcggggaccgggtaacgggtaaccgttaaggttcggtaacccggttaccggtttaggtacccggtaaccgggaccccgtaaacggcccgttcccgtaccccccggtaggttacccgaaccgtttccgttacccccg

SEQ ID NO: 88857 - DNA, 624 bp, Homo sapiens
  misc_feature: GYAE6OF01BPA39.21.8.A08.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggaccaaacggccaggactcacctgctcgtgganattcattcgaaccaaaagtatattacgttgttgttccagcagaagtcaggccaggcccctgtactggtcatccatgacgcgagtcgacgacacgtccgggactcccgagagagtactcgtctcgcccttaccgagtcctacggaggactaggtccggaccctaccgttgacctagtaccgaggtccgggaccccgtagggtcgggacgtaagtggaacgtcgtagactacgttagtttacgtaccgactaaccgaagtacgtaagtaggtacgtacgaggtacgggtaaggggttgttaccgggacgggaagggtaccgtaagttacggacccgttcgttagggtccaacggcccgtaacggccgttcccgccccgttcgactcccgttcgttcccccg

SEQ ID NO: 88858 - DNA, 561 bp, Homo sapiens
  misc_feature: GYAE6OF01B27S8.21.8.A08.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgacggccagtcgacgacacgtccgggatcccgtgagagattcnctcgcctccgagctcgagggacaggtcggcctaccgttgacttactcgacggtcggggccgaggtcggacgtagtgaagtctagtacttactagttcgtacgcacagacgtagtagtggtctagtcggtagggtacgtcgggacggacgggtaccgaaggttcggaccgttccgttggtacgacgcccgaaggcccgtccgcccccgttcggcctccgtcgttcccgg

SEQ ID NO: 88859 - DNA, 568 bp, Homo sapiens
  misc_feature: GYAE6OF01CEADB.21.8.A08.1.454.CMB.1.raw
  modified_base (556)..(556): a, c, t, g, unknown or other
  misc_feature (556)..(556): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctgtactggtcatccatgaggccagtcgacgacacgtccgggatccctgagagtactttctctcgtccctccgagctacgagggacaggtcggcctaccttgacttatcgaggtcggggcccagggtcggacgagtgaagcgtagacttactattgtacgcacagacaggtagtcggtacagtcggaggggttactcgggacgggtagggaccgtaaggttcgaccggttccgttggaccgtacggacccgaagggtcccgtccgtcccccgtaggtcccncgttccgtcccg

SEQ ID NO: 88860 - DNA, 751 bp, Homo sapiens
  misc_feature: GYAE6OF01DJMH7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagttcgtcccccgaggaaccaaacggccaggactcacctgccttcgtggagtattcattcgaaccaaaagtattatacgttgtttcgttccagcagaacgtcacggccacggcccctgtactggtcactccagtcgacggccaggtccgaacgacaccgtccgggactcccgtagaagtacgtacttccgtcgtcgtcccctccgtacgcctacggaacgggtaccacgggtcccggaccctaaccgtttagtaacccttagtaccggtacgggggtcccggggaacccgtaggggtacggaacggtagtaacgggtaaacgtcgttaacgtaacctttaaccgttaacgtttaccggttaacccgaaccctaacccggaagtaacccgtaaggttacgggttaacggtaccctaaggttaccggggtaggggtttaaccgttcgggggacggggtaaccggtaaccgttaacggttccggtacccggttaccggtacgggttaccaccggtacccgaacggtcccgtaccccgtaccccggttccggtacctccgtttcccgtacccccgg

SEQ ID NO: 88861 - DNA, 561 bp, Homo sapiens
  misc_feature: GYAE6OF01EXOBC.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgtccagcagaagtcaggccaggcccctgtactggtcatccatcggaggccagtcgacgacacgtccgggatccctgagagtattctctcgccctccgagcctcgaggacacggtcgaccctacttgactatcgaggtcgggcccgagggtggacgagtagaagcgtagactacgtatttcgttacgcaccgagacagtagtggtctagtcgaggggttagttcgggacggtacggacctaagggttcgaccgttcgttggcgacggaccccgaaggccctaccggcccccgtacggtcctacctccgtcccgg

SEQ ID NO: 88862 - DNA, 643 bp, Homo sapiens
  misc_feature: GYAE6OF01DJ9LK.21.8.A08.1.454.CMB.1.raw
  modified_base (468)..(468): a, c, t, g, unknown or other
  misc_feature (468)..(468): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagccaccctcggtgtcaggtcgtccccaggaacaaacggccaggactcacctgctctggagattcattcgaccaaaagatatacttgttgtcagcagaagtcagccaggccctgtactgtcatccatgacgcagtcgacgacacgtcggatcccgtgagagtattcctcgtcgccctccgagtctacgagggacaggttcggacccctaaccgtttcgaacttcgtacgaacgggtccggggaccctaaggggtacggaacgagtacggaaaggcctagtaacttacgttaagtttcgttaaccncgaacccgaggtaactaggttagttcgggtacgtagtacgggtaggggggttacttcggggacgggtaacgggtacctaaacggttcggtaaccccggttcgttcggtaccaccgggacccgtaggcccgttcccgtaccccccgttcgggttccctacccgttccgttaccccg

SEQ ID NO: 88863 - DNA, 705 bp, Homo sapiens
  misc_feature: GYAE6OF01DRJO8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccacccgtcggtgtcagtcgtcccccgaaggaacaaacggccaggactcacctgctcgtggagtattcattcgaaccaaaagattatacttgttgtcagcagagtcaggccacggcccctagtacgtcggtcactccagtcggacggccaggtccgaacgacctaccgtccgggaactcccgtagacgtagtactttctcgtcgccctccgagctacggaggacacggtcgacctacgttgactatacgtacggtcggggacccgtagggtacggacgtacgtaggaacgtccgtacgtactttaacgttacgtttacgttaccgaccgtaaccgaacggtaacgtaaggttacggtacggttacgtacggttacgggtacgggggttacgtttacggggacggggtaaaccgggtaaccgtaacggtttacggtaccccggtttaccggttacgggtaccgtaaccgggtaccccgtaacgggtcccgttacccggtccccccgttacgggtaccctcccggttcccgttcccccgg

SEQ ID NO: 88864 - DNA, 595 bp, Homo sapiens
  misc_feature: GYAE6OF01EWSTZ.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaagatatacttgttgtccagcagagtcaggccaggcccctgtactggtcatccatggacggccagtcgacgacacgtccgggatcccgtgagagtattctctgccctccagctcgaggacaggtcgcctacttgactatcgaggtcgggccgagggtggacgtagtaggagtccgtagacttactagttacgtaccgacaaccgagactacggtaggtcggtcgtagtcgggtaagggggttacttacggggaccgggagggtaaccgtaaggttccggtacccggttccgttaggaccgtacggacccgtaacgggcccgtcccggtccccccgttacggtccctccgtcccgttaccccgg

SEQ ID NO: 88865 - DNA, 613 bp, Homo sapiens
  misc_feature: GYAE6OF01CBMQU.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttgtcagcagaagtcaggccaggccctgtactggtcatccatgagccagtcgacgacacgtccgggatcccgtaggagtagtacttctcgcgtccctacgagtcctacggaacggacgtacggtcccgaccttaccgttagtaacctcgtacggtacggggtcccgggaccggtagggtacggaacgtacgtaacggtacgtcgtacgtaacgttacgttacgttacggtaccaccgtaacgaacgacgtagttacggtcgtagtacgtagggtagggttacggtcgggacggacggtaacgtcgttacggtccgttcgtcgacgccgtaccgacgtcgtcccgtcccgtacgtcctcgtcgttccccg

SEQ ID NO: 88866 - DNA, 726 bp, Homo sapiens
  misc_feature: GYAE6OF01C4L2R.21.8.A08.1.454.CMB.1.raw
  modified_base (128)..(128): a, c, t, g, unknown or other
  misc_feature (128)..(128): n is a, c, g, or t
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgaggcctcctatgagctgacacagcccacccgtcggtgtcagtcgtcccccaggacaaacggccaggatcacctgctcgtgganacttcattcgaaccaaaagatattacttgttcggttccagcaagaagtcgacggccacgcccctgtactggtcatccagtcgacggccagtccgacgaccgaccgtccgggtactcccgtaggagacgtacttcgttacgtcgtaccctccgagtcctacggacggtacacggtcggacctacttcgacttacgtacgagggtccgggacccgagggtacggaacgtagtaggaaacgtcgtacgtaaccgttaaccgtttaagtttacggtttaaccgaccgtaacccgtaagtaaccgttaaggttaacggttacgggttacgtaacggtacggggttaacggggtttaacggttccgggggaaccgggtaacgggtaaaccgtaaacgggtttaccggtacccggtttcggttacgggtacccgtaacggacccggtaaacggtcccgttaccccggtcccccgttacggttacccgtaccgtttccccggttacccccg

SEQ ID NO: 88867 - DNA, 571 bp, Homo sapiens
  misc_feature: GYAE6OF01AVR9W.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgagccagtcgacgacactccgggatcccctgagagacttctctcgccctccgagctcgaggggacaggtcggccctaccgtttgacttatcgaggtcggggcccagggtcggacgagtggaagtcgtagtaactacttattcgttacgcacagacgagtagtcggtcagtcgaggggttatcgggacggagggtaccgtaaggtcgaccggtccgttggtacgtacggccccgaaggtccgtaccggtccccccgttaggtccctaccgttccgttacccgg

SEQ ID NO: 88868 - DNA, 682 bp, Homo sapiens
  misc_feature: GYAE6OF01A51J2.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggactccactgctctgganattcattcgaaccaaaagtatatacgttgttcgttcagcgagaagtcacggccacggcccctgtacgtggtcatccagtgacggccaggtccgacgacaccgtccggatcccgtagagatagttctctcgccctcgacgtcgtacgacgggactacgggtccgacctaccgttcgaacctacgtcgtacgggtccggggaccgtagggtcggaacgtacgttaggaacggtacgtagtaaccgttacttacgttacggttaccgaccgtaaccgaacgtaacgtaacggttaggtacggtacgtaggttaccgggtaaggggttacggttacggggacgggtaacggggtaaccttacgggttaccggtacccggttccggtttacggaccggtaaccggtacccgtaacgggtcccgtacccggtcccccgtaccgggtccctaccgttccgttacccccg

SEQ ID NO: 88869 - DNA, 548 bp, Homo sapiens
  misc_feature: GYAE6OF01AJ0VV.21.8.A08.1.454.CMB.1.raw
  modified_base (299)..(299): a, c, t, g, unknown or other
  misc_feature (299)..(299): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (503)..(503): a, c, t, g, unknown or other
  misc_feature (503)..(503): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggaggcatgggtccagcctggggaggtccctgagcctctcctgtgcagcgtctggattcagtatcggcttcctttgccatgcactggggtcccnccgaggctccgaggcgaaggggctgggaggtggggtggcgtattatcgtggtatggatgggaagtgagagattatattcgagtctcggtaggaacgggccatccacatcacagacgacaatcgacccaaacaacacacgttagtacttctanaaacncgaaccgctagacgacgccgaggacacggctatgtagttctgtacgngtcgtttaggactaggttcgggacctacgggaaccctggtacccg

SEQ ID NO: 88870 - DNA, 524 bp, Homo sapiens
  misc_feature: GYAE6OF01BHS3U.21.8.A08.1.454.CMB.1.raw
  modified_base (219)..(219): a, c, t, g, unknown or other
  misc_feature (219)..(219): n is a, c, g, or t
  modified_base (427)..(427): a, c, t, g, unknown or other
  misc_feature (427)..(427): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatgacggccagtcgacgacacgtccgggatccctgagagtacttctctgccctcacgctcgacgggacagtcggccacgttgactatcgaggtcggggccgagggtggacgagtgaagctagacttactgttcgttacncacagacagtagtgtcagtcgaggggtctcgggaggacgggactagtcgaccgttcgttgcgcgaccgaggctcgcccctggtcctcgtcgttcccg

SEQ ID NO: 88871 - DNA, 651 bp, Homo sapiens
  misc_feature: GYAE6OF01DKR02.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganattcattgaccaaaagatatacttgttgtccagcagaagtcaggccaggcccctgtactggtcatccatgaggccagtcgacgacacgtccgggactccctagagagtacttctctcgtccctccagtcctacgacggacaggtcggccctacgttgacttatcgaggtcggggaccctagggtcggacgagtacggaacgcgtagtacgttaacttagttacgttaccgaccaccgtagaacgaaggttagtacggttacgagttacggtaagggggttacgttcggggaacggggtaacgggtaaccgtaagggtttacgggtaccccggtttaccggttcgggttaccggaccggaccccggtaacggtcccgttacccggtaccccccggttccggttaccctacccgtttcccgttccccccgg

SEQ ID NO: 88872 - DNA, 567 bp, Homo sapiens
  misc_feature: GYAE6OF01BWQL8.21.8.A08.1.454.CMB.1.raw
  modified_base (221)..(221): a, c, t, g, unknown or other
  misc_feature (221)..(221): n is a, c, g, or t
  modified_base (491)..(491): a, c, t, g, unknown or other
  misc_feature (491)..(491): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggaccaaacggccaggatcacctgctctgganattcattgaccaaaagatatacttgttggttacaagcagaagtcaggccaggcccctgtactggtcatccatggaggccaggtcgacgacaccgtccgggactcccgtgagagtactttctctcgccctcccgagcctcgacgggactacggtcggacccctacgttgacctatacgaggtcggggcccgtagggtacggacgagtggaacgcgtagtaacttacgtattcgtacgccacagacaggtagtggtctagtcggtaggggtntcgggacggacggactagtcgtaccgtcgttggacgcgcccgaggtcctccgcccccgtggtcctctccgttcccg

SEQ ID NO: 88873 - DNA, 809 bp, Homo sapiens
  misc_feature: GYAE6OF01BOI0C.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtcgtcagtcgtcccaggaaccaaacggccaggactcacctgctcgtggagtattcattcgaaccaaaagtaatattacgttgttcgtacagacgaagaacgtcgacgccacggtcccctgtactggtcactcagtcggacgccgacgtcgaacgacacgtccgggactcccgtagacgtatacttctcgtccgtccctaccgacgtccgtaccgaacgggtacgtacggtccggtacccgttaaccgttacgtaaccgttacgtaccggtacggggtccggggtaaccccggtaaggggtaccgggtaacggttaaggtaacgggaaacgttaccgttacgtaaccgtttaaacgtttacggttttaccggtaacccgtaccgtaaacccggtaaaggtaaccggttaacggtttaacgggttacggttacgtaaccgggttaacggggttaacgggggttaccgttaccggggaacggggtaaaccggtaacccgggttaaaccgggtttaccggtaacccggtttccgggtttacgggaacccggtaacccggtaccccggtaacgggttacccctttccccgggacccccggtttaccgggtcccttaacccgttcccggtttacccccg

SEQ ID NO: 88874 - DNA, 671 bp, Homo sapiens
  misc_feature: GYAE6OF01C1URK.21.8.A08.1.454.CMB.1.raw
  modified_base (180)..(180): a, c, t, g, unknown or other
  misc_feature (180)..(180): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (565)..(565): a, c, t, g, unknown or other
  misc_feature (565)..(565): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgacggcctcctatgacgctgacacacgtcccacccgtggtntcaggtcgtacccgaaggaaccgaaacggccgaaggactaccaccgtgcctcgtagggaatatttcaattacggaaacctaaaaagaattacttacgttaggtttacggtaccgaagcgaaggtaaaagtccgaacgggcccgtaacggtccccgttcggtaacgtcggtacctaactccgaagtcggaacgtccgacgtaccggaacacgtaccgtccgggactccgagaacgagttaccttcttcgccgacctacgacgtctacgggacgactaggtccggaccttacgtacgacgtactacgtagggacggccgagggtacgtacgtagaacgagtcgtacgtaactacgtagtcgttaacnccaanacgtaagtagtacgngtaccgagtacgggtagggtacggtcggacggtagggaactacgtcgaccgttcggtagccgagccccgtaagcccgtccgcccgaggtccctcgtccgttcccgg

SEQ ID NO: 88875 - DNA, 889 bp, Homo sapiens
  misc_feature: GYAE6OF01D1NA4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacacgcccacccgtcggtgtcagtcgtcccaggaccaaacggccaggactcaccgtgctctaggatattcattacgaaccaaaagtaattaacttacgttaggtttacggttccaacgacgaaggaacgtccgaacggacccgtaacggtcccccttaggtaaccgttcggttacaacgttacccgtaagtcgggaaccggtacccgtaacggtaccggaaaccggtaaccgtacccggtacccggggtaacttaccccgtagggaaggtaaccggttaactttcccgttccgtaccggtacccccttaccgaaccggtttcccgtaaccgggtaaccggggaaccgtaacgggttcccggggtaaccccttaacccgtttttaaggaaccctttaacgttaccgggttaacggggtcccccgggggtaccgtaagggggttaacgggaaaccgtagtaacggtaaacgtccggttaacgtaacctttaacgttaacgttttacgggttaacccgaccgtaaacccgaaggtaacgtaacggtttaacggggttcggttaacgtagttaccggggttaaggggttcgttaccgggggacggtaaacgggtaaaccgtagggttaccgtacccggtttcggtacggtaccggtaaccggtaacccccgtagggtaccccgttccccggtacccccgttggttaacccgtcccgtttcccggtttaccccgg

SEQ ID NO: 88876 - DNA, 617 bp, Homo sapiens
  misc_feature: GYAE6OF01CZS8J.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatattacttgttggttacaagcagaagtcaggccaggcccctgtactcggtcactccatgacggccagtccgacgacacgtccgggactcccgtagacgacgtatttcctctcgccctccagctcgaggacaggtcgccacttcgactactcgtaggtcggggaccgtaggtcggacgtagtagaagtcgtagaccttattattcgttaccgacaccagactagtagttacggtactaagtcggaaggggttacgtcgggacgggtaacgggtaccgtaaaggtttcgggaacccgtttccggttaggttaccgaccggtacccgaaggttccccgttaccggccccccgttacgggtacctccgttcccggttccccgg

SEQ ID NO: 88877 - DNA, 661 bp, Homo sapiens
  misc_feature: GYAE6OF01D5OIV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcacctgctctggatattcattcgacaaaagatatacttgttgttcagcagagtcaggcagcccctgtactggtcatccatgacggcctagtccgacgacacgtccgggactcccgtaggagtagactttcctctacgcccttaccagtccgtacgagggaacacggtcggcctaccgttgaactagtacgaggtcggggacccgtagggtacgggacgtacgtacggaagccgtagtaacctttaacgtaagtttacgttaaccggacctaccaacgggtaacgtaacggttaggtcggtacgtaggttaccgggtaagggggttacgttcggggaccgggaacgggttaccgaagggtttaccgtacccggttaccgtttcgggtacgaacgtaccccggaaggtccccgtaccggtacccccgttagggtccctaccgttccgtttaacccccg

SEQ ID NO: 88878 - DNA, 762 bp, Homo sapiens
  misc_feature: GYAE6OF01CDXEK.21.8.A08.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagcatactctacaggggggctgtgggctcaggaggcagagctctggggaatctcaccatggcctggacccctctcctgcctcccccctcctcacttttctgcacagtctctgaggcctcctatgagctgacacacgcccaccctggtgtcagtcgtccccaggaccaaacgggccaggatccacctgctcgtgganttcattcgaccaaaagatatacttgttgtccagcagaagtcaggccaggcccctgtactggtcatccatgacggccagtcgacgacaccgtccgggatcccgtgagacgtattctcgtcggacctacccgaacgtcgaggggaccggtcggaccctacggtttgactttccgtacggtaggggtccggggacccgtaggggtcgggaagggtacgttagggaacgtcgttacggtaaccgttaacgttaaccgtttacgtttaaccgttaccgaacggtaccgtaacggaaccgtaacggtaccggtaagggttccgggtactaacgggttaccggggacggggggtacccttaacggggtttcccgggggaaccgggggtaacggggtacccgggttaacggggtttaccgggtaacccccgggtttaccgggttaaccgggttcccggaaccgggtacccccggaaacgggtcccccgttacccgggtaccccccccggtttaccgggtacccgttcccggtttcccccgg

SEQ ID NO: 88879 - DNA, 700 bp, Homo sapiens
  misc_feature: GYAE6OF01D612I.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccgaggacgaaacggccaggactcacctgctctggagattcattcgaccaaaagaatatacttgttggttccagcagaagtcaggccacggcccctgtactggtcatccagtggacggccagtccgacgacaccgtccgggactcccgtagagagtactttcgtctcgccctccagcctacgacgggacaggtcggaccctaaccgttcgacttacgtacggtacgggttccgggggaccccgtaggggtacgggaacgtaggtacggaaacgtccttaggtaaccttaacgtagttttacggtaaccgcctaaccgaagtacgtaaggttaggtcggtactaaggttcgggtaagggggttacgttcggggaccgggtaacggggtaacccgtaagggtttacggaccccggtttccgtttagggtacccgtaaccggaccccgggtaaacggtcccggttaccccggtccccccgttaccgggttccctacccgttcccgtttacccccgg

SEQ ID NO: 88880 - DNA, 763 bp, Homo sapiens
  misc_feature: GYAE6OF01ARTP8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggactcacctgctcgtggagtattcattcgaccaaaagatatacttgttggttcaagcagaagtcaggccacggcccctgtactggtcactccatgacggccaggtcgacgacacgtccgggatcccgtgacgagtactttctctcgtaccctccgacgccgtacgaagggctacggtcggcctaccgttgtacctagtcgtacgggtcgggacccgtagggtacggacgtaagtacggaacgtcgtacgtaccttaacgttacgtttacgttaaccgaccctaaccgtaacggtaacgtaacggtttaacgggttacggttaccgttaacgggttaccgggtaaacgggggggtttaacggttacccggggaccggggtaaccggggtaaccggttaaaccgggtttaccgggtaaccccggttttcccgggtttacgggtacccggtaacccgggttaccccccgggtaaaacgggttccccggttacccccgggttaccccccccgggttacccggggtttaccccgtaccccggtttccccggttttacccccccggg

SEQ ID NO: 88881 - DNA, 658 bp, Homo sapiens
  misc_feature: GYAE6OF01ECL7U.21.8.A08.1.454.CMB.1.raw
  modified_base (170)..(170): a, c, t, g, unknown or other
  misc_feature (170)..(170): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgcttcttttaagnggtgtccagtgtcaggcgcaactggtggagtcgtgggggagcagtggtccagcctgggacggtccctgagcctctccgtggtgcagcgtctggattcagtatccggcttcctttgccatgcacgtcgggtcccgccgacggcctccgagggcgaaggggctgggaggtgggtggcgtattagtcgtggtatggagtagggaagtggaagtagtattatttagtacagtaccgttcggtagggaacgggtccgtaattcccaacctcttcccgtacaagaacgaactaacgtcgaacctaaccaaactctaacttagttaacttctaacgaaagtccggaaccggtctaggaacgacggacccggaggaccgtacggtacttaacggtcgtttaacgttacgtaggttaccggttacgttacgttttacgggacgttaacgggtttccgggggaacccgtaaccggggtaacccgttcgggtaaccccg

SEQ ID NO: 88882 - DNA, 741 bp, Homo sapiens
  misc_feature: GYAE6OF01A3BPQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggagtattcattcgaccaaaagatatacttgttggttccagcagaagtcaggccaggcccctgtctggcatccatgagccagtcgacgacacgtccgggactcccgtagagagactttctctcgccctccgagcctcgagggacacggtccggccctaccgtttgaaccttacgtccgacgggttccggggaccccgtaggggtacgggaccggtaagtacgggaaacgtccgtacgtaccttaacgttagtttacggttaaccgccgtaacccgtaaggtaaccgttaagggttaacggttacgggttaccgttaacgttaccggggtaaggggggtttaacggtttccgggggaacgggggtaaacggggtaacccggttaaacgggtttacgggtaacccccgggttacggttttaccggggtacccggaaccgggtaccccggtaaacgggtccccggttaccccggtacccccccggttccggggttaccctacccgtttcccggtttaccccccggg

SEQ ID NO: 88883 - DNA, 711 bp, Homo sapiens
  misc_feature: GYAE6OF01CPM0D.21.8.A08.1.454.CMB.1.raw
  modified_base (128)..(128): a, c, t, g, unknown or other
  misc_feature (128)..(128): n is a, c, g, or t
  modified_base (311)..(311): a, c, t, g, unknown or other
  misc_feature (311)..(311): n is a, c, g, or t
  modified_base (388)..(388): a, c, t, g, unknown or other
  misc_feature (388)..(388): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttcngcacagtctctgaggcctcctatgagctgacacagccaccctcggtgtcagtgtaccccaggacaaacggccaggatcacctgctctgggatattcattgacaaaagatatacttgtgtcagcagaagcagccaggcctgtactggtcatcatgagccagtcgacgacactccgggactcccngacgagtacttctcgtagccctcgacgtcctcgaaggggaccaaggttcgggaccctaaccctttaggacctttaancgaagggttcggggggaccccgtaagggtcgggaacggtaagttacggaaaggtccgttagaaccgtttaacgtaacgttttaggtttaaccgaccgtaaccgaaaggtaaccgtaaaggttaagggttcgggtacctaaggttaccggtaaggggggggttaactttaccggggacggggaaaccgggggtaaccgtaaacgggtttacggaaaccccggtttccgttacggggttacaacccgggtaacccccggaaacggggtaccctacccgggtcccccccttaccgggtacccgtacccgttcccgtttacccccgg

SEQ ID NO: 88884 - DNA, 630 bp, Homo sapiens
  misc_feature: GYAE6OF01DAHJW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagtattcattgaccaaaagaatatacttgttggttccagcaagaagtcaggccaggcccctgtactggtcatccatgaggccaggtccgacgaccacgtccgggatcccgtagagagtattctctcgccctccagtcctacggaggactaggtccggacctaccgtttgacttacgtcgacgggtcgggggaccccgtagggtacggaacgagtaggaacgccgtagtaaccttaacgttactttacggttaccgtactaacccgagaacgtaaggtaggtggtactagtaccggaggggttacgttcgggacgggacgggtaaccggaaggttcggtacccgtccggttggtaccgacgtacccggaggtcccgtaccggtccccccgtcggtcctccgttcccgttccccg

SEQ ID NO: 88885 - DNA, 583 bp, Homo sapiens
  misc_feature: GYAE6OF01C3AAN.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctagagagtacttctctcgccctccagcctcgaggacaggtcgccctaccttgacttatcgaggtcggggcccagggtacggacgtagtaggaagtcgtagacttaactagttagttacgacaccgagacgtaagtaggtggtactagtacggtaggggttacgttcgggacggtaacgggacctaaggttcgaccggttccgttggtccacggcccgaacggtccgtaccggtcccccgtacggtcctaccgtccgttacccg

SEQ ID NO: 88886 - DNA, 820 bp, Homo sapiens
  misc_feature: GYAE6OF01DKHKE.21.8.A08.1.454.CMB.1.raw
  modified_base (132)..(132): a, c, t, g, unknown or other
  misc_feature (132)..(132): n is a, c, g, or t
tcagtcgtcgctcgcacgaccggtgctcgatttagcatactctacagggggctgtgggctccaggaggcagacgctctgggaatctcaccatggcctggacccctctccgtgcctccccctctctactttcngcacagtctactggacgccctcctatggagctagacacacgacccacccgttcggtgtcgacgttccgaccccgaaggaaccaaacgggccaaggactacctacccgtgtcgtcgtagggactacttcattacgaacctaaaaagtacttacttacgtttgttcggttaccgaaggacgtaaggtaacgtcgacggtacccgacggtcccccttaggtaccgttcggtacctacgtccgtaggttcggaccggaccgtaacggtaccggaaccacccgaccggttaccggggtaaccttccccgaaggttaacgacggtaacctttccgtacgtcggtaccctacgacgtctcggaacggtacgtacggtcccgtaacctccgtttacgacctttagccgggtacgggtaccgggaccgttaaggggtacggaacgtacgtaaggaccgttacgtacggttaactaaaccggttttgtaacccgttaacgaaccctaacggtaagaccgttaaaggtcggttcgtaacgtagttaccggggaagggtttaccgtaccggggaacggtaacgggttacgtaaccggttcgggaacccgttttccggtaggtccctaaccgggacccggtacggtccccgttacccgggtacccccttaggtacccttacccggtccgtttaccccccgg

SEQ ID NO: 88887 - DNA, 570 bp, Homo sapiens
  misc_feature: GYAE6OF01CNLAO.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgacaaaagatatacttgttggtcagcagaagtcaggccacggccctgtactggtcactccatgacggccaggtcgacgacacgtccgggactcccgtgagagtacttctctcgcctccaggtcctacgaacgggacacggtcggacctacgttgactatcgtaggtcgggacccgtagggtcggacgtagtaggagtcgtagtacttactagttcgtacgcaccgagactagtagtgtacagtcggtagggtagtcgggacggacggacgtaggttcgaccgtcgtcggtcacgccgacggccgtaccggccccgttcggtcctacttcctccgttcccctaccccg

SEQ ID NO: 88888 - DNA, 859 bp, Homo sapiens
  misc_feature: GYAE6OF01EGD2Q.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacagacggccaggatcacctgctctgcagatggactgaaccaaaagaaatatagtacctttaagttacggtaacccaaacgaaggaacgaccgaagggccccaacgggtcccccttggtttacggttaaggtacgtaattaataaagtaaaacgacctaacgtaggaacggacggtacccctacgaaggtaacgtactccccgtaggacgtccgtaatttcctcgtcggtccctacccgagtccgtaccgaacggggtaccaaggccgtaacggttacccgtaacggtttacgaaccgttaacgttaccggtaaagggttaacggtaaaccggttaccccggaaaggggacccgtaaacggggaacgggtaaacccggaacggggttacccgttaacggttaaaccttttaaacggtttaacccgttaacggttaaacccgtaaaacggtaaggtaaccggtaaacgtaagggttaaacgggtaaccggtttaaccgttacggttaaacggggttttcgggggttaaccggtttacccgggggaacgggggtaaaccggggtaaacccgtaaacggtccggtaacccgggttaccccggttaacccgttacgggtaaccccggaaccgggtaaccccggtaaccggggtcccgttacccccccgggg

SEQ ID NO: 88889 - DNA, 851 bp, Homo sapiens
  misc_feature: GYAE6OF01CSAKB.21.8.A08.1.454.CMB.1.raw
  modified_base (129)..(129): a, c, t, g, unknown or other
  misc_feature (129)..(129): n is a, c, g, or t
  modified_base (177)..(177): a, c, t, g, unknown or other
  misc_feature (177)..(177): n is a, c, g, or t
  modified_base (354)..(354): a, c, t, g, unknown or other
  misc_feature (354)..(354): n is a, c, g, or t
tcagtcgtcgctcgcacgaccggtgctcgatttagcatactctacagggggctgtgggctcaggaggcagagctctgggaatctcaccatggcctggacccctctcctgcctccccctctctactttcngcacagtctctgacgcctctatgagctagacacagcccacccgtggtntcgagttccgacccgaggaaccaaacggcaaggtactcaccgttgtctcgtagggaatactttcgagttacgaaaccgtaaaaaaagtattacgtttaccgtttaggtttacggttacccgaagtaccgaaggtaaacgtcggaaccggaccgaaccgggtccccttaggttaccgnggttaaccaacgttaccagtacggaccgaccgtaacggttaccggaacgtaccgtaaccgttaccggggaacctccccgtaagggaacgtacggttaacctttccgtaccgtaccggtacccttaccgagtccgtacggaacgggaccgttacgggtccgtaaccccttaacgtttacgaaaccgttacgtacggtaaccgggtccgggaccgtaagggtacggaaccgtagtaacggtaacgtctaacggtaaccttacgttacggttacgttaaccgaccgaacgaggtaacgttacggtaacggttacggtaaccgttaggtaccgggttaagggggttaaccgttccggggaacgggtaaacggttaaccggtaacggtttccggtaaccccggttaccggtttacggaccggttacccggaacccggtaaccgggttccgtacccccggtaaccccggttacccggtaccttcccggttccgttaccccccg

SEQ ID NO: 88890 - DNA, 546 bp, Homo sapiens
  misc_feature: GYAE6OF01C8EX0.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganattcattgaccaaaagaatatacttgttggttccagcagaagtcaggccaggcccctgtactggtcatccatgaggccagtcgacgacacgtccgggatccctgagagattctctcgcctccagctcgaggacaggtcggcctaccttgactagtcgaggtcggggcctagggtggacgatgaagctgactactattgtacgcacagacagtagtgtcagtcgaggggttagttcgggacggacgggaccaaggttcgaccggttccgttggtcgacgacccgaaggcccgtccggcccccgtggtccctccgttcgtccccgg

SEQ ID NO: 88891 - DNA, 923 bp, Homo sapiens
  misc_feature: GYAE6OF01AURV8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgttcggtgtctacggttccgtacccccgaagggaaccgaaaaccgggccaagggacttaccaacccgttggccttcgtagggaacgtactttacctaagtttacggaaaccctaaaaaaaggtaactttaagtttaaccgttttggttttacgggtttaccccaaggaccgtaaaggtaaaacggttccggaaccggggtacccgtaaccggggtacccccccgtttagggtttaacccgttcggggttaccctaaacgttcccgtaaggttacgggaaccgggtccccgtaacgggttacccggaaccggtaaacccgtacccgggttaccccggggtaaccttccccggtaggaacggtaacggttacttaccgttcgtaccgtccctaccgacgtccgtaccggaacgggacctcggttaccggacccctaacgttcgaaccgttaacgtacgtaccggggtaccggggacccggtaagggttacgggaacggtacgtacggtaacgtcgtaacgtaaccgttacgttacgtttacggtaaccgtaccgaaccgtaaggtacgttaggttaaccggttacggttaccgtacggtaacgggtacgggggttaccggtaccggggacgggtacgggaaccgttacgggttaccgacccggtttccgttacgggtaccgaccgggtaccccgtaaagggccccgttaacccggccccgttaccggtcccgtcccgttcccgttcccccggg

SEQ ID NO: 88892 - DNA, 626 bp, Homo sapiens
  misc_feature: GYAE6OF01BO301.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatcacctgctctggagattcattgaccaaaagatatacttgttgttccagcagagtcaggccacggcccctgtactggtcactccatgacggccagtcgacgacacgtccgggactccctgagagattctctgccctcagctcgaggtacagtcggccaccttgactatcgaggtcggggacccgtagggtggacgtagtcggaagtccgtacgtaacttacttaagtttcgttaaccgaccgaccgacgtacgtaaggttaggtcgggtactagttacggaagggggttacgttacggggacgggtacgggtaaccgtaggttaccggtacccggttccggtttaggtacccgtacggtccccgaacggccgttacccggtccccccggtacggttcccgtaccgttcccgttccccgg

SEQ ID NO: 88893 - DNA, 731 bp, Homo sapiens
  misc_feature: GYAE6OF01CDVV1.21.8.A08.1.454.CMB.1.raw
  modified_base (129)..(129): a, c, t, g, unknown or other
  misc_feature (129)..(129): n is a, c, g, or t
  modified_base (180)..(180): a, c, t, g, unknown or other
  misc_feature (180)..(180): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgacggcctcctatgagctgacacacgcccacccgtcggtntcacggttcgccccaaggaacaaaccgggccaaggtactccacctgctcgtagggactattcagttacgaaccaaaaagattattacgttgttacggttaccaagcgtaagaacgtcaacgggccacggccctgtactggtacatccatcgaggccagtcgacgacaccgtcggactccgtagagacgtacttcgcttacgccctacgacgctacgacgggactaggtccggaccctaacgttaggaacttacgtaccgtacgggtcgggacccgtagggtacggaacgtaacgtaggaaacgtcgtaacgtaaccgtttaacgttaagtttacgttaaccgaacaaccgaaagtacgtaaggttaacggtcggtaacgtacgttacgggtaaggggttaacggtaccggggtacgggaaacgggtaaccgttaaaggttcccggtaacccggttacgggttaccggttaccgaaccggtaacccggtaaccgggtacccgtcccggtaccccccgttacggtaccctacccgttcccggtttaacccccg

SEQ ID NO: 88894 - DNA, 781 bp, Homo sapiens
  misc_feature: GYAE6OF01C5SQ6.21.8.A08.1.454.CMB.1.raw
  modified_base (129)..(129): a, c, t, g, unknown or other
  misc_feature (129)..(129): n is a, c, g, or t
  modified_base (134)..(134): a, c, t, g, unknown or other
  misc_feature (134)..(134): n is a, c, g, or t
  modified_base (166)..(166): a, c, t, g, unknown or other
  misc_feature (166)..(166): n is a, c, g, or t
tcagtcgtcgctcgcacgaccggtgctcgatttagcatactctacgagggggctggtgggctcaggaggcagagcttctggaatctcaccatggcctggacccctctctgcctccccctctcactttcnggcanagtctcgtgacggcctctatgagtctgacacngccctacccgtggtgtacgtaggtccgtaccccgagggaaccgaaaccggccgaaggtactccgtaccgtcgtctcggtggtactagttccgagttcggaaaccaaaaggtattacgttacgtttggttacgtaccagcgtagaagtcgacggaccgcggtaccctgtacgtacggtacacgtcgagttcggacggtcgtaaggtaccgaaccgtacgaccggtaccgggtactacccggtaaagaacggtagtaccgtttcccgtacgttacgggacccctaacggaaggttaccgtaacggacgggtaactcggaccgtaccctaacgttagaaccgtacgtacggaacgggttcgggaccgtaggtaggacttaagacgtaacgtcgtaactaacgtaatccggtaacgtaccgactaacggtacaacggttagtacggtcgtacggttaacgtacgggggttaggttacggtaccgggaacgggtaaccggtaacggttaaccggttacggttacccgggttacgttaggaaccccgtacggtaacccgggtagtaaccccgtcccgggtaaccccggtcggttacctccccgttccgggtttaccccccg

SEQ ID NO: 88895 - DNA, 798 bp, Homo sapiens
  misc_feature: GYAE6OF01EMXQ5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtctagtccgtaccccgaggaaccaaaccggccaaggactccacctgctcgtaggagtattcattcgaaccaaaagtaattacttacgttgttcggttacccagacaagtaacgtcgacggccacggcccctagtactcggtactacgtccgtacgtacggacggaccgtacggtaccgaccgaccgtaccggtaccggtacctacccgtaggagtacgtactttccgtccgtaccgtccccgttaccgacgtccgtacggaacgggaccgtacggccggtaccctaccgttacggtactacgtcgtacgggtaccgggtaccggtacggtacgggacgtaacgtacggaaggtccttagtaaccttaccgtttacgtttacgttaaccgacctaacccgtagggtaacgtaacggtttacggttacggtacgttacggttaccggggttaacgggggttacggttacccgggggtacgggaaacgggtaacccgttaacggttaccggtacccgggttaccggttacgggtaccgtaacccgggaccccggtaaaggtccccggttaccccggtaccccccggttggtaccccgtacccgttcccgtttacccccccgg

SEQ ID NO: 88896 - DNA, 746 bp, Homo sapiens
  misc_feature: GYAE6OF01DV2Y5.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgaggcctcctatgagctgacacacgtcccacccgtcggtgtcagttcgccccaggaccaaacggccaggatcacctgctctggatattcattcgaccaaaagatatacgttgttcgttaccaggtcagaagttcgaggcccaggcccccttagtacctggtactactccgtaatcggacgccaggtaccgacgactacgtccgggacttcccgagacgacgtacgttctctcggtccttaccgagtccgtacgacggtacgtagtccggacctaccgtttagaacccttagtcggtaacggtcccggggaccctaggggttacggactaagttacggaaagttccccgtaggtaaacctttaccgttaagtttaccggttacccggacccgtaaacccgtaggtaaaccgtacgggtttaaacgggttccgtaacgtaacggtttccggggtaacggggtttaccttaccgggggacggtaacgggtaacccgtaaggtttaccggtaccccggtttccggttagggtacctacggtaaacccccggtaaggttccctaccgggttccccccgtaggttcccgtaaccgtttcgttaccccccgg

SEQ ID NO: 88897 - DNA, 739 bp, Homo sapiens
  misc_feature: GYAE6OF01DRUM2.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccacccgtcggtntcagtcgtaccccaaggaccaaacggccaggactccacctgctcgtggatattcattacgaaccaaaaagtatattacgtttgttcggttcagcaagaagtcaggccacggcccctgtacgtggtcatccagtcgacggtccagtccgacgaccaccgtccgggacttcccgtagacgtagtcttactcgtcgaccctcgacgtccacggagggactacggtcggacctaccgtttagtaactagtaccgtacgggtaccggggcccgtaaggggtaccgggtaacggtaaacgttacggaacggttaccgttacgttaaaccgttaaacgtttaacgttttaccggttaaccgtaacccgaaccgtaacgggtaaccgtaaggttaacgggttccggtacgtaacggttacggggtagggggttaaccgtttcgggggaacgggtaaccgggtaacgtaaacgggttccgtacccgggtttcgttcgggtacgacccggtacccggaaacggtcccgttcccggacccccgttacggtcctaccgttcccgttaccccg

SEQ ID NO: 88898 - DNA, 702 bp, Homo sapiens
  misc_feature: GYAE6OF01C3SW4.21.8.A08.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggtgtctcaccatggcctggatccctctacttcctccccctcctcactctctgcacaggctctgacggcctcctatgagctgacacacgcccacccgtcggtgtcagtcgtccccaggacaggaccggccaggatccacctgcctctgcagntcggactgaccaaaagaattatgtactttagttacggtaaaccaacgaagaaccgaccgacggacccacggccccttggttaggtttagtagtaattaataaacgtaaagctaacgtggaagtaccggccctagaaggactaccgtacccgttaggaccgtccgttacgttccgtcgtacggtccgtaccgacgtccgtacgaacgggaactacggactaccggacttaaccggtagtaacgttacgtacgtaaggtaacgaacggttacgaacggacgaagggtaccgggaacgtcggtacgttacgtaattaccgttaacgtacgtaaacaaacggtagttaacggaacgttagtaagggtaacgttacctacggtttagggtacggggttacgtaccggggacggtaaaccggtacggaacgtccgttacggaccgttccgtacggcgaccgacccggtggtacccccgg

SEQ ID NO: 88899 - DNA, 689 bp, Homo sapiens
  misc_feature: GYAE6OF01B98R9.21.8.A08.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaacggcagntcacctgctcgngganattcattcgacaaaagatatacttgttgtccagcagagtcaggccacggccctgtgttggcatccatgagacgaggacgaccgacccgtccggactcccgtagagacgtacttccgtcgtggcctaccgaacgtcgaacgggtacggtcggacctacggttcgtatttccgtacgtacgggttcgggggacccgtaggggtacgggaagggtagtagggaaggtccgttacggtaaccgttaccgttaacgtttacgtttaaccgtacgtaacggaccgtaacgaacgaacggtcgtaagggttcggtacgtacggtacgggtaggggtactacgggttcgggaccggggtaacggggtaccgtacgggttaccggtaccggttaccggtacgggtaccgaccggtaccccggtaacggtcccgtcccggaccccccggttacggtacccgttccgttcccgttcccccgg

SEQ ID NO: 88900 - DNA, 671 bp, Homo sapiens
  misc_feature: GYAE6OF01BZ1W9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttggttcagcagaagtcaggccaggcccctgtactggtcatcatgagccagtcgacgacacgtccgggactcccgtagacgagtacttccgtctacgcccctccgagtccgtacgaaggggacctaggtcggacccctaaccgtttgaccttacgtcgtacgggttccggggacccgtaggggtcggaacggtaacgttaggaaacgtccgtacggtaacttacgttagtttacggtaccgactaccgaggctaaggttacggtcggtacgtagtacggtagggggttacgttcggggacgggtacggggtaaccgtaggttacccggtacccggttccggttagggtcccgacggtaccccgtaggtccccggttcccggaccccccggttacgggtccctaacccgtttcccgttacccccgg

SEQ ID NO: 88901 - DNA, 683 bp, Homo sapiens
  misc_feature: GYAE6OF01DIQR2.21.8.A08.1.454.CMB.1.raw
  modified_base (599)..(599): a, c, t, g, unknown or other
  misc_feature (599)..(599): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgctcttttaagaggtgtccagtgtcaggcgcaactggtggagtcgtgggggaggcagtggtccagccgtggggaggtcccctgagccctctcctggtgcagcgtcgtggattcagtatccggcttccttgccatcgccgacgtcgggtccgccgaggcctccgaggcgaagggggctgggaggtgggtggcgtaattacgtcgtggttatggagtagggaagtgagtaagattagttattcgaaggtacttccggtagggaacgggtccgtaacgtaccgaacctagtacctacgagtaacgaactaacgtcgaacccaaacaaccaactacttagttaacttaccgttaactaaacgtccggaacccggtaccgtaggaacgtaccggaccgggtaacggaccgtaacccgggtattaacgttagttaaccgttttaacgngggttaaccggttaggttcgttttaacgggtctaacggggtttacggggcccgtaaacggggttaccccgttgggttaaccccg

SEQ ID NO: 88902 - DNA, 716 bp, Homo sapiens
  misc_feature: GYAE6OF01CDVO5.21.8.A08.1.454.CMB.1.raw
  modified_base (129)..(129): a, c, t, g, unknown or other
  misc_feature (129)..(129): n is a, c, g, or t
  modified_base (367)..(367): a, c, t, g, unknown or other
  misc_feature (367)..(367): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgagcctctatgagctgacacacgcccacccgtcggtgtcagtcgcccaggacaaacggcaggactcacctgctcgtggatattcattcgaacaaaagtatatacttgttcggttccagcgtagaagtcgaacggccacggcccctaggtactcggtaccataccgagtcgaacggccacggtcgaacgacaccgtaccgggactcccgagacgatacgttctcgacncctacgatcgtacgaggtacacggtacggctaaccgtggaaccttagtacgtagggtcgggtacccgagggtaggaacgtagtacggaacgtctacgtaacttacgtattacgtaaccgcgaaccgaagtaaccggttaagtacgggtacgttacgtaacggtaccggtaaggggggtttacctacggggaacggggtaacgggtaaccgttaacgggttcggtaaccccggttcccgggttaagggtaccccggaaacgggtacccccgtaaggggtaccccgtttacccgggtacccccccggttacggggttcccctaacccggtttccccgtttaccccccgggg

SEQ ID NO: 88903 - DNA, 782 bp, Homo sapiens
  misc_feature: GYAE6OF01BWRNV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtcccaggacaaacggcaggactccactgctcgtaggagtattcattacggaacctaaaaagtattattacgtttggtttacggttaccagtacaaggtaacgtcgacggaccacggtcccctaggtacgtggtacctacgtccagtcggacggcctaggtaccgaaccgacgtaccgtccgggactcccgtggaacgtagtaacttactccgtcgaccctaccgagtacctaccggaggggaacctcggtaccggaccccttaacgttacgtacgttaacgttaccggcgggtaccggggcccggtacgggtacgggtaacgtaagtaacggaacggtacgtacgtaaccgtttaacgttaacgtttaaccggttaccgaccgtaaccgtaacggtaacgttaacggtaacggttacggtacgtacgtacggggttaacggggttaacggttacggggaccggggtaacgggtaaccggttaaggttacccggtacccgttaccggttagggtacccggtaccggacccggtaaacggtccccggtacccggtaccccccggttacggtacccttacccggttcccgtttacccccggg

SEQ ID NO: 88904 - DNA, 628 bp, Homo sapiens
  misc_feature: GYAE6OF01A8347.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagatatacttgttgttccagcagagtcaggccaggcccctgtactggtcatccatgacgccagtcgacgacaccgtccgggactcccgagagacgtacttcctctcgccctccgacgtccgtacgaacgggactacgggtcggccctaccgttagaaccttagtcgaggtcggggacccgagggtcggacgagtacgaacgcgttacgaacttacgttacgtttacgttaccgcgaaccgaagacgtaggtagtcggtactacgttacggtaggggttacgttcggggacgggtagggaccgtaaggttaccgtaacccggttcgttggtaccacggacccgaaggcccgttaccggaccccccgtacggttcctacccgttccgttccccgg

SEQ ID NO: 88905 - DNA, 829 bp, Homo sapiens
  misc_feature: GYAE6OF01B6MB4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtcggtgtcaggttcgtaccccgaggacgaaacggccaaggactccacctgcctcgtggagattcattcgaccaaaagatatacgttgttcgttaccagcagaagtcaggccacggccctgtacgtggtcatccagtcgacgccgtagtcgacgacacgtccgggaactcccgtaggacgtacgtacttcctacgtcgtcccttacccgagcgttaccggaacgggtacacggtacggacctaaccgttggtaactacgtacgacgggtcgggtaccccggtaagggtcgggaacgtaacgtacggtaaacgccgtttacgtaaccttaacgtttaacggtttaccgttaacgacccgtaaccgtaacgtaacgttaaagttacggggttaccggttaccgttaagggtaaccgggtttaaggggggtttaaccggtccggggggaaccgggttaaaccggggtaaacccggttaaacgggttttaaccggggtaacccccggttttaccggggttttaaccgggtaccccgggtaaaaccgggtaacccccgggttaaaccgggggttccccggtttaaccccccggggtacccccccgggtttttcccgggaaccccggttttacccccgttccccgggtttttaaccccccccggg

SEQ ID NO: 88906 - DNA, 610 bp, Homo sapiens
  misc_feature: GYAE6OF01CCZKQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattcgaccaaaagatatacttgttgttccagcagaagtcaggccacggcccctgtactggcatccatgacgccaggtcgacgacaccgtccgggactcccgtgagtagtacttctctcgccctccagcctcgagggacaggtcggcctaccgttgactatcgaggtccggggcccgtagggtaggaacgagtacggaacgtcgtagtaaccttagttacgtttcgttaaccgacaaccgtaagacgtaggtagttcggtacgtagtcgggtaagggggtacgttacgggacgggtagggaccgtaaggttccggtacccggttccgttagggtccacggaccccgaaggccctccggtcccccgtcggtcctccgtccgttccccg

SEQ ID NO: 88907 - DNA, 673 bp, Homo sapiens
  misc_feature: GYAE6OF01B5RN4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtcggtgtcagtcgtccccaggacaaacggccaggactcacctgctctggagtattcattgaccaaaagtaatatacttgttggttccagcagagtcaggccacggcccctgtactggtcatccatgacgccagtccgacgaccaccgtaccgggactcccgtagacgtagtacttctctcgccctccagtctacgaggactaggtccggacctaccgttagacttacgtacgagggtccgggcccgtagggtcggacgagtagacgtacgtagtaaccgttacgttacttacgttaccgaccaacgaacgtactagggttagttcggtacctaggtacgggttaacgggggtacgttacgggaccggggtaacggaaccgttaggtttaccgggtacccggtttccggtttacgggacccgtaacgggaccccgtacggggtcccctacccccgggtacccccgttccgggtacccttacccggttcccgtttaccccccgg

SEQ ID NO: 88908 - DNA, 711 bp, Homo sapiens
  misc_feature: GYAE6OF01ENEDB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccaccctcggtgtcagtcgtccccaggaccaaacggccaggatccactgctctggagtattcattacgaaccaaaaagtaattaattaccgttttggtttcggttacccaggtacgaaaggaacggtccgaacggcccgacggtcccccttaggtacctgggttaccacgtacccgagttggaccggacccgtaggtaccggaaccggtaacctacccggtaccccggggacttcccccgtagggaacgtacgtactttccgtaccgttcgtacccctccgacgccttacggacgggacacggtccggaccctaccttagaccttacgtcgacgggtccggggacccgagggtacggacgtagtaggaacgtcgtagtaccttacgttagtttacggtacgacacgagaacgtagtagtgtacgtagtacggtaggggtagtacgggacgggacgggtacgtacggttcgtacccggttcgttcggtccgaccggacccgacggtcccgtacccggccccgttacggactccgtccgttccccg

SEQ ID NO: 88909 - DNA, 623 bp, Homo sapiens
  misc_feature: GYAE6OF01D5ZLP.21.8.A08.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggacaaacggccaggatcacctgctctgagattcattgaccaaaagatatacttgttggtcagcagaagtcaggccaggcccctgactggtcatccagtgacggccagtcgacgacncgtcgggactcccagacgagacttcgtctcgccctcgagtcgtcgagggacaggtcggaccctacgtttacgacttacgtcgtacgggtcggggccccgtaagggtacggtacggtagtaggaacgtcgtacgtaacttaacgttagtttccgtaacgcaaccgtagacgtagttagtcggtactagttcggtaggggttacgtcggggacgggaagggtaccgtaggttacggcccgttaccggttaggtaccgaacggtacccgaagggtcccgtacccggtcccccgtcggttaccaccgttccttaccccg

SEQ ID NO: 88910 - DNA, 662 bp, Homo sapiens
  misc_feature: GYAE6OF01BEJRZ.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtntcagtcgtcccaggacaaacggccaggactcacctgctcgtggagtattcattacgaaccaaaagtattactactttggttcgttccaagacaagaacgtcgacggccgacggtcccctgtacgtggtcactccagtggacggccgagtccgaaccgacaccgtccgggactcccgtagagactacttcctcgtcgccctaccgacgtcgtacggacggacgtacggtcgacctaccttgacttacgtcgacgggtccgggacccgtagggtacggacgagtacggaacgtcgttacgtaacttacttagtttacgtaaccgccaaccgagtacgtaggttacggtgtacgtagttacgggtaggggttacgtacggggacgggtacgggtaccgtaaggttcggtaccggttcgttacgggtaccgaccggaccggtaacggcctacccggtccccgttacgtcccttccgtccgttccccgg

SEQ ID NO: 88911 - DNA, 618 bp, Homo sapiens
  misc_feature: GYAE6OF01EO2Z4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgagattcattcgacaaaagatatacttgttgttccagcagaagtcaggccaggcccctgtactgtcatccatgagccagtcgacgacacgtccgggatccctagacgtagactttcgtctcgccctccgaagcctacgagggactaggtcggaccctaccgtttgaactactaccgtacgggtccggggacccgtagggtcggaacgtagtaggaacgtcgtacgacttaacgttagttacgttacgaccaccgaagactagtaacgtcgtacgtagtaccggtagggggttacttcggggacgggaacggtaacgtacgggttacggtacccgttccgttaggtacacgtacccgacggcccttcccggcccccgttaccggtcctaccgtccgttccccg

SEQ ID NO: 88912 - DNA, 772 bp, Homo sapiens
  misc_feature: GYAE6OF01D4NM0.21.8.A08.1.454.CMB.1.raw
  modified_base (527)..(527): a, c, t, g, unknown or other
  misc_feature (527)..(527): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacggcctcctatgagctagacacacgcccacccgtcggtgtcgagttcgtaccccgaaggaaccgaaccggccaggactccgacctgcctcgtggatattacagttacgaaccaaaagtaattacttacgtttggttacggttacccgagtacgtaaggtaacgtccgacggtacccgacggtacccccttggtaaccgtcggtacctaacgtaccgaggtacggaaccggtcccgtaacggtcccggtaaccgaccgtaccggtacccggggtaccttacccggtaggtaacgtacggttactttccgtaccgttacgtccccgttacgacggtaccgtacgggtacgggtaacgtacgggtcccggtaaccctacgggtttanaaccgttagtaccggacggggttccgggacccgtaggggtacgacggtaagtagggactacgtataaccttagtacgttacgaccgtacaccgtaaggacgtaacggttggtacggtacgtaacggttacgggtaggttacggtcggaagtacgggaccggtacgtaacggttccgtaccggttcgtacggtacgaccgaccgtacggtcccgtcccgttacccgtacgtcctcccgttacccgg

SEQ ID NO: 88913 - DNA, 692 bp, Homo sapiens
  misc_feature: GYAE6OF01CGTUC.21.8.A08.1.454.CMB.1.raw
tcagtcgtcgctcgcacgaccggtgctcgatttagcatactctacagggggacgtgtgggctccaggaggcagagctctgggtaatctcgaccatggcctggacccctctacctgctccccctcctcacctttctggctacgagtctctgtacggtcctccttatgagtctgtacacagcctacctggtgtcagtcgtcccgaggacaacggcgaggactcgacctgcctcgtggacgtattcgattcgaccaaaagtatatacttgttgttccagcagtaagtcaggccaggtcccctgtacgtggtcactccgagtcggacggccacgtcggaacgacgacgtccgggactccgtagacgtagtacttctactcgcctccgagtcgtacgacgggtactacggtcggtacctacgttcgtacttacgtcgtagggtaccggggccctaagggtacgtacgtacgttacggaacgtccgtagtaaccttacgttacgttacgtaaccgcctaaccgtagtactaggtaacggttcggactagtacggtagggggtacttcgggacgggacgggtaacctacgggttacggtacccgtttcggttaggtacccgtcgggtaaccccgtaagggttccccttacccgggtacccccgttagggtacccggtcccgtttaccggttacccccgg

SEQ ID NO: 88914 - DNA, 517 bp, Homo sapiens
  misc_feature: GYAE6OF01E41XN.21.8.A08.1.454.CMB.1.raw
  modified_base (317)..(317): a, c, t, g, unknown or other
  misc_feature (317)..(317): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
  modified_base (507)..(507): a, c, t, g, unknown or other
  misc_feature (507)..(507): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtgtccccaggacaaacggccaggatcacctgctctggatattcattgaccaaaagatatacttgttgtccagcagagtcaggccaggcccctgtactgcatccatgagccagtcgacgacaccgtccgggatcccngagagtattctctcgccctccagtcctcgacggacacggtcgcctaccttgactagtcgaggtcgggcccgaggtcggacgagtagagctgtactactattcgtacncacagacngtagtcgntagtcgtagggtntcgggacggaggactagtcgccgtcgttgcncgccgacgctcgccccgtgtccncgtcgtcccg

SEQ ID NO: 88915 - DNA, 633 bp, Homo sapiens
  misc_feature: GYAE6OF01EWE0Z.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccacccgtggtgtcagtcgtccccaggaccaaacggccaggatcacctgctcgtggatattcattcgacaaaagtatatacttgttcgtcagcagaatcaggccacggccctgtactggtcatccgagtcggacgccaggtccgacgacaccgtccgggactccgagagtactacttcctctacgccctaccgagtcctacggaacgggactacgggtccgaccctaacgtttgaaccttacgtcgacgggttccggggacctagggtacggacgagtagaacgtcgtacgtaacttacgtagtttacgtaccgacctaaccgagaacgtaggtacggtcggtacttacggtacgggtaacggggttacgtaccgggacgggaacggtaacgtacggtcgtaccggttcgttaggccgacggacccgacggccgtcccgtaccccgtacggtcctcgtcccgttcccgg

SEQ ID NO: 88916 - DNA, 635 bp, Homo sapiens
  misc_feature: GYAE6OF01AYTXD.21.8.A08.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgaccacagcccaccctcggtgtcagtcgtccccaggacaaacggccaggactcacctgctcgtggagtattcattgaccaaaagtattatacgttgttgttccagcagaagtcaggccacggcccctgtactggtcactcagtgacgccaggtccgacgaccgaccgtccgggactcccgtagacgagtacttctcgtcgccctcgacgctcgaggacncggtcgaccctacgttgactacgtcgtaggtcgggaccgtagggtcggacgagtacgaacgtcgtacgtaacttacgttacgttcgtaccgacaccgagacgtagtaggtacgtacgtagtacggtaggggttacgtacgggacgggtacgggaaccgtaacggttcggtacccggttccgttagggaccgtaccggaccccgtaacggtcccgtcccggtaccccccgttacgggtccctacccgttccgttaccccg

SEQ ID NO: 88917 - DNA, 906 bp, Homo sapiens
  misc_feature: GYAE6OF01C52G8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtcgtcagtcgtccccaggaacgaaaccggccaggactccaccgtgcctcgtggatattcattacgaccaaaaagatattacgttgttcgttccagtcaagaacgtcacggccacggccctggtatcggtctaactccatcggacgtccgagtaccgaccgaaccgtaccgtccgggtaactccccgtaggacgtaacggtacttccgtcgtaccggtcccttaccggacgtccgtacggtaaccggggtactaacgggtccggaccccttaaccggtttacgaaacctttacgtaccggtaacggggtcccgggggtaacccggtaacgggggtacggggtaaaccggtaacggtaacggggtaaaccggttccgtaacgggttaaacccgtttaaccgtttaacggtttaccggtaaccccggtaacccgtaaccgaaccgggtaaaccggttaacggttaaccgggtttacgggttaacccggttacggttaacgggggttaacggggggtttaaccgggtttaccggggggtaaccgggggtaaacccggggttaacccgggttaaacccggggtttccgggttaacccccggggttttcccgggtttaaccggggttacccgtaacccggggtaaccccgggtaacccgggttccccggttaccccgggtacccccccggtttacgggttccccggttacccgtttccccggtttaccccccggg

SEQ ID NO: 88918 - DNA, 631 bp, Homo sapiens
  misc_feature: GYAE6OF01AU2TS.21.8.A08.1.454.CMB.1.raw
  modified_base (178)..(178): a, c, t, g, unknown or other
  misc_feature (178)..(178): n is a, c, g, or t
  modified_base (351)..(351): a, c, t, g, unknown or other
  misc_feature (351)..(351): n is a, c, g, or t
tcagtcgtcgctcgcacgaccggtgctcgatttagcatactctacagggggctgtgggctcaggaggcagagctctgggaatctcaccatggcctggaccccctctcctgcctccccctcctcactttctgcactgtctctgaggcctcctatgagctgacacagcccaccctcggtntcagtcgtccccaggaccaaacggccaggactcacctgctctggagtattcattgaccaaaagatatacttgttgttaccagacagaagtcgagccaggcccctgtacgtggtcactccatgacgccagtcgacgacaccgtccgggactcccgtgagtacgtattctcgtcncccgtcgacgccgtacgaggggtacaggtcgaccgtaccttgaccttagtccgtagggtcggggacccgtagggtacggacggtagtacggaacgtcgtacgtaacttaacgttagttcggttaaccgaccaaccgaaggaactaggttagtacggtagtactacgggtaggggttactcgggacggtagggaccgtaggttaccggtaccgttccggtcggactaccggacccgtaggacccgtccggacccccgttaggtccctccgtcgttccccgg

SEQ ID NO: 88919 - DNA, 629 bp, Homo sapiens
  misc_feature: GYAE6OF01CDGWA.21.8.A08.1.454.CMB.1.raw
  modified_base (177)..(177): a, c, t, g, unknown or other
  misc_feature (177)..(177): n is a, c, g, or t
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtntcagtcgtccccaggacaaacggccaggactcacctgctctggagnttcattcgaacaaaagaatatacttgttggttcagacaagaagtcacggccacggcccctgtactggtcatccagtgacgccagtcgacgacaccgtaccgggatcccgtagacgtagtacttctctcgccctcagtcctacgacggactacggtcgaccctacgttcgacttacgtacgtagggtccggggaccgtagggtacggaacgtagtacgaacgcgtacgtacttaacttagttacgtaccgaccacgaagacgtaaggttagtcggtacgtagttacgggtacggggttagttacgggacgggtaacggtaaccgtaaggttccggtaccggtttcgtcgggacaccggaccgaaccggtcgtcccgtacccccgtggtaccctcgtccgttccccgg

SEQ ID NO: 88920 - DNA, 777 bp, Homo sapiens
  misc_feature: GYAE6OF01EY1XT.21.8.A08.1.454.CMB.1.raw
  modified_base (445)..(445): a, c, t, g, unknown or other
  misc_feature (445)..(445): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcactttctgcacagtctctgacgtcctcctatgagctacgacacacgccctacccgtcggtgtcgtacggtccgtaccccgaaggaaccgaaacggccgaaggactccaccgtgtccttcgtagggatacttactacgttacgaaccgtaaaaagtattacttacgtttcggttcggtaccagacgaagtaacgtccgaacggtccgaaccggtccccgttaggtaccgtcggttacctactaccgtagtacgggaccggaccgtacggtccggaaccgaccgtaccgtccgggacttcccgtaggacgtactcgtttaccncgtccgaccctacgacggtacgtacggaacgggtaccgtacggtccgtacccttacgttacgtacttacggtcggtaaccggggtccgggaccgtagggtacgacggtagtaacggacgtacgtacgtaacgttacgttacgtacgtaccgacctaacgaggtaacgtggtaacggtcgtacgtaacggttcgggtaagggttccggtacggggaaccggacgggtaaccgttagggtacccggttcccggtacgttcgggaacctccggaaccccgggtacggtcccgtacccgggtcccccgtagttccccgtccgtcccggttcccccg

SEQ ID NO: 88921 - DNA, 519 bp, Homo sapiens
  misc_feature: GYAE6OF01BV1C3.21.8.A08.1.454.CMB.1.raw
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactctctgcacaggctctgaggcctcctatgagctgacacagcccaccctcggtgtcagtcgtccccaggacagacggccaggatcacctgctctgcagatggactgaccaaagaatatgcttattggtaaccaacagaagccaggccaggccccctgtgttagtgatatataaagacactagagaggccctacagagactccctgagcgattctacgtggcctccgagtcgtacgagggacagctagtctacgttnaactatnagtagaatcgaganagagacgngacngactatactcgacaagagtaganaggtaagagtactgtagttgggtagttcgggaggagggacgacgcgtacggcccgtacgtacggtcacgcccgaggtaccccg

SEQ ID NO: 88922 - DNA, 709 bp, Homo sapiens
  misc_feature: GYAE6OF01C8TFQ.21.8.A08.1.454.CMB.1.raw
  modified_base (130)..(130): a, c, t, g, unknown or other
  misc_feature (130)..(130): n is a, c, g, or t
  modified_base (181)..(181): a, c, t, g, unknown or other
  misc_feature (181)..(181): n is a, c, g, or t
tcagtcgtcgctcgcacgaccggtgctcgatttagcatactctacagggggctgtgggctcaggaggcagagctctgggaatctcaccatggcctcggacccctctcctgcctccccctctctactttcngcacagtctctgagcctctatgagctgaacacacgtacccacccgtcggtntacgacgttcgaccccgaaggaaaccgaaaaccggcccgaaggacttaccaaccgtgtccttacgtagggaactatttacaagttacgaaacctaaaaaaggtattacttaacgtttgtttacggttaccaagacgaaagtaacgttaccaaggtcccgaaccgggtaccccctaggttaacccgtggttaccaacttacccgaagtacggacggacccctaaggtaccggaaccgtaaccgtaaccgttccgggaactcccggaagtaacgacgtactttcctacttcgacccttcgacgtactacgagtacgactacggtcgacccttacgttagactacgtcgacggtacgggaccagggtacgacgactaagactactacgtaactacgttacttcgtaacgaccaacgagtaacgaggttaagttcgtagacgtagggtaggtacgttcggacggtaagaccgttaagcgaaccgttcgtacggacaaccgcgaaggccttaccgacccttcggctcgtcccg

SEQ ID NO: 88923 - DNA, 665 bp, Homo sapiens
  misc_feature: GYAE6OF01E1JYU.21.8.A08.1.454.CMB.1.raw
  modified_base (277)..(277): a, c, t, g, unknown or other
  misc_feature (277)..(277): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggaccaaacggccaggatcacctgctctggagattcattgaccaaagatatacttgttggtccagcagagtcaggccaggccctgtacngtcatccatgagccagtcgacgacacgtccgggatcccgtgacgagtacttcctctcgccctccgagcctacgacgggactacggtcggacctacccgtttgaaccttatacgacggtcggggaccccgagggtcggacgtagtacggaagtcgtagtactacgttagttacgttaaccgcaacccgaggaacgtaggttacggtacggttaccgtaaggttaccggtaaggggggttacgttaccggggaaccgggtacggggtaacccgtaaacgggttaccggtacccggttcccgtttacgggtaccgtaccggtacccccggaaacgggtccccgtccggtacccccccgtacggttcccctacccgttcccgtttacccccg

SEQ ID NO: 88924 - DNA, 621 bp, Homo sapiens
  misc_feature: GYAE6OF01BU6UA.21.8.A08.1.454.CMB.1.raw
  modified_base (173)..(173): a, c, t, g, unknown or other
  misc_feature (173)..(173): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagccacctggtntcagtcgtcccaggacaaacggccaggactcacctgctcgtgagtattcattgacaaaagtatatacgttgttgttacaagcaagagtcgaggccaacggcccctgtactggtcactccgagtagacgccgagtaccgacgaactacgtccggactcccgtagacggtatacttctcgtcgcctacagctacgaggacagtccggactacgttgactagtcgtaggtcgggaccgaggtcgagagtacggaagtcgtacgtacttacgttacgttacgtaccgacgtaaccgatacgtaagtagttacggtactaacggtacggtaagggttacggtacgggacgggtaagggtaaccgtacggttaccggaccgttcggttacgtccggtaccgacccgtaacggccgtacccgtcccgttaccgtcccttaccgtccgttaccccg

SEQ ID NO: 88925 - DNA, 721 bp, Homo sapiens
  misc_feature: GYAE6OF01DTK5L.21.8.A08.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccaccgtcggtgtcagtcgtcccaggacaacggcagntcactgctcgnggatattcattcgaccaaaagtatatacgttgttgttccagcagaagtcgacgccgacggcccctgtacgtggtctactccagtgacggcacgtcgaccgacgacgtccgggactcccgtagacgacgtacttcgacttcgcctaccgacgtccgtacgacgggtactacggtacggaccctaccgtttaggaaccttcgtaccggtacgggtaccgggggacccgtacggggtacggaaacggtaacggtacgggtaaacggtcgttaacggtaacctttaacgttaacgtttacggttaaccggtacctaaccgaagtaacggtagttacggtacggtcgtaacggtacgggtaacgggggttacttaccgggggaacgggacggtaaaccggtacgggttaccggtacccgggtttccgttaggggtacctacccgggtacccgaacgggtcccgtacccggtacccccttacggggtacccctacgttcccgtttacccccgg

SEQ ID NO: 88926 - DNA, 733 bp, Homo sapiens
  misc_feature: GYAE6OF01CLWQ8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggaacaaacggccaggactcacctgctctggatattcattcgaaccaaaagaatatacttgttgttccagacagaagtcgacggccacggcccctagtactggtcatccagtgacggccagtccgacgaccacgtccgggactcccgtagacgagtactttctctcgccctccagcgtacgacgggactaggtcggtaccctaaccgtttggaaccttgtacgacgggtaccgggggaccgtaaggggtcgggaacgtagtaacggtaacgcgttaggaacctttacgttaacgtttcggttaaccgtacaacccgtaacggtaacgtaaggttacgggtacgggtacgtaacggttcgggtaaagggggtttacggttacggggaacggggttaaccgggtaaccggttaaacgggttccgggtaaacccggtttccgggtttacgggtaacccggtaaccggtaccccggtaacgggtaccccgttacccgggtacccccccggttacgggtaccccgttacccgttccggtttaccccccgg

SEQ ID NO: 88927 - DNA, 724 bp, Homo sapiens
  misc_feature: GYAE6OF01DE8OB.21.8.A08.1.454.CMB.1.raw
  modified_base (225)..(225): a, c, t, g, unknown or other
  misc_feature (225)..(225): n is a, c, g, or t
  modified_base (372)..(372): a, c, t, g, unknown or other
  misc_feature (372)..(372): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccacccgtggtgtcagtcgtccccgaggaacaaacggccaggatcacctgctctgganttcattcgaccaaaagatatacttgttcgtccagcagaagtcaggccacggcccctgtactggtcatccatggacgccgagtcgacgacaccgtccgggactcccgtagagagtacttcctctcgccctccgatccgtacgaggacnggtcggcctacgtcgactatcggacggtcggggaccctagggtacggaacgtacgtacggaacgtcgtacgtaaccgttaacgttaacgttacgttaaccgaccaacccggtaacgtaacgttaaggtaacgggttaccgttacgtaacggttacgggtaacggggggtttaccgttacccgggggtaacggggtaaacccgggttaaacccgtaaacggggtttacccggtaacccggtttaccgggtttacgggtacccggtaaccggtaaccccggtaaccggttcccggtaccccggttacccccccggttacggtacccgtaccccggttcccgtttaccccccggg

SEQ ID NO: 88928 - DNA, 664 bp, Homo sapiens
  misc_feature: GYAE6OF01BLHJX.21.8.A08.1.454.CMB.1.raw
  modified_base (515)..(515): a, c, t, g, unknown or other
  misc_feature (515)..(515): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgttcggtgtcaggtcgtccccaggaccaaacggccagggactccacctgcctcgtaggatacttcacgttcgaacccaaaaagtattacttacgtttggttcggttaccagtctaagaagtcacggccacggtcccctgtacctggtcactccatcggacggtccagtccgacgaccacgtccgggatccccgtgacgtacgtacttctctcgcccttccagtccgtcgaacgggactagggtccgaccctacgttcgaaccttacgtacgacgggtcggggtcccgtaggggtcggaacgtagtacggaacgtcgtacgtacttacgttatttcggttaaccncgtaaccaaggtacgtaaggttagtacggtatacgtacggaggggttactcgggtacggacgggtaacctaaggttccgtaccggtcgtttcggactacggacccgagggccttaccggtcccccgtaggtcccttcgtccgttacccg

SEQ ID NO: 88929 - DNA, 855 bp, Homo sapiens
  misc_feature: GYAE6OF01DM3AS.21.8.A08.1.454.CMB.1.raw
  modified_base (383)..(383): a, c, t, g, unknown or other
  misc_feature (383)..(383): n is a, c, g, or t
tcagtcgtcgctcgcacgaccggtgctcgatttagcatactctacagggggctgtgggctcaggaggcagagctcgtgggaatctcaccatggcctggactccctctacttcctccccctcctcactctctgcacgaggtctcgtggacggtcctcctagtgacgctagacacacgcccacccgtcggtgtaccacggtccgtccccgaggacgacggaccggaccgaaggtactccgaccgttgccgttacgtagacgagagttacggacgtacgaaaccgtaaaagtaagttagtcgttactttagtaaccggtaaccaaaggacggaccgaccgacggacccgtaccggtccgttagtacggttagagtaataagtaaanaacgactacgtaggacgtaccgcctagaacggtacgtacctccgtaggacgtacgttcttcgtaccggtcggaccttacgacgtacgtacgggaacggactacgtacgttacgtaccgtaacgttacgaactttacgacggtaaacggtacggtaaccgtccgggaacggtacgggaaacgggacgggaaacgtacgggtaccgttaaacgttacgttttaacctaaacgggttaaacgttaaaaacgggtaaacggtaccggttaaagaaacggggtttaaacggtacccgtttaagggttccgggtttaaggggtttccggggggttaaccgggttaacggggggaaccgggtaaccgggtaaacgtaccggttccccgggttaacccggttaacccggttacccggggttaacgtacccccggaaagggttcccccgggttaacccggtcccccggttaacccccccgg

SEQ ID NO: 88930 - DNA, 770 bp, Homo sapiens
  misc_feature: GYAE6OF01D64U3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtcggtgtcagtcgtccccaggaccaaacggccaggactcacctgcctcgtggagtattcattcgaaccaaaagtaattattacgtttgtttacggttacccagacgaaggaagtccgacggcccacggtcccccgtgtaccgtcggttacacgtccagtaggacggccgacggtaccgaccgaccaccgtccgggacctccgtaggacgtagtacgttcctcgtcgtccctccacgtcgtaccggaacggtaccgtacggtccggaccctaccgtttaccgacttaacgtccgtacggggtaccggggtaccccgtaagggtaccgggaacgtacgtacgggtaaggtccgtaacggtacctttaacgttacgtttacggttaccgacccgtaaccgagtaacggtaacggttaaggttacggttacgtaaggttacgggtaacggggggttacgttaccggggacggggtaaccggggtaaccggttaaacggttaccgggtacccgtttccggttccggtaccgtaccggaacccggtaacggtcccgttcccggtaccccccttacgggttccctacccgttcccgttacccccgg

SEQ ID NO: 88931 - DNA, 756 bp, Homo sapiens
  misc_feature: GYAE6OF01BC6H2.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggcctcctatgagctgacacagcccaccctggtntcagtcgtcccaggaccaacggccaggactccacctgcctgtggatattcattagaaccaaaagtatattacttgttacgttccagtacgagaagtcgacggccacggtcccctgtacgtggtccaatccaagtggaaccgtcacggtcgaaccgtactaccggtccgggactcccgtaggacgtacgtattccgtacgtcggccctacgagtccgtcgaagggtacctacggtcggtaaccccttacggttcgtaacttacgtacggtacggggtaccgggcccgtaaggggtccgaacggttaacggtacggaaacgttcgtacgggtaaccctttaacgttaagtttaccggttaacccgccgtaacggacgtacgtaacggttacggtacggtacctacgggtacggtacgggggttacgtacgggacgggtaacggtaacccggttaggttaccggtacccggtttcggttaccggacggtaaaccccgggtaccccggtaaacggtccccgtttaccccgggtaccccccggttacggtaccccgtttccccggttccggtttaacccccccgg

SEQ ID NO: 88932 - DNA, 854 bp, Homo sapiens
  misc_feature: GYAE6OF01D0JYX.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcactgtctctgacggcctcctatgagctgacacacgccctacccgtcggtgtcagtcgtaccccaaggaaccaaacggccaaggactccacctgctcgtggagtattctagttacgaaccaaaaagtattacttacgttggtttcggttaccagacgaagtaacgtcgacggaccgtaacggtccccttaggttaccgttacgggtacaacgttcccgtaaggttcgggaacgggtcccgtaaggttacccgaaaccggtacccgtaacccggtttccccggggaactttaccccgttaggggaacgttaacggttactttccctccgttaccgtaccccgtaccgtaacggtcccgttaaccgggaaacggggttaacctacgggtacccgggtacccccttaaccggttacggtaaccttacgtaccggtaacggggttaccggggacccgtaaggggtacgaacggtaacgtacggtacgtacgtacgtaactttacgtaacgtttacgtaccgtaccgaaccgtaagtacgtaagggttacgtacggtacgtaacggttacgggtaacggggttacgtaccgggggtaacgggtaaacgggtaccggttaaacggttaccggtacccggtttccggttagggtaacccgtacccggaacccggtaacggtcccgttaccccgtccccggttacggtacccttccgttcccggtttcccccg

SEQ ID NO: 88933 - DNA, 584 bp, Homo sapiens
  misc_feature: GYAE6OF01E095P.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacagccaccctcggtgtcagtcgtccccaggacaaacggccaggatcacctgctctggagattcattgaccaaaagatatacttgttgttccagcagaagtcaggccaggcccctgtactggtcatccatgagccagtcgacgacactccgggatcccgtgagagtattctctcgccctccagctcgagggacaggtcggacctaccgttgactatcgaggtcggggaccgagggtcggacgagtaggaacgctagtactacttagtttacggttaccgacaaccagacaggtagtcggtacagtacggaggggttatacgggcggtacgggaccgtaaggttcgtaccggttccgttggtacgacgaccccgaacggccgtcccggtccccccgttacggttccctaccgttcgttaccccg

SEQ ID NO: 88934 - DNA, 653 bp, Homo sapiens
  misc_feature: GYAE6OF01CS37G.21.8.A08.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggaacaaaacggccaggatcacctgctctggagtattcattacgaccaaaaagaatatacttgttgttccagcagaagtcaggccaggcccctagtactggtcatccatgacgccagtcgacgacacgtccgggactcccgagacgagtacttctctcgccctccgagtcctacgacgggtacncggtcgaccctaccgtttgaccttagtacgtacgggtccggggaccccgtagggtacgggacgacggtaggaacgtccgtagtaaccttaacgtttagttcggtttaccgacctaaccgaagacgtaaggttagtacggtactagttacgggtagggggttacgtcggggacggacggtaaccgtaggttccggaccggttccggtggtacccgacggaccccgtaagggtcccgtacccggcccccgttacggtaccctccgttcccgttacccccg

SEQ ID NO: 88935 - DNA, 688 bp, Homo sapiens
  misc_feature: GYAE6OF01CHHE7.21.8.A08.1.454.CMB.1.raw
  modified_base (629)..(629): a, c, t, g, unknown or other
  misc_feature (629)..(629): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtggtgtcagtcgtcccgaggaacaaaccggcaggactccacctgctcgtaggagtattacattacgaaccaaaagtaattattaccgtttgttacggttaccaagacgagtaaacgtcgacggaccgacggtccccttagtaccgtggtcctaactccgagtcgacggccaggtaccgaaccgacgtaccgtaccgggactcccgagacgagtacttcgctcgaccctcgacgtccgtacggaggacgacggtccggtaccctacgtttacgaacgttacgtaccgtaggggtcccgggacccgtagggtacggacgtaagtacggaagtcctagtaacgttacttagttacgtaccgactacgaacgacgtagttagtcgtactaggtacgggtaggggttacgtcggggacggtaacggtaccgtaagggttccgaccggttccgttgggaaccnccggacccgtaacgtcccgtacccgttacccccgtaggtccctcgttcccgttccccgg

SEQ ID NO: 88936 - DNA, 743 bp, Homo sapiens
  misc_feature: GYAE6OF01EOWV7.21.8.A08.1.454.CMB.1.raw
  modified_base (134)..(134): a, c, t, g, unknown or other
  misc_feature (134)..(134): n is a, c, g, or t
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatcctcaccatggcctggacccctctcctgcctccccctctcactttctgcacngtctctgacggcctcctatcgagctagacacagcccacccgtggtgtcacgtcgcccaggaaccaaacggccaggactcacctgcctcnggagtattcattcgaaccaaaagtattattacgttggttacggttccagcaagaacgtcgacggccacggtcccctgtacgtcggtacagtccagtgaccggccagtacgacgaccacgtccgggactcccgtagagtacgactttctcgtcgtccctaccgacgcctacggaacgggactacgggtccgaccgttaaccgtttaggaaccttacgtacggtaaccggggtaccggggacccctaagggggttcggaaacccggttaggtacggaacggtccgttacggtaactttacgttaacgtttacgttaaccggacccgtaaacgacgtacgtaaggttaggacgttacggagttaaccgggtacgggggtttaacgttccggggacggtaacgggtaacccgtaggtttacccggtacccggttccggtttacggtacccggaacgacccccgtaaggtccccgtaccccggttcccccgtaccgggttcctacccggtccgtttaccccccgg

SEQ ID NO: 88937 - DNA, 721 bp, Homo sapiens
  misc_feature: GYAE6OF01EXUGT.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaaagtattatacttgttggttccagcagaagtcaggccacggcccctgtactggtcatccatgacggccaggtcgacgacacgtccgggatcccgtagacgagactttctctcgccctccagtctacgacgggacaggtcggaccctaccgttgtacttacgtcgacggggtcggggacccgtaggggtacgggaacgagttacggaacgtccttaggtaacctttaacgttacgttttcggttaaccgccgaacccgtaggaaccgtagggttacggtacgggttacgtaacgttaccggggtaaggggggtttaacggtttccgggggaccggggtaaccggggtaaccgttaaacgggttaccggttaccccgggtttacccggtttggggttaaccccggacggtacccccgggtaaacggtccccggttccccgggtacccccccgttaccggggttaccctcccgttcccgtttaccccccgg

SEQ ID NO: 88938 - DNA, 878 bp, Homo sapiens
  misc_feature: GYAE6OF01BEAIY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatcacctgctctggatattcattcgaaccaaaagtattatacgtttgttggttccagcagaagtcgaggccacggcccctgtacgtggtcatccatggacggccagtcgacgacaccgtccgggacttccccgtagaggacgtacgtttccttccgtcggtccccttacccgacggtcccgttaccggaacgggggtaacccgtaggggttcccgggtacccccttaacccggttttacggtaacctttaaccggttaccgtaaccggggggttccgggggtacccccgggtaagggggttaccggggaaaccggtaacggttacgggaaaacggtccgttaacgtaacccgtttaacgtttaacgttttaccggtttaacccgacccgtaacccgtaaacggaaccggttaacggtttaacgggttacgggttaccgtaaccggtttacgggggttaaacgggggggtttacggtttccgggggaaccgggggtaaacggggttaaacccggttaaacgggtttacccggggttaaccccggtttccgggttttaggggttaaccccggtacgggtaccccccggggtaaacgggtccccggtttacccccgggcccccccgggttttaccggttaccccttaaccccggtttccccgttttaccccccgg

SEQ ID NO: 88939 - DNA, 535 bp, Homo sapiens
  misc_feature: GYAE6OF01AYE1H.21.8.A08.1.454.CMB.1.raw
  modified_base (220)..(220): a, c, t, g, unknown or other
  misc_feature (220)..(220): n is a, c, g, or t
  modified_base (500)..(500): a, c, t, g, unknown or other
  misc_feature (500)..(500): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggaccaaacggccaggatcacctgctctgganattcattgaccaaaagatatacttgttggttccagcagaagtcaggccaggcccctgtactggtcatccatgaggccagtcgacgacacgtccgggatcccgtgagagtacttctctcgccctccagcctcgagggacagtcggccctaccttgactatcgaggtcgggcccgagggtcgacgatgaagctgacttactagttcgttacgcaccagacagtagtgtctagtcggaggggttactcgggacggtagggacaggttcgaccgtcgttggacncgacccgaggcctccgccccgtgtctctcgtcccg

SEQ ID NO: 88940 - DNA, 713 bp, Homo sapiens
  misc_feature: GYAE6OF01D3AUZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctcgtggagattcattgaccaaaagaatatacttgttggttccagcagagtcaggccaggcccctgtactggtcatccatggaggccagtcgacgactacgtccgggatcccgagagaggtacttctctcgccctccagtctacgaggacaggtccgcctaccgttgaactagtacgaggtccggggacctaggggtacgggaacgagtacggaaacgtcgttacggtaacctttaacgttacgtttaccggtttaaccgaccgtaaccgaacggtaacgtaagggttacggttaggggtaccctaaggttaccggggtaaagggggggtttacttaccggggggaacgggggtaaccggtaaacccgggttaaaggttttcccgggtaaccccgggtttcccggtttggtacccggaaccggaccccggtaaacgggtccccgttcccgggtacccccccgttacgggtaccccttacccgttccggtttaccccccggg

SEQ ID NO: 88941 - DNA, 601 bp, Homo sapiens
  misc_feature: GYAE6OF01BJ9H0.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagaatatacttgttggttccagcagaagtcaggccacggcccctgtactggtcatccatggacggccaggtcgacgacaccgtccgggactccctagagagtacttctctcgccctccagcctacgacgggactaggtcggaccctaccgttgactagtcgagggtccggggcccgtagggtcggacgtagtacggaacgtcgtagacttacgttagtttacgttaccgcaccagacgtaggttagtcggtactagtcggagggggttacgtcgggacgggacggtaccgtaggttcggtaccgtccgttggaccgcggcccgtaaggtccgtccgcccccgttaggcctccgttccgttaccccg

SEQ ID NO: 88942 - DNA, 561 bp, Homo sapiens
  misc_feature: GYAE6OF01AZAT5.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggaggcatggtccagcctggggaggtccctgagcctctcctgtgcagcgtctggattcagtatcggctcctttgccatgcactggggtccgccaggcctccgaggcaagggggctgggagtggggtggcgattatctggtatgatggaagtgagagattattattcagtactccggtaggaacgggccgattcacctatcctcccagacgaacaatcgaccaaacaacacactgtactacttacaaatcgacccggtcctagacgacgcccggaggacacggcttagtgttaacttacgtaggtacgcgtcgtttggctaggttcgggggaccacggggtaaccccgtgggtacccg

SEQ ID NO: 88943 - DNA, 698 bp, Homo sapiens
  misc_feature: GYAE6OF01B21XS.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagagtcaggccacggcccctgtactggtcatccatgacggccagtcgacgacaccgtccgggactcccgtagagtacgtactttcctacgtcgccctaccgaagtcctacgaaggggaccaggtccggccctaccgttgaccttagtcgagggtccggggcccgtagggtcggaacgtagtacggaacgtcgtacggtaaccttacgttaacgtttacggttaaccgaccgtaaccgtagtaaccgtagggttaacggttcggtaccgtaacggttacgggtaagggggttacgttccgggggacgggtaacggggtaaccgttaaacgggtttccggtaaccccggtttcgttacgggttacccgaaccgggtaccccgtaagggtccccgtacccggtaccccccgttcgggtaccctaccgttcccgttacccccgg

SEQ ID NO: 88944 - DNA, 861 bp, Homo sapiens
  misc_feature: GYAE6OF01BSD7U.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgacgctgacacacgccccacccgttcggtgtcacgttccgtccccgaaggaaccaaaccggccaaggactccaccgtgctcgtaggatattcattacgaaccaaaagtattacttacgtttggttcggttaccagacaagaagtcgacggccgacggtccccgtagtaccgtcggtcacgtccgagtaggacggaccaggtaccgaccgacctaccggtaccgggtacctcccgtagacggtagtacttctccgtccgtccctaccgtacgtccgtaccggaacgggtaacgtaccggtaccggtacccgtaacccgtttacgtaaccgttaacgttaccgggtacgggggtaccccgggggtaaccccggttaaggggtacccgggtaaacgtacggttaacggaacggttccgttaaggtaacccttttaaacggtttacgtttaccggttaacccggaacccgtaaccggtaagtaaccggttaggttaacggttcggtacgggttaaccggttacggggttaacgggggttaccggttaccgggggaacgggttaaaccggggaaccgtttacggggttaaccccgttaccgggtttacccggttacgggtacccggtacccggaccccggtaacgggtccccgttccccgggttacccccgttacccggttacccgttaccccgttccccggtttacccccgg

SEQ ID NO: 88945 - DNA, 783 bp, Homo sapiens
  misc_feature: GYAE6OF01BVJGI.21.8.A08.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctctatgagctgacacacgcccacccgtggtntcagtcgtacccgaggaacaaacggcaaggactccactgctcgtaggatacttcattacgaaccaaaaagtattattaacttggttcgttaccagacaagaagtcgacggaccacggtcccctaggtactggtacactccgagtcggacggaccgtaagtccgaaccgaccgtaccgtccgggaacttcccgtaggtaacgagtacttccgtctaccggccctaccgaagtcccgtaacgggaacggtaacgtacggtccgggtaaccctaacgtttacggtaacttaacgttaccgggtaacgggggttccggggtaaccccgtaaggggtacgggtaaacccgtaggtaacggtaaacgaccggttaacgtaccgtttaacgtttaacggtttaacggttaaccgaacccgtaaccgtaacggtaaccgtaagggttaacggttacgggtaccgtaacggttacggggtaagggggttaccgttacgggggaacgggtaacgggtaacgttaacggttaccggtacccggttcggttacgaccgacggacccgaacggtcccgtcccggtaccccgttacggtacctcccgttccgtaccccgg

SEQ ID NO: 88946 - DNA, 674 bp, Homo sapiens
  misc_feature: GYAE6OF01E1ACF.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtntcagtcgtccccaggaccaaacggccaggactccacctgctctggagacttcattgaccaaaagtaatattacttgttggttccagtcagaacgtcgaggccacggcccctggtacctggtccatccatgacgccagtcgacgaccaccgtccgggactccctggagacgtactttcctcgtcgccctaccgacgccttacggacgggactacgggtcggccctaccgttgacttacgtcgacgggtcggggcccgtaggtcgggactagtacggaacgtccgtacgtaacttaacgttacgtttacgtaccgaccgtaccgacgtaacgtaaggttacggttcgtacgtacgttacggggtaacgggggtttacgttcggggacgggtaccggtaccgtaaacggttcgtacccggtccgtttaggacccggtacgccccgtaacgggcccgtacccggtccccccgttaggtaccctcccgttccgtttacccccg

SEQ ID NO: 88947 - DNA, 699 bp, Homo sapiens
  misc_feature: GYAE6OF01DXLDS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggcctcctatgagctgacacagccaccctggtgtcagtcgtcccaggaacaaacggccaggatcacctgctcgtggatattcattcgaaccaaaagtatatacgttgttcggttccagcaagaagtcaggccacggcccctagtactcggtcactccagtgacggccagtcgacgactacgtccgggactcccgtagacgtagtacttcctcgtcgtccctaccgacggtctacggacggggaactagggtaccggaccctaaccgttacgtaaccgttagtaccggtacgggtccggggacccgtaaggggtacggaacgtaagtaaggaacgtcgtacgtaaccttaacttacgtttacggtaaccgacctaacgtaacgtaacggtaggttacggtacggtacgtagttacgggtaacggggttacgttcggggacggtaacgggtaccgtaaggttccggtaccggttccggttaggttaccgaaccgggtacccgtaacggtcccgttaccccggacccccgttcggtaccctaccgttcccgttacccccg

SEQ ID NO: 88948 - DNA, 615 bp, Homo sapiens
  misc_feature: GYAE6OF01B5BAV.21.8.A08.1.454.CMB.1.raw
  modified_base (172)..(172): a, c, t, g, unknown or other
  misc_feature (172)..(172): n is a, c, g, or t
  modified_base (219)..(219): a, c, t, g, unknown or other
  misc_feature (219)..(219): n is a, c, g, or t
  modified_base (465)..(465): a, c, t, g, unknown or other
  misc_feature (465)..(465): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctcctatgagctgacacagccaccctggtntcagtcgtcccaggacaaacggccaggatccacctgctctggaagtnttcattgaccaaaagatatacttgttggttccagcagaagtcacggccacggccctgtactggtcatcatggacgccagtccgacgaccacgtccgggactcccgtgagagtacttctcgtcgcccttcacgcctacgacgggactaggtcggaccctacgttacgacgttacgtcgtacgggtcggggaccctaggggtcggaacgtagtagaaacgtcgtaggtacttacgttagttcgttacncgtaaccgagacgtaggtagtgtactagtcgggtacggggttacgttcgggacgggtacggaccgttaaggttcgaccggttcgttacggtcgacgacccggtaggcctcccgccccgttcggtacaccgttcgtcccgtcccctacccg

SEQ ID NO: 88949 - DNA, 917 bp, Homo sapiens
  misc_feature: GYAE6OF01DDJ5L.21.8.A08.1.454.CMB.1.raw
tcagtcgtcgctcgcacgaccggtgctcgatttagcatactctacagggggctgtgggctcaggaggtcagagctctgggaagtctcgaccatggacctggacccctctcctgcctccccctcctcactttctgcacagtctctcgacgtcccttcccttagtcgacgtctacgtaacacgacgcccacccgttcggtcggttccgacggttccgtaccccgtaagggaaccgtaaaccggccgaacggacctacccaacccttcggaccttccggttacgggacgtaccttaccgaacgttacgaaacccgaaaaagtaaccttaacgttaccgttttacggttttacggtttacccgaaacggtaccgtaaacggtaaacgttaccggaaccggggtacccgtaaccgggtacccccgtttaggtttacggtttaccggttaccgtaaccgttacccgaaggttaacgggaacggtaaccggaacggggtaccggtaccccggtacccccggttaccgggtacgttaccccgtaggtaacggtacgtacttccgtacggtaccgtaccgtaacccgaaccggttcggaacgggtacggtaccggtaccgtaccggtttacgacgtttccgtacggtacgggtccgggaccgtacgggtacgtacggtaagtacgaacgtaccgtagtaacttacgttgttaacgtaccgaccgaacgtacggaactaggtacgttaggtctaaggttacgggaacgggttcgtaacggtcgggtaacgtaacggtacggttcgtacccggttacgttacgggccgtaaacgggtaccccgaaagggttcccgttacccggtcccccggttacgggtacccgtaaccggtttccccgttccccgttcccccggtcccgttccccgg

SEQ ID NO: 88950 - DNA, 690 bp, Homo sapiens
  misc_feature: GYAE6OF01C4VK1.21.8.A08.1.454.CMB.1.raw
  modified_base (388)..(388): a, c, t, g, unknown or other
  misc_feature (388)..(388): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtcgtcaggttcgtccccgaaggaaccaaacggccaggactcacctgctcgtggagattcattcgaaccaaaagaatattacgttgttcgttcagcaagaacgtcgaggccacggtcccctagtactcggtcatccagtcgacggccagtcgacgacacgtccgggactccgtagagagtacttctcgtcgccctccgagtctacgaggtacncggtacgccttactgacttacgtcgacgggtcggggacctagggtcggaacgtagtaggaacgtcgttagtaaccttaacgtttacgttcgttaaccgaccaacgtaagtaacgtaaggttacgttacgggttactacggttcggggtaaacgggggtttacggtaccggggaacgggtaaacgggtaaccgttaacgggttacccggtaccggttccgttacggggtaccgaccgggtaacccggtaacggcccgttccccggtaccccggttccggtacctacccgttcccgttaccccg

SEQ ID NO: 88951 - DNA, 608 bp, Homo sapiens
  misc_feature: GYAE6OF01BGUQP.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtcgtccccaggacaaacggccaggatcacctgctctgganattcattgaccaaaagatatacttgttgtccagcagagtcagccagcccctgtactggtcatccatgagccagtcgacgacacgtccgggatcccgtgacgagtacttctctcgccctcagctacgagggacaggtcgccaccttgactagtacgaggtcgggcccgagggtcggacgtagtacggaacgccgttagaactttacgttacgtttacgttaccgaccgtaaccagtaacgtaaggttaggtcggtacaagttcgggtaaggggttcgttaccggggacgggtaacgggaaccgtacggttcggacccggttcgttcggtaccgtaccggacccgtaaggcccttccggcccccgttacggtcctccgttccgttccccgg

SEQ ID NO: 88952 - DNA, 720 bp, Homo sapiens
  misc_feature: GYAE6OF01BDC8B.21.8.A08.1.454.CMB.1.raw
  modified_base (354)..(354): a, c, t, g, unknown or other
  misc_feature (354)..(354): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggactcactgctctggatattcattcgaaccaaaagattaatacgttgttcgtccagcaagaagtcacggccacggtcccctgtactggtcactcgatcgacgcctagtccgacgacgacgtccgggactcccgtagagtacgtactttccncttcggccctacgagtcctaccggacgggactacgggtccggacctaaccgttacgacttacgtacgagggttccggggacccgtaagggtacggaccgtagtacggaacgtacgttacgggtaacctttaacgttacgtttacgtaaccgctaaccgaacgacgttaagggttacggttcgtacgtaaggtaccggggtaagggggtttacggttaccggggacgggtaaacgggtaaccgttaaacgggttaccggtacccggttccggtttacggggtacctaaccgggtacccgtaaaccgggtcccttacccccgggtacccccggttccgggtaccttccccgttaccggtttccccccg

SEQ ID NO: 88953 - DNA, 731 bp, Homo sapiens
  misc_feature: GYAE6OF01BYHP8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcacctgctctggagtattcattcgacctaaaagaactatacttgttggttaccagcaagtaagtcgaggccacggtcccctagtacctcggtcactccatcgacggccagtcgacgacacgtccgggactcccgtgagacgtacttctcgtcgcccttcccagtccctacgaacgggaccgacggtcgggaccctaccgttacgaccttacgtacgtacgggttccggggccctaaggggtcggaacggtagtacggaacgtcgttacgtaacctttacgtacgtttacgttaacccggacctacgtaacggtaatagggttacggtcgtacgtaacgttcggggtaacggggttacgtccgggggaacgggtaacgggtaaaccgtaacgggttcccgggtaacccggtttaccggttcgggtaaccggttaacccggaacccccggttaaacggggtccccgttcccggggtacccccccggtttagggtaccccttaacccggtttcccccggtttacccccg

SEQ ID NO: 88954 - DNA, 739 bp, Homo sapiens
  misc_feature: GYAE6OF01AT0IH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccctacccgtcggtcgtcaggttcgtccccgaaggaaccaaaccggccaagggactccacctgctcgtagggatattcagttacgaacctaaaaagtattacttacgttttggttacggttacccagacgtaaggaacgtcgacggaccgtacggccccttggtacgttggtccatccgagttcggacggccgagtaccggacgtaccgaccgtccgggaacttccccgtagagacgtattccgttctacgtccctaccgacgtccgtacgacgggtacgacgtccggtaccctaccgttcgaacgttactcggtacgggtccggggaacccggtagggtacgggaacggtagtaggaacgcgttacgtaaccttaacgttacgttacggtaccgtacccgacgacggtactacgggttacggtacggtacgtaaggttcgggtaagggttacggttacggggaacgggtacggaacgttacgggttccgtaccgggtttcgttacgggacgtaccggtacccgacgggtccctcccggaccccggttcgtaccctccggttccgttaccccg

SEQ ID NO: 88955 - DNA, 627 bp, Homo sapiens
  misc_feature: GYAE6OF01C28BH.21.8.A08.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtggtgtcagtcgtccccgaggaacaaacggccaggatccacctgcttcgtggagattcattgaccaaaagatatacgttgttgttccagcagaagtcaggccaggcccctgtactggtcatccagtgagcagtcgacgacacgtccggatcccgtagacgngtactttctcgtcgacctcccgagcctcggagggtacaggtcgacccgtacttaggaccttagtccgaggtcggggacccagggtcggtaacgagtaggaacgtctacgaacgttacttaagttcgttaacgccgaacgtagacgtagtaggtacggtctacgtacggtaggggttacgttcgggacgggtaacgggtaccgtaacgggttacgacccgtttcgttacggttacgaccgtacccgtaaggtcccgtccgtacccccggttacgtcccgacgttccgttccccgg

SEQ ID NO: 88956 - DNA, 700 bp, Homo sapiens
  misc_feature: GYAE6OF01C3O1H.21.8.A08.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaacgtggtggagtcgtgggggagcagtggtccagccgtggggacgtccctgacgtcctctcctgtgcagtcgtcgtggattcgagtatcggtcttccgttgcctagtcgcctacgtcggggtccccnccgaggtcctaccggaggccggaagggggtcctaggggagggttggggtcggaccgtaagtttacgtcgttgggtatggagtagggaggtgaagtagtattaagtttacgtcgaaggtaccgttaccgggagggtaacgggtccgtaacttaccgaacctactcccgtaccgaaggtacgaactaagtcgaaccctaacaaccaactctagttactactaacgaaacgtccggacccggtaccgtagaacggacgtaacccgggaggtaaccgacggtactacgttacgttaacgttacggttaggtaaccggtgttacggttttacgggaccgttacgggttaccggggacccggtaaccgggtacccggttcggttaccccggg

SEQ ID NO: 88957 - DNA, 913 bp, Homo sapiens
  misc_feature: GYAE6OF01EN92J.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtgtntcgagtccgtacccgagaacgaacgccgaggactccactgtctcgaggagtacttactagttacgaaacaaaagtaattacttacgtttggttacggttaccagacgtaagtaacgtcgacggaccgaccggtccctacgtacgtcggtactactacgtagtagggaccggaccgtacggtaccggaaccgtaaccgtacccgggtacccgggtaccttacccggtaggaacggtaaccgttcctttccgtccgtaccgtaccccgttacgacggtccgtaaccgggaacgggtaaccgtacgggtcccggtaaccccttaaccggtttacgtaaccttacggttaaccgggtaccgggggttacccggggaacccgggttaagggggttaaccggaaacggttaacgggttaacggtaaacggtcccggtttaaacgtttaaaccggttttaaacgtttaacggtttaccgggttaaaccccgacccgtaaacccggtaagggtaaaccgttaggggtttaacggttacccgggtaacgtaaccggggttaacggggggtttaacggggttaaccccggttaccggggggaacggggtaaaccggtaacccgggtttagggttaccccggttaccccggttttccggacggtaacccgacccggacccggtaacggtcccccgttccccggtacccccgggttagtcccgttcccgtcccggtttacccccccggg

SEQ ID NO: 88958 - DNA, 716 bp, Homo sapiens
  misc_feature: GYAE6OF01AE88Q.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctctggagattcattgaccaaaagaatatacttgttggttccagcagaagtcaggccaggcccctgtactggtcatccatgaggccagtcgacgacacgtccgggatccctgagagtattctctcgcctccagcctcgagggacaggtcggcccaccgttgacttagtccgagggttcggggcccgtaggggtacgggaacggtagtaggaaacggcgtacgtaaccgtttaacttaacgttttacgtttaaccggacctaacccgaacggtaacgtaaggttaacggttagggtacctaaggttacgggtaacgggggggttaacgtttaccggggacgggggtaacgggggtaacccgttaaacgggtttaccgggtaaccccgggtttcccggtttaccggggttaccgtaaccgggtacccccgtaaaggggtccccgttaccccgggtccccccccggtttaccggggtccccttaacccgttcccggttttaccccccggg

SEQ ID NO: 88959 - DNA, 712 bp, Homo sapiens
  misc_feature: GYAE6OF01B5300.21.8.A08.1.454.CMB.1.raw
  modified_base (163)..(163): a, c, t, g, unknown or other
  misc_feature (163)..(163): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacngcccaccctggtgtcagtcgtcccaggacaaaccggccaggatccactgctctggagattcattcgaaccaaaagtaatattacttgttcggttaccagcaagaagtcgacggccacggcccctgtacgtggtcatccagtcgacggccgagtaccggaccgaccgtaccggtcccgggactcccgagaacgtacgtactttccgtctcgtccctaccgacggtcctacggaacgggtacacggttcggaccctacgttacgaccttacgtcgacgggtcgggacccgtaggggtacggaacggtagtacggaagtcgtacgtacgtttaacgttagtttaccgtaccgtaaccgaaccgtaaggtacgtaaggttacgggttcggtacgttaacgggttagggtaacggggtttacgtacgggggaacgggtaaccgggtacggttacgggttaccggtacccggttccgggtacggtaccgtaccggaccgtacggtcccgtaccccggtccccgttaccgtcccgttaccgttcccgttaccccgg

SEQ ID NO: 88960 - DNA, 715 bp, Homo sapiens
  misc_feature: GYAE6OF01COGJY.21.8.A08.1.454.CMB.1.raw
  modified_base (128)..(128): a, c, t, g, unknown or other
  misc_feature (128)..(128): n is a, c, g, or t
  modified_base (131)..(131): a, c, t, g, unknown or other
  misc_feature (131)..(131): n is a, c, g, or t
  modified_base (206)..(206): a, c, t, g, unknown or other
  misc_feature (206)..(206): n is a, c, g, or t
tcagtcgtcgctcgcacgaccggtgctcgatttagcatactctacaggggctgtgggcggtcaggaggcagagctctgggaagtctcaccatggcctcggaccctctcctgctcccctctcactttcngcnagtctctgcggcctcctatgacgctgacacacgccacctggtgtcagtctcccaggacaacggcaggacacacgngctcgttggagtattaccagttcgaaacctaaaaggaatattacgtttggttcggttaccagtcgtaaggaacgtccgaacggtaccacggtacccctagtaccgtcggaaccctataccgagtcggtaagcccgtaaggtccgaaccacgtaccggtcccgggaaccttccgaggtacgtactaactttcgccgttccgcccgttacgacggccttaacgaacggggtaaccgtgtaccggccctaaaccggtttcgaacccttacgtacggtaacgggtccggggtacccgtgggtaacgggtaacgtaggttaacggaacgtcgttacgtaaccgtttaacgttacgttcgtaaccgtcgtaaccgtaacgtagtacgttgtacgtacgtagttcggtagggttcggtacggacgggtacggtactaggtcgttacccggttcgttaccggacgaacgccgtaacggcccgtacccgtcccgtcgtaccgtccttccggtaccccg

SEQ ID NO: 88961 - DNA, 693 bp, Homo sapiens
  misc_feature: GYAE6OF01BTTR5.21.8.A08.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctcgtggagtattcattcgaaccaaaagaatatacttggttggttccagcaagaagtcgacggccacggtcccctgtaccgtggtcactccagtggacggccaggtccgacgacaccgtccgggactcccgngagagtattctctcgccctccagctcgacggacaggtcggacctaccgttgactagtcgagggtccgggaccgtaggggtcggacgagtacgaacgtcgtgtaaccttacttacgtttacgtaccgaccgtaaccgagaacgtaggtacggttcggtacgtagtaccgggtaggggggttacgttaccggggacggggtaaacgggtaccgttaagggttacccggtaccccggttccggtttagggtacccgtacccgggaaccccggtaacgggttccccgttacccccggtacccccccgggtttaccgggccccgttaacccgttccccggtttacccccccg

SEQ ID NO: 88962 - DNA, 656 bp, Homo sapiens
  misc_feature: GYAE6OF01ECCQ7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtcccaggacaaacggccaggatcacctgctctggatattcattgaccaaaagatatacttgttgtcagcagagtcagcaggccctgtactggtcactcgatgagctagtcgacgcaccgtccgggactccccgtagagagtacttccgtacgtcgccctccgacgtcctacggaaggggtaccaggtccggaccctaacgtttcgaacttacgtaccggaaggtccggggacccgtagggtacggacgagtaggaacgtcgtaggtaaccttacttagttcgttaccgctaaccgagtacaaggttacgtcggtactagtacgggaaggggttacgtaccgggggacgggaacgggtaaccgtaacgggttccggtaacccggttccggtttagggccctaaccgggtaccccgaaggaccccgttacccggtaccccccgttaccgggtaccctcccgtttccgttacccccg

SEQ ID NO: 88963 - DNA, 760 bp, Homo sapiens
  misc_feature: GYAE6OF01BN8GV.21.8.A08.1.454.CMB.1.raw
  modified_base (177)..(177): a, c, t, g, unknown or other
  misc_feature (177)..(177): n is a, c, g, or t
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtntcagtcgtccccaggacaaacggccaggatcacctgctctgganattcattgaccaaaagatatacttgttggttccagcagagtcaggccacggcccctgtactggtcatccatgacgccagtccgacgacacgtccgggactcccgtagagtagtacttctcgtcgccctccagcctacgaggggactacggtcggaccctaccgtttagacttactcgtacggtcggggaccccgtagggtacgggacggtaagtacggaacgtacgtacgtaaccgttaacgttacgtttacggttaacccgtacgtaacccgtaacgtaaccgtaagggttaacgggttacgggttaccgtaacggtttaccgggtaacgggggggtttaacgtttcccggggggtaaccggggtaaccgggggtaaacccggtaagggtttacccgggtaaccccggtttcccggtttacggggttacccggtaacccgggtacccccggtaaaacggggtccccgttacccccgggtaccccccccggttaccggggttaccccgttaccccggttcccggttttaacccccccgg

SEQ ID NO: 88964 - DNA, 744 bp, Homo sapiens
  misc_feature: GYAE6OF01BQY57.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgaggcctcctatgagctgacacagcccacccgtcggtntcagtcgtcccgaggaacgaaacggccaggactccacctgctcgtggagtattcattacgaaccaaaagtattacttacgttggtttcggtaccagacaagaacgtcgacggccgacggtccccttgtacgtcggtcactaccgtagtcggacggccgaacggtaccggaacgaccgtaccggtcccgggtaacttccccgtaggaaggtacgtacttcctcgtccggtccctaccgacgtccgtacggacgggactaggtccggccttacgttcgacttacgtacggacgggtccgggtaccgagggtacggacgagtacgaacgttccgtaagttacctttaacgttacgtttaacgtacccgacgtaacgaacggtacgtaacgggttacggttacggtacgttaacgggttagggttacggggtttacgtacgggggaaccgggttaacgggaaccgtttagggttcccgtacccggtttcggttacggaccgtaaccggacccgtacggtaccccggtccgtacccccgttaggtaccctcccggttccgttacccccgg

SEQ ID NO: 88965 - DNA, 662 bp, Homo sapiens
  misc_feature: GYAE6OF01CVVVJ.21.8.A08.1.454.CMB.1.raw
  modified_base (316)..(316): a, c, t, g, unknown or other
  misc_feature (316)..(316): n is a, c, g, or t
  modified_base (346)..(346): a, c, t, g, unknown or other
  misc_feature (346)..(346): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgcagatggactgacaaagaatatgcttattaggtaccaacaagaagccgaggaccacggcccctgtgttagtgatatataaagacactaggagacgcctanagtagatcccgtgacgcgtaattccgtacnggcctccgagctacgacgggactacgacagtacgtacgttagactagtacgagttacggaacgtccgaaggtacgaaggaacgggcgtaaggtccgtaggtaaccttaacgtttaccgtagtaaccgtaaaaccgaagttaacgaacgttaacggtaggtaacggttactacgttaagggtttcgggttagggttaccgggtacggggaaacggggtacccgtaaaggccggttaacggaccccgggttaaccgttacgggtacccggaacgtaacccccgggaaacggttcccggtccccgggttaccccccggg

SEQ ID NO: 88966 - DNA, 875 bp, Homo sapiens
  misc_feature: GYAE6OF01DZ92Q.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttcngcacacgttctcgtgacggtccctcctaatcggacgtctacgaaccaccgtacgccctacccgttcggtcgtaccgacggttccgtaccccgaaggaacccgaaaccgggccaagggtacctacccgtaacccgttggtacccgttaccggtacgggtaagttaccttttaaccgtaacggtttaaccgaaacccgtaaaaaaagtaacgttttaacgttaccggtttttacggttttaccgttacccgacgggaaccgtaaaggtaaccgttaccggacggtacccggtaaccgggtccccttaggtaaccggttcggtaaccagtttcccgaggtacggaaccggacccgtaacgggtaccgaacccggtacgttaaccccggtacccgggtaaccgtttcccggtaagggtaaccgtacgtttaaccgtttcccggtacgtccggtacccctacggtaacgtccgttaacgggaacggttaacgtacgggtccgtaacccgttacgttacgtaacttcggtacggtaccgggtccggtaccgtagggtacgtaacgagttacggaccgtagtacgtacttacgtacgttcgtaccgacctacgtacgaacgtcggtaacgtcgaacgtacggtacggttagggtacgccggggaaggtaacgtacggtaccgtcggtacccgttgttcacggtcgacccggtactcccggtacgtcccggtactctttccgcccgtttcccg

SEQ ID NO: 88967 - DNA, 713 bp, Homo sapiens
  misc_feature: GYAE6OF01ETGNA.21.8.A08.1.454.CMB.1.raw
  modified_base (566)..(566): a, c, t, g, unknown or other
  misc_feature (566)..(566): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtggtgtcagtcgtccccaggacaaacggccaggactcacctgctctggagtattcattcgaaccaaaagaatacttacttggttacggttccagcaagaacgtcaaggccgacggcccccttaggtacgttcggtactaatccctaagttcggaaccgggccctaaggttacccggaaaccgaccgtaacccgtacccgggggaacttccccgtagggaagtaacgtacgttttcctccgttacgccccttaccgagacccttacggaacggggaacctaggtccgggacccctaacgtttacgaaccttagtacgagggtccggggacccgtagggtcgggaacgtagaggaacgtctagaccttaagttagttacgtacgaccaacgagaanacggttaggtcgtactagtacggtaggggtacgttacgggacgggtacggaaccttagggtaccgtaccggttccgttaggtacaccggtaccgacccgggacgttccccggtaccccctacggttctccgttcccggttcccccgg

SEQ ID NO: 88968 - DNA, 779 bp, Homo sapiens
  misc_feature: GYAE6OF01EQEDS.21.8.A08.1.454.CMB.1.raw
tcagtcgtcgctcgcacgaccggtgctcgatttagcatactctacagggggggagaggagcccagcactagaagtcggcggtgttccattcggtgatcagcactgaacacagaggactcaccatggagtttgggctgagctgggttttcctccttgctcttttaagaggtgtccagtgtcaggcgcaactggtggagtcgtgggggaggcatggtccagccgtggggacgtccctgagcctctcctgtgcagcgtctggattcagtatcggcttcctttgccatcgccacgttcggggtcccgccgagggtcctccgaagggccgaagggggtctgggacgtggggtggcgtattagtcgtggtatgagtggaagtggagtaagtattagtttagtacgacgtaccgttccgggtaggaacggggtaccgtaactttacccgaaccctaagttacccgttaccccgaaagggtaacgaaccgtaaaacgttaccgaaccccaaaaccgtaaacctaacccgtaacctttacggtttaaccttacctttaaccgtaaaacgttccgggtaaccccgggtacttacggaaacgggaccggtacccgggaaacgggtacccggtaaaccggggacctttaaacggttcggttttaaaacgttttaccggttacggttaacccgggttaggtttaccggttttttacggggaaccgtttacgggttaaccggggggtaccccgtaaccggggggttaaacccccgttcggggttaacccccgg

SEQ ID NO: 88969 - DNA, 773 bp, Homo sapiens
  misc_feature: GYAE6OF01BYA8T.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtggggggaggcagtggtccagcctggggaggtccctgacgcctctcctgtgcagcgtctggattcgagtatcggcttcctttgccatcgctacgtgggtcccgccaggcctccgagggcgaaggggctgggaggtggggtgggacgtattatcgtaggtatggagtgggaagtggaggtagtattattacttcgaacgtacgtccgggtaggaacggggtcccgtaatttcccaaccgtattccgtaacccgaaggaacgaacctaaagtccgaaccctaaaacgaaacccaaccgtaactttacggttaactttcccgttaaaccgtaaaacgttcccggggaacccccggtaccggttaagggtaaccggtaacccgggacccgggaacggggaaaccccgtaccggggtactttaaacggttacgggtttaaaactttaccgggttacgggttaaaccgggtcggttttacccgtttttagggggttaacccgtttacgggggtttacccggggggaacccccggttaaaaccggggggttaaccccccgttgggggttaaccccccgg

SEQ ID NO: 88970 - DNA, 734 bp, Homo sapiens
  misc_feature: GYAE6OF01B9GAI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaacggccaggactcacctgctctggagtattcattgaccaaaagaattacttacgttgttaggttccagtcgaagaagtcaggccacggccccttgtaccgtggtcactccgagtggacggccaggtaccggacgaccgaccgtaccgggactcccgtagacgagactttcgtctcggccctcgtacgccttacggagggtactaggtccggaccctaccgttagaaccttagtccggagggttccgggaccccgtaaggggtcggaacgtaagtagggaacgtccgtaggtaaccttaagtttaacggttacgtttaacggacctaaccgaaggtaacctagggttaacgggtcgtaaccgtaggttcggggtaacgggggtttacgttaccgggggaccgggtaacgggaacccgttacgggttaccggtaccgggtttacccggttagggtacccggtaacggtacccggtaaaccgggtcccgttaaccccgggccccccgtttacgggtacccttccggttccccggttacccccg

SEQ ID NO: 88971 - DNA, 698 bp, Homo sapiens
  misc_feature: GYAE6OF01CPWXG.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccaccctcggtntcagtcgtaccccaggacaaacggccaggactcacctgctgtggatattcattcgaacaaaagtaatattacgttgttggttccagcagaagtcacggccacggtcccctgtactggtacatccatcgacgccacgtcgacgacctaccggtccgggactcccgtaggaacgtacgttacgttcctccgtcgtacccttaccgaaggtcccgttacggaaggggtacctacggtcggtaccccttacgttacggaacttacgccggtaagggtccggggacccgtaaggggtacgggaacgtacgtaggaacgtcgtacgtaccttaagttacgtttacgtaccaccgtaacgaacgacgtagttacggtacgtaccgagtaccgggtaggggttacgtacggggacgggtaacggtaccgagggtttaccgacccggttcgttacggacgtacccggtacccggaacggtcccgtcccggtcccccgttacgggtccctaccgtttcccgttaccccg

SEQ ID NO: 88972 - DNA, 726 bp, Homo sapiens
  misc_feature: GYAE6OF01DZJNR.21.8.A08.1.454.CMB.1.raw
  modified_base (178)..(178): a, c, t, g, unknown or other
  misc_feature (178)..(178): n is a, c, g, or t
  modified_base (231)..(231): a, c, t, g, unknown or other
  misc_feature (231)..(231): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccacccgtggtntcagtcgtaccccaggaaccaaacggcaaggactcgacctgcctcgtaggatnttacattcgaacaaaaagtattacgtacgttgttggttccagcagaagtcagccacggcccctgtactggtcactccatggacgtcagtcgacgacacgtccggatcccgtagagtacgtacttcctcgtacgcccttaccgagtcctacggacgggactacgggtccggacccttaccgttacggtaacttacgtaccggtacggggtcccggggacccgtaaggggtaccggtaacgtaagtaacggaacgtacgtacgttaaccgtttaacgttacgtttaccgtaaccgtacctaaccctagtaaccgtaaggttaggttacggttaacgtaacggttacgggtaacggggttcgttaccgggggacgggtaaaccggggtaacccggttaaaggttcccggtacccggtttaccgttcggtaccgtaaccgacccggtacggaccgttaccccgtccccgttaccggtacctccttcccggttacccccg

SEQ ID NO: 88973 - DNA, 568 bp, Homo sapiens
  misc_feature: GYAE6OF01AKDC0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgagccagtcgacgacacgtccgggatccctgagagtattctctgccctccagctcgaggacaggtcggccctaccgttgacttagtcgagggtcggggacccgagggtggacgagtggaagctgactatattcgtacgcacagacagtagtgtactagtcgagggggttatcgggacggtacgggacctaaggttcggacccgtttccgttgggtaccgcggaccccgtaaggtcccgtccgaccccccgttcgggttccctaccgttccgttaccccg

SEQ ID NO: 88974 - DNA, 632 bp, Homo sapiens
  misc_feature: GYAE6OF01BY8IM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccgtcggtgtcagtcgtccccaggaccaaacggccaggactccacctgctcgtggagtattcattcgaaccaaaagaattatactttgttggttccagacagagtcgaggccacgcccctgtacgtggtcactccagtgacggccaggtaccgacgacacgtccggactcccgtagacgtagtacttcgtctcgtccctccgacgtccgtacggacggaccgtacggtaccggaccctacgtttacgaaccttacgtacggtacgggttaccggggacccgtaggggtacggaaccgtagtacgaacgtcgtagtaaccttacgttagttacgtaccgcaacgaagtacgtgtagtggtactagtaccggtagggtcgtcggacggtacggtaccgtagtaccggtcgttcgtagtacgcgaccgacgtccgtcccgtcccgtacgtctccgtccgttaccccg

SEQ ID NO: 88975 - DNA, 765 bp, Homo sapiens
  misc_feature: GYAE6OF01A053B.21.8.A08.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagcatactctacagggggtcgtgtgggctcaggaggcagagctctgggaatctcaccatggccgtcggacccctctcctcgccctcccctcctactctttctgcacacgtctctggacggcctcctatgacgctgacacacgcccacccgtcggtcgtacncgttccgaccccgaaggaaccgaaaaccgggcccgaagggtactaccgtaacccgtcggtccgttccgtagggaagttacgttaccagtttacggaaaccaaaaagtaatacgttaacgtttggtttacggttaccgagtaccgaaggtaacgtccgaacggaccaacggtccccgtagttaccgtagggtaccacgttaccgaagtcggaacggaccgacggtaccgaacggactaccggtacgggactcccgtaggaacggactacttctcgtacgccctacacgtacgtacggaacggactacgggtccgacccttacgttagtaaccgtacgttacggacggggtccgggaccgaggggtaccgggaacgtagtacggaacgtcgtacgtaacgttaacgttgttaccgttacgaccgtaacgagaacggtagttaacggtcggtactacgttacgggtagggttaacgtcgggacggacgggtactaggttccgaccgttcggttaggaccggtaccgacggtccgtccgtacccgtccgtacgtcccttaccggtccgttccccg

SEQ ID NO: 88976 - DNA, 649 bp, Homo sapiens
  misc_feature: GYAE6OF01D5BGE.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtntcagtcgtccccaggacaaacggccaggatccactgctcgtggagtacttcattcgaaccaaaaagtattatacgttgttcgttccagcaagagtcagccaggcccctgtacgtggtcactccagtggagccgagtcggacgacgtactcccggggacttcccgagacgtagtactttccgtctcgcctaccagcctacgacgggacaggtcggaccctacgtttgaacttacgtcggtaacggtccggggacccgtagggtagggaccgtagtacgaacgtgtacgacttacgttagttacgtaccgtaccacgaacgtacgtagttacgtcggtactagtacgggttaaggggtcgttacggggcgggtaaccgggtacgtaacggttcggtacccggttcgttaggtaccgtacggacccgtaaggtcccctccggtacccccgtcgtacctccgttccttaccccgg

SEQ ID NO: 88977 - DNA, 660 bp, Homo sapiens
  misc_feature: GYAE6OF01DAHK6.21.8.A08.1.454.CMB.1.raw
  modified_base (641)..(641): a, c, t, g, unknown or other
  misc_feature (641)..(641): n is a, c, g, or t
tcagtcgtcgctcgcacgaccggtgctcgatttagcatactctacagggggctgtgggctcaggaggcagagctctgggaatctcaccatggcctggaccctctcctgcctcccctctcactttctgcacagtctctgacgcctcctatgagctgacacagccaccgtggtatcagtcgtcccaggaccaaacggccaggactcactgctctggaatattacagttcgaccaaaagatatacttgttggtccagtcagaagtcacggccaggtcccctgtactggtcatccatgacgccaagtcgacgacacgtccgggactccgagacgagtacttctacgtcgtaccctcgagtcctacgaggactggtacggcctacgttgaacttacgtacgtagggccggggtacctagggtacggtaacgtagtacggaaacgtcgtacgaacttaacttacggttacgttaaccgacctaaccgaagtaaccgtaaggttacgttacgggtactagttacgggaaggggttacgtccggggacgggtaacgggtaaccgaacgggtttcggacccgtttcggttacgggtacgttaaccgggacccggttaacggtccgttaccccgaccccgttcggtacccncccgtttcgttacccccgg

SEQ ID NO: 88978 - DNA, 725 bp, Homo sapiens
  misc_feature: GYAE6OF01C0WUB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtaccccgaggaaccaaaccggccaaggactccacctgctcgtaggatacttacattacgaaccaaaagtaatattacgttgttacggttaccaagacgaagtaacgtacgacggaccgaccggtccccctaggttaccgtcggtacctactaccgagtacgggaccggaccgtacggtaccggaacgaccgtaccggtcccgggactcccgtaggaacgtacgtacttcctcgtccgtaccctaccgagtccgtacggagggtactacgggtcgtacccctagttacggacttacgtacggtacgggtccgggaccgtagggtacggaacgtacgtacggaacgtccgtacgtaaccgttacgtttacgttaccgttaccgacctaaccgtaacgtaacgtaaggttacggtacggtacgtaggtacgggtaggggttacggtcgggaacgggtacggtacgtacgttcgtacccggtgtcggacgccggtaccgtacgtcccgtcccgtcccctaggtacctccgttccgttccccgg

SEQ ID NO: 88979 - DNA, 731 bp, Homo sapiens
  misc_feature: GYAE6OF01CY4ZY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggaccaaacggccaggatcacctgctcgtggaacgtattcattgaaccaaaagtatattacttgttggttccagcagaagtcgaggccacggtccctgtacgtggtcactccagtcgagccaggtcgacgacaccgtccgggactcccgtagacgtagtacttcgtctcgcctccgacgcgtacgacgggacgtacgtcgggcctaccgtacgactacgtcggtacggcggggtacccgagggtcgggaacgtagtacggaacgtcgtaacgggtaacttaacgtacttacggttaaccgacctaaccggaagtaacgtaacggtaacggtttacgggtaaccgtacggttaccgggtaaggggggtttaccggttaccgggggacgggtaaacggggttaacccggtaaaggtttccgggaaacccggttttacccggttacgggtaacccggtaccggtaccccgggtaaacgggtcccgttaccccgggacccccccggtttaccgggaccgttaaccccgtcccggtttaccccccggg

SEQ ID NO: 88980 - DNA, 783 bp, Homo sapiens
  misc_feature: GYAE6OF01D37VJ.21.8.A08.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagcatactctacgagggggctggtgggctcaagggaggcagagctctgggaatctcaccatcggcctcggacccctctcctcgcctcccctctctactttcgngcacagtctcgtggacgtcctctatgagctagacacacgccctacccgttggcgtcacgtccgcccgaaggaaccgaaaccggccaaggctccactcgcttagtaggatacttcatacgaacaaaagtacttattcgttgttcggtaccagactaagacgtacgacggacccgtaccggtaccccttaggttaccgtcggttacacgtacgagtacggaccggtaccaaggtacccgaaccgtacgtacccggtaccgggactccgtaagaacgttcgttctttcgacctccgtaacccgtcgacggtccgaacggaacgggtaccagggtttcccgaaccgtcgtttaacgaacgtcgtacggtacgggtccgggacggtagggacggtacgtaacgtaggaaccgtcgtaacgtacctttaacgtcgtttaccgtacgaccgtaacacggtaacgtaggttacggtacggtacgtacgggtacgggtaggggttaaccggtcggggaaccgggtacgtaaccgggttacggttacccgggttaccggttccggtaggtacccgtcccggaccggtaccggttaccccgggtccccgttaccccgggttaccgttacccgggttccccttcggtttacccccccgg

SEQ ID NO: 88981 - DNA, 638 bp, Homo sapiens
  misc_feature: GYAE6OF01ARALT.21.8.A08.1.454.CMB.1.raw
  modified_base (172)..(172): a, c, t, g, unknown or other
  misc_feature (172)..(172): n is a, c, g, or t
  modified_base (215)..(215): a, c, t, g, unknown or other
  misc_feature (215)..(215): n is a, c, g, or t
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtntcagtcgtcccaggacaaacggccaggatcacctgctctgganattcattgaccaaaagatatacttgtgtccagcagagtcacgccacgccctgtactgtcatcatgagccagtcgacgacacgtcggactcccgngacgacgtacttctcgtcgcctcgacgccgtacgacgggtacncggtcggaccctacgttcgacttagccgtaggtcgggacccagggtacggacgtagtagaacgtcgtacgtaccttacgttagtttcgttaaccgactacccgaggtacgtacggtagttcggtactacggtacgggtagggggttacgttacgggaccgggtaacgggtaaccgtaagggttccgtacccggttaccgttcgggtacctaaccggaccccgtaaggtcccgtcccgtaccccccgtcggtacctacccgtccgttcccgtccccccgttaccccg

SEQ ID NO: 88982 - DNA, 623 bp, Homo sapiens
  misc_feature: GYAE6OF01A25KW.21.8.A08.1.454.CMB.1.raw
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagattcattgaccaaaagatatacttgtgttccagcagaagtcaggccaggccctgtactggtcatccatgaggccagtcgacgacacgtccgggatcccngagagattcnctcgccctccagcctcgagggacctaggtcggacctaccgttgaactatcgaggtcggggcccagggtggacgagtcggaagcgtagacttactattacgtacgcaccgtagactaaggtagtggtactagttaccggtagggggttacttcgggaccgggtaaggggtaacccgtaaagggtttccggtaacccggttccggtttacgggtaccgtacggtacccccggaaagggtcccgttacccgggccccccgttaccggggttccctaacccggttcccgttaccccgg

SEQ ID NO: 88983 - DNA, 676 bp, Homo sapiens
  misc_feature: GYAE6OF01CICC2.21.8.A08.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattcgaccaaaagaatatacttgttggttccagcagaagtcaggccacggcccctgtactggtcatccatgacggccagtcgacgacacgtccgggatcccgtggagacgtactttccncgtcgtccctccgacgtctacggagggtacaggtccggacctaccgttgacttagtccgtacggtcggggaccccgaggggtacgggaacgtacgtaggaacgtccgttagaacctttaacgtagttttacggttaaccgaccgtaccgaacgtaacgtaacggtagggttacggttaccgtagttaccgggtagggggttaacgttacggggaccggggtaacggggaaccgtaaacgggttcgtacccggttccggttaggacccgtacggaccccggaaggtcccgtaccggtccccccgttacggtcccgtccgttcccgttcccccgg

SEQ ID NO: 88984 - DNA, 818 bp, Homo sapiens
  misc_feature: GYAE6OF01DGSB2.21.8.A08.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctcgtgacggcctcctatgacgctgacacacgcccacccgtcggtntcgagtcgtcccgaggacaaacggccaggactccaccgttcgcgttcgtaggaagtatttacagttacggaaccaaaaagtacttaagttaccgtttggtttacggtaccctaaggaccgtaaggtaaacgtaccgaacgggcccgtaaccggggtcccccttaaggttaccgttacggggtaccctaacgttacccgtaaggttcgggaaccggtacccgtaacgggttccggaaacccggtaccgtaaccgggtcccgggtaaccttccccggtagtaacggtaacggttcttaccgtcgtccgcccttacgacgtaccgtcgggaaggtccgacggtccggtaaccctacgttacggtaactacgtaccggtacgggtccgggaaccgggtaggtacgggtaacgtaggttaacgaacggtactaccggtacttaaccgttatttaccggtacgacctaccgtaagacgttagtacggtacggtcgtaaggttaccgggaaggggtttcgtacggggacgggtaacgggtaccgtaaggttccggtacccggtttccggtgggtaaccacccggttacccgaacggtcccggttcccggtaccccgtgtacccgttcccgtcggtttacccccg

SEQ ID NO: 88985 - DNA, 717 bp, Homo sapiens
  misc_feature: GYAE6OF01DF2KU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctctatgagctgacacagcccacccgtggtgtcagtcgtaccccaggaaccaaacggccaggactccacctgcgtcgtgggatattcagttcgaaccaaaagtattatacttgttggtccagtcagaagtcgaggccacggtccctgtactggtaccatccagtcgacggccagtcgaccgtacgaccgtccgggactcccgtaggagtaacgtctttcgtcgtcgtaccctacgagtcccgtacgagggactacgtccggacctacgttagacttagtcgaaggtccgggaccgtaggtcggaacgtagtacggaacgtcgtaggtaaccttacgtacgtttacgtaaccgcctaaccgtacgaacgtgggttaacggtcggtaacgtacgtacgggtagggggttaaccttcggggaaccgggtacgggtaaccgtaaacgggtttccgtaacccgggttccggtttagggaacccgtcccgggaaccccgtacgggttaccccgttaccccgggttaccccccgttacggggtttcccctaccgggtttccccgtttaccccccgggg

SEQ ID NO: 88986 - DNA, 742 bp, Homo sapiens
  misc_feature: GYAE6OF01BYS2K.21.8.A08.1.454.CMB.1.raw
  modified_base (251)..(251): a, c, t, g, unknown or other
  misc_feature (251)..(251): n is a, c, g, or t
tcagtcgtcgctcgcacgaccggtgctcgatttagcatactctacagggggctgtgggctcaggaggcagagctctgggaatctcgaccagtcggcctcggacccctctcctcgcctcccctcctcactttctcgcacagtcctgtgacgcctcctatgagctacgacacacgccctaccctgtgtcgtcgagtcgtcccaggacaacggcagactcactgctcgtggactattcagtcgaaccgtaaaanattagtacgttgttcggtaccagtacagagtcgacggtccgacgtcccctgtacgtcggttacacgttccagtacgacggacctaggtaccgaacgtaccaccggtccgggtaactccgtagacgtatacgttctcgtacgcccctcgacgtccgtacggagggaccgtaaggtcccggtaccctacgttacgtacttacggacgtacgggtcgggacccgtaagggtcggactaacggtgaacgtcgtacggtaaccttacgttaacggttccgttaacgacaccgtaacgacgtaaggtcggtagtaccgtaggtacggtaggggttacgtaccgggtacgggtaacggtacccggttaaacgggttcccggttaacccgggttaccggttacggggttacccaaaccgggtaacccccggtaacggttccccggttaccccgggttaccccgtttacccggggttaccctaccccggttttaccccgg

SEQ ID NO: 88987 - DNA, 670 bp, Homo sapiens
  misc_feature: GYAE6OF01BZ14G.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacatggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggacaaacgccaggatcacctgctctgganattcattgacaaaagtatatacttgttcggtcagcagaagtcaggccacggcccctgtactggtcactccagtcggacggccacggtcgaccgaccgacgtccgggactcccgtagacgtacgtactttccgtcgtccgtccctaccgacgtccgtacggaacgggtacacgggttcggaccccttaaccgtttacggaaccttacgtaccggtacgggttccggggaccccgtaaggggtacggaacggtagtacggtaacgtcgtagtaacgttacgttagttacgtacgacctaaccgagtacgtaacggttaggtcggtacgtacgtacgggtaaggggttacgtacggggacgggtacggtaccgtaacgggttacgtaccggttcgttacggtcgaccgtaccggacggtccgtacccgtcccccgtcgtccgtccgttcccg

SEQ ID NO: 88988 - DNA, 738 bp, Homo sapiens
  misc_feature: GYAE6OF01AC319.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcgacctgctcgtggagatgctattgacctaaaaaatttgttggtttttacgtacctagcaggaagtcaaggtccacggtcccctggtcgttggtctactccagtaggacggacgaggacgaccgacccgtaccgggatcccgtgagagtacttctcgtggcctacccgaatccgagggtaccggtcggaccgtacggttacgtacgttactacgaggttccgggacccgtagggtacggacggatacggaaacggtcccgttagtaaccgttacgttaccgttacgtttaacgtacgacgtacgtaacggaacgcggtaccggtaagttcgggtactaaggtccggtaacggggggcttacgggttcccgggggacgggtaaccgggtaaccgtacggggttacccgtaacccgggttacccgtaacgggttcccggaacccggtaccccggaacggggtcccccttaccggtacccccccggttacggttaccccgtaaccgtttcccggtcccggtttaaccccccccg

SEQ ID NO: 88989 - DNA, 621 bp, Homo sapiens
  misc_feature: GYAE6OF01D1FUO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatccacctgctctgggatattcattcgaccaaaaagtaactatacttgttggttaccagcagaagtcaggccaggcccctgtactggtcatccatgaggccagtcgaacgacaccgtccgggactcccgtagagagtattcctctcgccctccacggcctcggaggacacggtcgccctaccttgaacttacgtcgaggtccggggacctagggtacggaacgaagtaggaagtcgtagaacttacgtattgtaccgcaaccgaagacaggtagtcggtactagttccggaaggggttacgtccggggacggagggaacccgaaggttccgggaacccgttccgttaggcctaacgggaccctaacgggcccgttccggaccccccgttcggtaccctaccgttccgttccccgg

SEQ ID NO: 88990 - DNA, 664 bp, Homo sapiens
  misc_feature: GYAE6OF01BIE9M.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagatatacttgttgttcaagcagagtcaggccaggcccctgtactggtcatccatgaggccagtcgacgacacgtccgggactccctgagagtacttctcgtcgccctcagctacgaggacaggtcggcctacttgactagtcgaggtcgggacccgtagggtcggacgtagtaggaagtccgtacgtacttaacgttagtttacggttaccgaccaaccgaagaaccgtaaggttacggtacgggtacctaacggttccgggtaagggggttacgttaccggggaaccggggtaacggggtaacccgttaaagggttcccggtaaccccggttcccggtttacgggtacccgtaccggaccccggtaagggtccccgtcccgggtacccccccggttcgggttacccctaccgttcccgtttcccccggg

SEQ ID NO: 88991 - DNA, 820 bp, Homo sapiens
  misc_feature: GYAE6OF01BS5MX.21.8.A08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagcatactctacagggggctgtgggctcaggaggcagagctctgggaatctcaccatggcctcggacccctctacttcctcccctcctcactcggtctgcacaggctctgacggcctcctagtgagctagacacacgccctacccgtcggtgtaccacggtcgtaccccgaggacgacggaccggaccgaggactccaccgtgtccttcgngacgagtagtacggactacgaaacgtaaaaagtaactagttacgtacgtttaacgttacgggaaacccaaagaacggaaccggaccgaaaccggggcccgaccgggtacccccgttaggtttacggttaacggtagtaaagttaactaaaacgtaaacgacgttaacgacggaacggaaccggtaccccgttaaggaacgtaaccggtacgtacccggtacgggtaacgtacgttaacgtttcccggtacgttaccggtaccgttaacccgacgttacccggtaaccggaacggggtaaccaggtaccggtaccgttaccggtaccggtttaacgtaaacccgtacgttacgtaaacgggttaacggaaccggttaccggaacgggtaccggaaggggtaacgggaaccggtacggtactaacgggtactttaaagttaccgtaacgtaacgaaacggtagtaacggtaacgtaaggttaacgtacggtacgtacgtagggttcggtacgggtaacggacggtacggactaaggctccggtaacgtcgacggtacaccggacgacgtccgtacccg

SEQ ID NO: 88992 - DNA, 611 bp, Homo sapiens
  misc_feature: GYAE6OF01AM8WT.21.8.A08.1.454.CMB.1.raw
  modified_base (220)..(220): a, c, t, g, unknown or other
  misc_feature (220)..(220): n is a, c, g, or t
  modified_base (331)..(331): a, c, t, g, unknown or other
  misc_feature (331)..(331): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctggtgtcagtcgtccccaggacaaacggccaggatcacctgctcgtggagnttcattcgaccaaaagatatacgttgttcggtccagtcagaagtcacggccacggcccctgtactggtcatccagtgacggccagtcgacgacaccgtccgggatccccgngacgtatacttctctcgcctccagctcgaggacaggtcgacctacgtgactatcgacgggtcgggaccccgtagggtcggaacgtagtacgaacgtcgtacgtacttacgtagttacgttaccgacgtaccagacgtaggtacgttcggtacctaggttaccgggtaggggttacgtccggggacgggtacggaacggtacgttccggacccggttccgtcgggtacaccggacccgtaaggtccgtacccgccccgttcgtcctccgttcgttaccccg

SEQ ID NO: 88993 - DNA, 632 bp, Homo sapiens
  misc_feature: GYAE6OF01DXHWG.21.8.A08.1.454.CMB.1.raw
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctctgganattcatcgaccaaaagatntacgttgttgttcagcagaagtcaggccacggcccctgtactgtcatccagtggagccgagtacgacgacacggtcggactccgtagagacgtacttctcgtcgccctcacgctacgaggactaggtccgaccctacgttcgtaacgtactcgacggtcggggacccgtagggttcggaacgtagtacggtaacgcgtacggtaacttacgtttacgtttacggttacgacctaacgaacgtacgtaagtaggttcggtacgtaggtacgggtaaggggttacgtccggggacgggtaacggtaaccgtacggttcgtacccggttcgttacggtcgacggtacccgaggtcccgtcccgtaccccggtacgttcctaccgttccgttccccg

SEQ ID NO: 88994 - DNA, 563 bp, Homo sapiens
  misc_feature: GYAE6OF01BXC46.21.8.A08.1.454.CMB.1.raw
  modified_base (221)..(221): a, c, t, g, unknown or other
  misc_feature (221)..(221): n is a, c, g, or t
  modified_base (515)..(515): a, c, t, g, unknown or other
  misc_feature (515)..(515): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatcacctgctctgganattcattcgaccaaaagatatacttgttgttccagcagaagtcaggccaggcccctgtactggtcatccatgacgccagtcgaccgacacgtcccgggatcccgtgagagtacttctctggccctcgagtcctcgaggtacaggtcggcctaccgttgactatcgaggtcgggcccgaggtacggacgagtgacgctagactacgtacgttgtaccgcacagacgtagtagtgactagtcgaggggttcgtcgggcgggtacggaccgtaggtcgtaccggttccgttggtccncggtacccgaggtcctccggaccccctcggtacctctcccgttcccgg

SEQ ID NO: 88995 - DNA, 628 bp, Homo sapiens
  misc_feature: GYAE6OF01C3ZG9.21.8.A08.1.454.CMB.1.raw
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (329)..(329): a, c, t, g, unknown or other
  misc_feature (329)..(329): n is a, c, g, or t
  modified_base (433)..(433): a, c, t, g, unknown or other
  misc_feature (433)..(433): n is a, c, g, or t
tcagtcgtcgctcgcacgaccggtgctcgatttagcatactctacagggggcgtgtgggctcaggaggcagagctctgggaatctcaccatggcctcggacccctctcctcgcctcccccctcctcactttctgcacagtctctgaggcctcctatgagctgacacagccaccctcggtgtcagtcgtcccaggaacaaacggccaggatcactgctctgganattcattcgacaaaaagatatacttgttgttccagcagaatcaggccnggcccctgtactggtcaatccatggaggccagtcgacgacacgtcggatcccgtaganagtattctacgtcgtcctccaagtccgtacgaagggactaggtccggaccctacgtttagaacttacgtctagggtacggggacccgtagggtaggaacgtaanaggtaaagctagtaccttaagtaagttcgtaacgtccgaacagtaacgaagtaggttacgtcgtaagtacggtaggggttacgttcgggacgggtaacgggtaccgaaaggttcgaccggttaccgttagggtccgtaacgacccgtaaacggccgttacccgtacccccgtggttacccacgtccgttacccgg

SEQ ID NO: 88996 - DNA, 568 bp, Homo sapiens
  misc_feature: GYAE6OF01BFV9H.21.8.A08.1.454.CMB.1.raw
  modified_base (553)..(553): a, c, t, g, unknown or other
  misc_feature (553)..(553): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccacggcccctgtactggtcatccatgaggccagtcgacgacaccgtccgggatcccctgagagacttctctcgcctccacgctcgacggacaggtcggcctaccgttgactatcgaggtcgggcccgagggtcggacgagtagaagacgtagacttacgttattagttacgcaccagaacgaggtagtgtacgtagtacggaggggtagtcgggcgggaggaccgaagttcgaccggtcgttggacgcgacccgaacggccgtacccggtcccccgtacggttccnccgttccgtaccccg

SEQ ID NO: 88997 - DNA, 721 bp, Homo sapiens
  misc_feature: GYAE6OF01CX851.21.8.A08.1.454.CMB.1.raw
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
  modified_base (540)..(540): a, c, t, g, unknown or other
  misc_feature (540)..(540): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcacctttctgcacagtctctgacggcctcctatgagctagacacacgcccacccgtcggtcgtcacggtccgtaccccgaaggaaccgaaaaccggccaaggactccaccgtggcctcgtggactattcattacgaaccaaaaagattattacgtttggttcggttaccaagctaagaagtcgacggccacggtcccctagtacgtcggtaccaacttccgaagtcggaacggcccgtaacggtccggaaaccgtacctaaccggttcccgggacttcccgaggacggtatacttccgtactcgtacccncgacgcgtacgagggacncggtcgaccctacgttgactacgtcggtacggtcgggaccgtagggtacgagacgtgaacgtctacggtacttacttagtcgttaaccnccgtaacgtagacggttaggtacggttggaaccgtaggttacggggtaaggggttacgtacggggaaccgggtacggtaaccgtagggtccggtaacccggttcggttacgggacgaccggtaacccggacgggtccctccccggtacccgttccggtacttcccggtcccgtttccccgg

SEQ ID NO: 88998 - DNA, 842 bp, Homo sapiens
  misc_feature: GYAE6OF01DGLI6.21.8.A08.1.454.CMB.1.raw
  modified_base (131)..(131): a, c, t, g, unknown or other
  misc_feature (131)..(131): n is a, c, g, or t
  modified_base (191)..(191): a, c, t, g, unknown or other
  misc_feature (191)..(191): n is a, c, g, or t
tcagtcgtcgctcgcacgaccggtgctcgatttagcatactctacagggggctgtgggctcaggaggcagagctctgggaatctcaccatggcctcggacccctctcctcgcctccccctctctactttcngcactgtctcgtggacggtcctctatggacgtctagaccacgacgccctacccgtgggtntcgacggtccgtaccccgaaggaaccgaaaccgggtccaagggtactaccctaccgtgtcctcgtagggtaactacttacctaagttacgaaaacctaaaaagtacttacgttacgtttggttccgttaccgagtacgaaggtaacgtccgaacgggtacccgtaccgggtaccccttggtaccgttggtacctaacgtccgagtacggcggtaccgaggttaccggaccgtaaccgtccggtaccgggtactaccggtaggaacgtaacgttccttccgtcgtccgtacccgtacgtacgtccgtacggtaacgggtccgtacggccggtaacccttacgttacgacgtacgtaccgggtacggggtaccgggacccggtaggtacggtaacggtaagtaacgggtaacgtacgtaacgtaacgttaacgttacggttacgtaacccgaccctaaggtaacgtaacgtagggtaacgtacggtacgtaaggtcggggttaagggtaccggtacgggggtaaccggtaacggtaggtacccggttacgggtacccggttcggtacggtaaccgtccgggaaccccgggtaagttcccccggtacccggaccccggttacggtcccttaacccgttcccggttaccccccgg

SEQ ID NO: 88999 - DNA, 873 bp, Homo sapiens
  misc_feature: GYAE6OF01BZBKW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctctcactttctgcacagtctctgaggcctcctatgagctgacacacgcccacccgtcggtcgtcaggtccgtaccccgaaggaaccaaaccggccgtaggactccgaccgtcgtactccgtaggagtacttacgtagttacgaaaccgaaaaagtaacttacgtttaacgtttggtttacggttacccgtaagtacgaagtaaacggtccgaaccgggtacccgtaaccggtcccccgttaggttaaccgttcgggttaccctaacgttacccgtaggtacggtaccggtacccgtaacggtaacccggaaccggtaacccgtaccgggtacccgggtaaccttacccggtaggaacggttaacgtacctttcccgttccggtacgtacccctccgaacgtccgtaccgggaacgggtaccgtacggtaccggacccttaaccgttacggtaaccttacgtaccggtacgggtaccggggccgtaacggggtacggtaacgtacgttaacgggacgttaccgtacgtaaccttaacggtttagttaacccgtaaccgaccgtaacggaacgttaacgtacgggttacgtacggttaccgacgggttaacgggtacgggggttacgggtacgggaaacggggtaacgggtaaccgttacggtaccgggttacccgtcgttaacggccggacccggtacccggtaaggtccccgtcccggtacccccgttaggtaccttccccgtccggtttcccccgg

SEQ ID NO: 89000 - DNA, 809 bp, Homo sapiens
  misc_feature: GYAE6OF01E3EBD.21.8.A08.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
  modified_base (147)..(147): a, c, t, g, unknown or other
  misc_feature (147)..(147): n is a, c, g, or t
tcagtcgtcgctcgcacgaccggtgctcgatttagcatactctacagggggctgtgggctcaggaggcagagctctgggaatctcaccagtcggcctcggacccctctcctcgccctcccccttctctactttcngcacngtctcgngacgtcctactagtgacgtcacgacctaccgaccgtccctaccgtcggtacgtaccgtaccggtacccggaacccgaaacggaacccgaaccggaccgtaacggtacctaccgtaccgtcgtaccgtacggttagtaacttacttaactaacgttaaaacgaaaccgtaaagttaacttacgtttacggtttaccggacgaaccgaggaacgtaccgtacgacccggaccgtaccgtaccgttcgttaagccgtactaccacggacgtacggacgaccgtacggtacccgaaccggtaccgtaacccggtccgtaccggttactacgaacgttctaccgttcctccggaccaccgtacgacggtacgaacggtcggacgtaccggtccaacgttacgtgacgttacggcggacggacgggagtaacggagaccgtagtacgtacgtattaacctaacgttacgtacggtacccaacggtaaccgacgtaggttagacggtcgttaacggcggttaacggggtaacgggtaccggtagggtaccggtaaaccgcggtttaacgtcccggaccgtaccggttgaacccggttcccaaccgggtcccgtaccgtcccgtcccccgtacgtcctacccttccccggttcccgtaccccttccccgg

SEQ ID NO: 89001 - DNA, 712 bp, Homo sapiens
  misc_feature: GYAE6OF01CVO8Y.21.8.A08.1.454.CMB.1.raw
  modified_base (341)..(341): a, c, t, g, unknown or other
  misc_feature (341)..(341): n is a, c, g, or t
  modified_base (398)..(398): a, c, t, g, unknown or other
  misc_feature (398)..(398): n is a, c, g, or t
  modified_base (508)..(508): a, c, t, g, unknown or other
  misc_feature (508)..(508): n is a, c, g, or t
tcagtcgtcgctcgcacgaccggtgctcgatttagcatactctacgagggggtgggctcaggaggcagagctctgggaatctcaccatggcctcggacccctctcctgcctccccctctctactttctgcacagtctctggacggtcctcctagtgagctacgaccacaccgcccaccgtcggtcgtccgaggttccgacccccgaaggaaaccgaaaccggccgaaggtactccaccgtgtcctacgtaggaagtactttacgagttaacgaacctaaaaagtattaacgttacgtttggttacggtacagactagagtcgaggccacggcctaggtacnggtacatcgagtcgacgcagtccgaacacgccgtcggactccgtagacgtactcgtntccgacgacctcagtccgtacggaacggaactggtacccgcctaaccgttaggaacttacgaccgggtaacgggacccgggtccgaagggtcgaaccgtagacggacgtnacgtaaccgttacgttagtccgaacccgtacaaccgagtaacgtaggtacggttactacggacggttacggggtagggttaccggtacgggacggtaacggtaccggttaagtcccggtaccgttcgacggttccaaccggacccgaacggtccacccggtccccggtccgtactaccgtttcccgtccgttccccgtcccccg

SEQ ID NO: 89002 - DNA, 678 bp, Homo sapiens
  misc_feature: GYAE6OF01BY3CD.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcactgtctctgaggcctcctatgagctgacacagcccacccgtcggtgtcagtcgtccccgaggaccaaacggccaggactccacctgctcgtggagtattcattcgaccaaaagatatacttgttgttccagcgaagagtcacggccacggtcccctgtactggtcatccagtgacggccagtcgacgaccaccgtccgggactcccgtagagtacgtacttccgtcgtcgaccctcgacgtccgtacgacgggtactacgggtccgaccctaccgttagtaccgtataccggtagggtaccggggacccgtaggggtacggacggagtacggaacgtcgtacgtaaccttacgttacgtttacggtacccgaccgtaccaagtacgtaggttaggtcggtacgtagtacgggtaggggttaccccgtggggacgggtacgggtaccgtacggttccggtaccggttccgttcgggactaccggtcccgaacggtcccgtacccggtacccccgttacggtccctaccgttcccggttacccccgg

SEQ ID NO: 89003 - DNA, 659 bp, Homo sapiens
  misc_feature: GYAE6OF01A40BY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaaccaaaccggccaggactccacctgctcgtggatattcattgaccaaaaagatatacttgttcgttccagcagaagtcgacggccacggcccctccggtacgtggtacactccatgacggccagtccgacgacaccgtccgggatcccgtggaagtagtactttccgtctcgcccctccgagtcctcggagggactaggtcggacccctaccgttggtacctacgtacgacgggtcggggacccgtagggtacgggacgtacgtaggaacgtcgtacgtaaccttaagttacgtttacgttaaccgaccaaccgacgacgtaaggttacggtcggtacgtacgtacgggtaggggttacggtaccgggacgggacggtaccgtaacggtacggtaccggttccggttcggaccgacgacccgaaggtcccgtccgtcccccgtcggtcctccgttccgttaccccg

SEQ ID NO: 89004 - DNA, 750 bp, Homo sapiens
  misc_feature: GYAE6OF01BJJ1L.21.8.A08.1.454.CMB.1.raw
  modified_base (176)..(176): a, c, t, g, unknown or other
  misc_feature (176)..(176): n is a, c, g, or t
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacagcccaccctcggtntcagtcgtccccaggacaaacggccaggatcacctgctctgganttcattgaccaaaagatatacgttgttcggtccagcagatcaggccacggccctgtactggtcactccatcggacggccaggtaccgacgacacgtacccgggatccccgtgaacgacgtacttcctcgtcgccctccgaatccgttacgaacggggtactacgggtacgtaccctaccgtttggaaccttacgtaccgtaacgggttccggggaccccggtacggggttacgggtaacggtacggtaacgggtaacggtaccgttacgggtaaacccttaacgtttacgttttacggttaaccccgtaccgtaaccgtaaacggtacctaacggtttaacggttacggtacgtacggttacggggtaacggggttaacggtttaccggggacgggtaaccggggtaccgttaacgggttaccggttacccggttccggttacgggttaccggaccggtaacccggtagggtaccccttccgggtaccccccgttaccgggtacccgtcccggttcccgttacccccggg

SEQ ID NO: 89005 - DNA, 661 bp, Homo sapiens
  misc_feature: GYAE6OF01AYAZF.21.8.A08.1.454.CMB.1.raw
  modified_base (218)..(218): a, c, t, g, unknown or other
  misc_feature (218)..(218): n is a, c, g, or t
  modified_base (334)..(334): a, c, t, g, unknown or other
  misc_feature (334)..(334): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggcaggatcactgctctgganattcattgaccaaaagatatacttgttgtccagcagagtcaggccacggccctgtactggtcatccatggacgccagtcgacgacaccgtccgggatcccgtgagagtactttccnctcgccctccgagccgtacgagggactacggtcggtccctaccgttacgacttagtcgacgggtccggggcccgtaggggtacgggaacgagtaggaacgtcgtacgtaacttacgttagtttacggttaccgacctaaccgacgtaacgtaggttacggttcggtacgtagttacgggtaagggggttacgttacggggacgggtacgggtaaccgtaacggttcggtaacccggtttccggttacggtaccgaccggtacccgaacgggtcccgttacccggtaccccccgttcgggtacccttacccgttcccggttcccccgg

SEQ ID NO: 89006 - DNA, 820 bp, Homo sapiens
  misc_feature: GYAE6OF01A1CWO.21.8.A08.1.454.CMB.1.raw
tcagtcgtcgctcgcacgaccggtgctcgatttagcatactctacagggggctgtgggctcaggaggcagagctctgggaatctcaccatgcctggacccctctcctgcctccccctcctcactttctgcacagtctctgacggcctctatgacgctgacacacgcccacccgtcggtgtcgacggtcgtccccgaagggaacgaaaccggtccgaggactccacccgtgctcgtggaagtacttcgtattacgaaccaaaaagtattaacttacgtttggttcggttccaagacaaggtaagtcgaacggccacggtacccctagtacgtggaccacgtcgagtaggacggtccgacgtccggaacgaccgtaccggtacccgggtactacccggtagacggtaacgttctttccgtcgttccggtaccctaccggtaatccggtacggaacggggtaacctacgggtcccgtaccccgttaaccgtttacggaacctttacgttaccggtaacggggtcccgggggacccggttagggggtacggaacggtaacggtacggtaacgtaccgtacgttaaaccgtttacgttaacgtttacggttaacccgaacctaacggtaacggtacgttaagggttacgttacggtacgttaacgggtcggtaagggggttacgtacggggacgggtaaccggtaacggttacggttaccgggtaccgtttccgggttacggaccggtaacccggaccggtaacggtccccgttaccccgggttaccccgttaccgggtcccttcccgttcccggttaccccccg

SEQ ID NO: 89007 - DNA, 679 bp, Homo sapiens
  misc_feature: GYAE6OF01BGZ73.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccgaggacaaacggccaggactcacctgctcgtggagtattcattcgaccaaaagattatacttgttggttccagctagaagtcaggccacggtcccctagtactggtacactccatgaggccagtccgacgaccacgtccgggactcccctaggacgtagacttcctctcgcccgtaccagtcctcgacgggacacggtcgcctaccttggacctagtccgaggtccggggacccgagggtacggacgtagtacggaacgtacgtacggtaacttaacgttacgtttacggttaaccgcctaacccgaagtaacggaagtttacgggtacggtacgtagtacgggtaaggggggttacttaccgggggcgggtaacggggaaccctagggttaccgggtacccggtttccggttacgggtaccgacgggtacccgaacgggaccttcccggacccccggttcggtaccccttacgttcccggttacccccg

SEQ ID NO: 89008 - DNA, 678 bp, Homo sapiens
  misc_feature: GYAE6OF01B1ZIS.21.8.A08.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagcatactctacagggggctgtgggctcagggaggcagagctctgggaatctcaccatggcctggacccctctcctgctccccctcctcactttctgcacagtctctgaggcctctatgagctgacacagccacctcggtgtcagtcgtcccaggacaacggccaggctcactgctcnggatcttcatcgaaccaaaagtatatacttgttgttcagcaagaagtcaggccacggcccctgtactggtacatccgatcggacgcctaggtaccgacgacgaccgtcgggaactcccgtaggagtacgtacttccgtacgtacgtccctaccgagtccgtacggacggactagggtaccgcctaaccgttgaccttagtaccgtacggtaccgggaccgtagggtcggtacgtacgtacgaacgtccgtacgtaaccttaacgttagttacgttaccgacctaacgacgtaacgtacggtaacggtcggtacgtaggtacggtagggggttacgttacggggacgggacgggtaaccgtacggttaccggttaccggtcccgttaggtaccggacccggtacccggtaacggtccccggtacccggtcccccggttacggtccttcccggttcccgttacccccgg

SEQ ID NO: 89009 - DNA, 659 bp, Homo sapiens
  misc_feature: GYAE6OF01CTOOU.21.8.A08.1.454.CMB.1.raw
  modified_base (431)..(431): a, c, t, g, unknown or other
  misc_feature (431)..(431): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtcggtgtcagtcgacccgaggaccaacggcaggactccacctgctcgtaggatattcattacgaaccaaaagattacttacgttgttacgtaccagacgaagtaacgtcgacggccgacggtccctaggtacgtcggacactaccgagtcggacgccgaaggtccgaacgaccaccggtaccgggactaccgaggacgagtacgttcctccgtctcccgtacacgtcgtacggaggtacctggtcgccctacgttanacgtatcggtacgggtaccggaccggtagggtacggaacggtagtaacggaacgtacgtacgttaacttaacgttacgtacgtacgaccgtaacgaagtaacgtagtacggtcgtactaggtacgggagggttcgacgggacggtacggacgtaggttccgtacggttcgtacggtacaccggtaccgaggtcccgtcccgtcccgtaggtccctccgtccgtccccg

SEQ ID NO: 89010 - DNA, 713 bp, Homo sapiens
  misc_feature: GYAE6OF01CZK29.21.8.A08.1.454.CMB.1.raw
  modified_base (701)..(701): a, c, t, g, unknown or other
  misc_feature (701)..(701): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctctactttctgcacacgtctctgacggtcctctatgacgctagacacacgccctacccgtggtgtacagtcgaccccgaaggaacaaaaccggccaaggtactaccacctgcctgtaggaatacttacaagttacgaaacctaaaaaagtaattacttaacgtttgttacggttaccaagacaagtaacgtacgacggaccgacgtacccctagtaactcggtacacgtaccaagtacggaacggccgtaacgtaccggaacgaaccgaccggttaccgggactcccgtagaacgtagtacttcgtacgtcgacctccgagtccgacggacggactaggtccgaccttacttacgactagtcgtacggtcgggaccgtagggtacgaacgtagtaacgagtacgtacgtaacttacgttagttacgtaacgtaccaacgaacgtaacgtaaggttaaggtacgtaacgtacggtacgggtaaggggttacggtacggggacggtaacggtaacgtacggttacgtaccggttacgtacggacgtaccgaccgtacggccgtccgtacccgtaggtaccncgtcgttacccg

SEQ ID NO: 89011 - DNA, 653 bp, Homo sapiens
  misc_feature: GYAE6OF01ECO26.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccaccctcggtgtcagtcgtccccaggaaccaaaccggccaaggactccacctgctctggatattcattcgaccaaaaagtaatatacgttgttcggttccagcaagaagtcaggccacggcccctgtactcggtacagtccagtcggacggacccgtaggtaccgaaccgaccgtaccgtacccggggtaacttccccgtaggaacgtacgtacttttccgtccgtcgccccttccgacgtcgtaccgagggacctaggtccggcctaccgtttgaaccttatacgacggtcggggccgagggtaggacgtagtagaacgctacgtactaacttagtttagtaaccgctaaccagtacgtagttaggtggtacctaggtacggtagggggttagtcgggacgggtaacggaacgtacggttacgtaccggttccgttggtacacggacccgaggtccgtccgccccgtgcctacgtccgttcccg

SEQ ID NO: 89012 - DNA, 818 bp, Homo sapiens
  misc_feature: GYAE6OF01BUTU0.21.8.A08.1.454.CMB.1.raw
  modified_base (236)..(236): a, c, t, g, unknown or other
  misc_feature (236)..(236): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgacggcctcctatgagctagacacacgcccacccgtcggtgtcgacggtcgtaccccgaaggaaccaaaccgggccaggactccacctgcgtcgngggatacttcgtattacgaaccaaaaagtaattacgttaacgtttgggttacggttacccgagtaccgaaggtaacgtccgaacgggacccgtaccggtcccccgttaggttaaccgttcggtacctaacgttccgaagttcggaacgacccgtacggtccggaaccgaccgtacccggtaccgggtaccttacccgtagaacggtacggttaccttccggttcctccgtaccccgtacccgtaggtcccgtaacgggacggtaacgtacggtcccggtaccttaccgtacgttacgtacgttccgggaacgggtccggggtaccggtagggtacgggaacgtaggaacgtaaacggtctaacggttaaccgttagtttaacggtttccaacgaacccgtagaacgtacggttgtaacgggtctacgggtacggttaggggtacggggttcggtaccggggtaccggaagggttaacccgttagggttacccggaccgggttttccggtacggtactacggacccggtaacggccccgtcccggttccccgtaccggtccttcggttccccgttacccccgg

SEQ ID NO: 89013 - DNA, 694 bp, Homo sapiens
  misc_feature: GYAE6OF01AX06M.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtggtntcagtcgtccccaggacaaacggccaggatccactgctctggatattcattgaccaaaagatatacttgttgttccagcagagtcaggccacggcccctgtactcggtacatccagtcgacgccgagtcgacgaccacgtccgggactacccgtgaacgacgtacttcctcgtcgccctccgacgtccgtacgacgggacacgggtccgacctaccgttcggactacgtcggaggtccgggaccgtagggtacggacgtagtacggaacgtcgtacgtacttaacgttagtttaccgtaacgacctaacgacgtaacgtaggttaacggttcggtactacgttacggggtaaggggttacgttaccggggacgggtaaccgggtaaccgtagggtttaccgggtaccccgtttcggttaccggtaccggtacccggtaaccccggtaacgggttccccgttaccccggtacccccggttaccgggtaccctttcccgggtaccccgtttcccccgg

SEQ ID NO: 89014 - DNA, 794 bp, Homo sapiens
  misc_feature: GYAE6OF01DHIRJ.21.8.A08.1.454.CMB.1.raw
tcagtcgtcgctcgcacgaccggtgctcgatttagcatactctacagggggctgtgggctcaggaggcagagctctgggaatctcaccatggcctggcccctctcctcgccttcccccctcctcactttctgcacagtctctgaggcctcctatgagctgacacagcccacccgtcggtgtcagtcgtccccaggaaccaacggccaggatccacctgctgtggagtacttcattcgaaccaaaaagtatattacttgtttcggttccaagtcagaagtcgacggccaggccccctagtaccgtggtcatccagtcggagccgaagtcgaacgacacgtccgggactccctaggacgtagtatttccgtcttcggtccctccgacgtcgttacgaacggggtaaccacgggttcggacccctaaccgttttacgggaacctttacgtaccggtaagggtcccggggggtaccccgtaggggtacggggtaacccgtaaggtaacgggtaaacggtccgtttaacgggtaaccgttttaaccgtttaacgtttacggttttaacccgaccgtaacccgtaacggtaaccgttaaggttaaccgggtttagggttacctaacggtttaccggggtaaacggggggttttacggttaccggggaccggggtaaaacgggtaacccgtaaacgggtttacggtaacccggttaccgtttcggggaccgtaccggaaccccgtaacgggtcccgttcccgacccccggttccggtaccgtcccgttcccgttacccccg

SEQ ID NO: 89015 - DNA, 686 bp, Homo sapiens
  misc_feature: GYAE6OF01D2J80.21.8.A08.1.454.CMB.1.raw
  modified_base (529)..(529): a, c, t, g, unknown or other
  misc_feature (529)..(529): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccgtcggtgtcagtccgtcccgaggaaccaaacggccaggactccacctgctcgtaggagtacttcattacgaacctaaaagacttattacgttggttcggttaccagacgaagtaacgtcgacggaccaccggtccctaggtaccgtcggtactacgtccgaacgttggaccggtaccgacggtccgaaccggaccgtaccgtaccgggacttccgtagagtagtacttcgtaccgtcgtccctccgacgtcctacggacgacgtcggtcgaccttcgtacgactacgtcgacgggtaccggccggtaggtacggacgagtacggaaacgtctagtaacttacgttacgttacgtaccncgtaacagtacgtagtacgttacgtacgtaggttacgggtagggttacgtacgggacgggtaacggtacgttacggtcgtaccgttcggtacgtcggtaccgacccgtaacggtcccgtacccggtccccgtagtacctccgttcccgttaccccgg

SEQ ID NO: 89016 - DNA, 773 bp, Homo sapiens
  misc_feature: GYAE6OF01D2WC8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccttctatgagctgacacacgcccacccgtcggtgtcagtcgtaccccgagacgaaacggcaggactcactgctcgtaggatattctattacgaaccaaaagtaattacgtacttggttcggtaccagacaggaagtcgacggaccgacgtccccgtagtcgacgttacactccgagtgaccggaccagtaccgacaccgacgttcccgggactcccggtagaggtatcttcgtcctcgtaccctccgagtccgacggacgggtactacgggtaccgacccgttaacgttacgaacttacgtagggtacccggggtacgggacccggtaggggtaacggtaacggtaaacgttacggaaacggtccgtttaaggttaaaccctttaacgtttaaacggttttaccggaacccggtaccctaaacggtaacgtaccggttaaggtttaacccggttaggtaccgtaacgggggttaaccggtaggggggtttaaccgggtaccgggggtaccggtaaaccggggtaactaccgggtttaccggttaccggttaccggttcgtaacccggcgtaacccgggtacgccccggttcccgccccgtttacggaacctccccgtacgttcccccg

SEQ ID NO: 89017 - DNA, 777 bp, Homo sapiens
  misc_feature: GYAE6OF01AFOAE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtcctctgacggcctcctatgagctgacacagcccaccctcggtctcagtcggtccccggaacaaaccggccaggactccacctgctcgtggagatgactattacgaaccttaaaaaagttttgtttaggttttttacggaaccacgtacgaacggtaacgtaccgaacggaccgtaccgggtccccgttggttcggtttcggtacctacttacccgaaggtacggacgggaacgtaacggggaaccgtacccggtacccccggtaccgggtactccccgtaggacgtaacgtcgtttccgtacgtccggtacctaccgtaacgtcggaacggggtaccggtccggaccgttacggttctacgttcggtaccggtacgggttccgggggacccgtagggggttcggaaggtacggtacggtaacgcgttacgtaaccttacgttaacgttacgttaccgcgtaacgcgtaacgacgagtcgaacgttggtactaacggcggaggggtccgtaaggttcgggacgggtacggtaccggtagggttccgtacccggtacggtacgggtacccgaccggccgtacggtcccgtacccgtcccccgggttcttaccgtaccgtccccgttccgtcccccgttacccg

SEQ ID NO: 89018 - DNA, 698 bp, Homo sapiens
  misc_feature: GYAE6OF01AJQOG.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaaccggcaggactccacctgctcgtggagtattccattcgaacctaaaaagtaattattacgtttgttcggttaccagtacagtaacgtcgacggtccgacggtccccctgtaccgtggtacacttccgatcggacggtcctaggtccgaccgtacgaccgttcccgggacttaccccgtagacgtacgtacgtttccgtccgtcgtccccgttaccgacgtaccgttaccggagggtaacgtacggtccggtaccctaccgttaggtaccttacgtcgaacgggtcccgggtacccgagggtacggacgtacgtaggacgtcgacgtactacgtcgttacgtcgacacacgtacgtagtacgagtctacggtacggtaggggtactacggggacggtaacgggaccctaagggttccgacccggttaccgtggtaccgacggtacccggtacgtcccgtacccggtcccccggttaggtaccctccgttcccggttaccccg

SEQ ID NO: 89019 - DNA, 665 bp, Homo sapiens
  misc_feature: GYAE6OF01E2RYQ.21.8.A08.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacagcccaccctcggtgtcagtcgtcccccaggaaccaaacggccaggatcacctgctctgganattcattgaccaaaagatatacttgttgtccagcagaagtcaggccaggcccctgtactggtcatccatgacggccagtcgacgacacgtccgggatccctgagagatttcctctcgccctcagcctacgacgggacaggtcggtccaccgtttagaccttatcgacggtcggggcccgagggtcgggacgagtagaagtctcggaacttaacgttaacgtttcggttaaccggacctacccgaagaaccgtaagggttaaggtacgggttacgtaacgttacgggtaaggggggttaacgttccggggaaccgggaacggggtaacccgtaaacggtacggtacccggttcccgttagggttccgaaccggaccccgaaacgggtcccgtacccggtccccccggttacgggtccccgtaacccgttcccgttccccgg

SEQ ID NO: 89020 - DNA, 556 bp, Homo sapiens
  misc_feature: GYAE6OF01EBSHW.21.8.A08.1.454.CMB.1.raw
  modified_base (176)..(176): a, c, t, g, unknown or other
  misc_feature (176)..(176): n is a, c, g, or t
  modified_base (220)..(220): a, c, t, g, unknown or other
  misc_feature (220)..(220): n is a, c, g, or t
  modified_base (428)..(428): a, c, t, g, unknown or other
  misc_feature (428)..(428): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtntcagtcgtccccaggacaaacggccaggatcacctgctctgganattcattcgaccaaaagatatacttgttgttccagcagaagtcaggccaggcccctgtactggtcatccatgaggccagtcgacgacacgtccgggactccctgagagacttctctgccctcagtcctcgagggacagtcggaccacttgacttatcgaggtcgggcctaggtaggacgtagagaacgctagtactattagttgtacnctaacagactagtagtaggtctagtaccggtaggggtcgtcgggacgggtacggtacgtagtcggtaccgttccgttggtacacgcccgaaggccgtcgacccccgtcgtcctacgtccgttccccgg

SEQ ID NO: 89021 - DNA, 715 bp, Homo sapiens
  misc_feature: GYAE6OF01ARCKS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtccgtaccccaggaaccaaaccggccaaggactccactgctcgtggagtattcattacgaaccaaaagtatattacgttgttggttccagtcaagaacgtcacggccgacggtccccctgtaccgtcgtctactccgagtggaccgccgtacggtccgaaccgaccgtacccggtaccgggtactcccgtaggaacgtagtactttctcgtccgtccctaccgacgtccgtacggaacgggtacctacgggttcccgaaccgttaccgttacggaacctttacgaccggtacggggtaccgggggaccccgttaggggtacgggtaacgtagtacgggaacgtccgtacgtaaccgttacgttagttacgttacccgactaaccgagtagtagttacggtcgtacgtaggtacgggtacggggttacggtacgggacgggtacggaccgttacggttaccgtccggttacgttcggaccgtccgtaccgacggtcccgtcccgacccgttaccgtccgtcctccggtccccg

SEQ ID NO: 89022 - DNA, 785 bp, Homo sapiens
  misc_feature: GYAE6OF01ACT5R.21.8.A08.1.454.CMB.1.raw
  modified_base (196)..(196): a, c, t, g, unknown or other
  misc_feature (196)..(196): n is a, c, g, or t
  modified_base (441)..(441): a, c, t, g, unknown or other
  misc_feature (441)..(441): n is a, c, g, or t
tcagtcgtcgctcgcacgaccggtgctcgatttagcatactctacagggggcgtgtgggctcaggaggcagagctctgggaatctcaccatggcctggacccctctcctcgcctccccctctcactttctgcacagtctctggagtcctcctatgacgctgacacacgccctacccgttccggtgtctaggttccnccccgaaggacgaaaccgggcaggactaccgacctgaccgttcgtggaagtactttcaagttacggaaccctaaaaagttacgttacttaccggtttacggttcggttaccgagtacgaaagtacggtaccgaaccgggtccaacggtccccgtagtaccgtcgtaccatcccgagtacggacggtccacgtaccgacgaccgtacggtccggactccgagtacgaacgtctttaccgtccgtanaccccgtccgagtcccgttacggaaggttaccgaccggtacccggttaccccacgtttacgacggtaaccgtcgtaacggggtccggggacccgtagggtagtaaccggacgtaacggtactaccgttacgacctttaagttccgttacggtaacccgccgtaagtaaccgggtactagggttaaccgtcgggtaacgttaacggttaccgggtaagggtttaccggacgggtcgggaaacggttaccgtacgggttcctccggttacgtacgtacccacgggtaccctaccggtcccgtacccggtccccggtaacttccgtaaccggttccttaacccccgg

SEQ ID NO: 89023 - DNA, 724 bp, Homo sapiens
  misc_feature: GYAE6OF01B7G88.21.8.A08.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagcatactctacagggggctgtgggctcaggaggcagagctctgggaatctcaccatggcctggacccctctcctcgcctcccctcctcactttctgcacagtctctgacggcctcctatgagctgacacacgccaccgtggtcgtcagtcgtcccgaggaccgaacggcaggactcgactgctcgtggatntcagtcgaacaaagtatatacgttgtcggtaccagcgaagtacgtacgacggccgacggtcccttaggtaccgtggtacctactacgagtacgaccggactacggtacgaaccgaccgtaccgttaccgggtactcccgaaggtagacggttacttccgtacgtccgtaccgtccgtagtccgaacggacgggaacttacgggccgtacctacgttcgaacttacgtacggtaacggggtccggaccgtagggacgtagaacgtgaccgtgtaaccgttactacgttacgttacgaccaccgtaaggacgtaacgtggtaacgtcgtacgtaacgggtcggggtacgggttacgtccgggaaacgggttgggaaaccttaccgggttcgggttaaccccgttcgggtttaaccgggacccgtaaacgggtccccggtaaacggtcccggtccccggtaccccggtttggtaaccctccggtttaccccggttcccccgg

SEQ ID NO: 89024 - DNA, 749 bp, Homo sapiens
  misc_feature: GYAE6OF01BGV0J.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtggtgtcagtcgtccccaggacaacggccaggactcacctgctcgnggatattcagttcgaaccaaaagtattattacgtttggttcggttccagtacctaaggaacgtccgaacggcctaccggtcccccgttagtaccgttggtacactccgagtcggacgccgagtaccgacgaccaccgtccggtactcccgtagacgtagtacttccgtccgtacgcccctacgacgtccgtaccggacgggtaccctagggtccggtacccttaccgttacgtaacgttacgtaccggtacgggtccggggaccgtaaggggtcggaacgtagtacggaacggtcgttacgtaccgttaacgttacgtttaccggtaccgaccgtaaccgagtaacgttaaggttacggttacggtaccgtaaggttacgggtaacggggttacggtaccggggtaccgggaacgggttaaccgtagggttacccggtaccggtttcccggttcggtacccgtaccggacccggtaacggtcccgttcccggaccccccgttggtccccgtaccgttcccgttacccccg

SEQ ID NO: 89025 - DNA, 722 bp, Homo sapiens
  misc_feature: GYAE6OF01AGDF4.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctccccctcctcactttctgcacagtctctgacggccctcctatgagctagacacacgcccaccctggtgtcaggtcgtcccgaggacaacggccaggactcacctgctcgtggatacttcattacgaaccaaaagtattattacgtttggttacgtaccagacgaagaacgtcgacggaccacggtcccttagtacgtacggtactacgtccagtcggacgtacctacgtaccggaacggacctaccggtaccggtactacccgtaggacgtacgtacctttctaccgtccgaccctacgacgcgtacggaacggacgtacggtccgtacccgtacttacgaacgttacggccgggtacggggttaccgggaccggtagggtaaccggtaacggtacgttaacggaacgttctaacggttaaccttacggttacgttaccgggtaaccaccgtaacggtacgtaacgtaggtacgtacggtacgtacgggttacgggtagggttcgacgggtacggtacgtaccgtaggttaccgtaccgttacggtcgaccgcggtaccgcggtcccgtaccggcccgttaccgtaccttccgtccttcccgtcccgtacccg

SEQ ID NO: 89026 - DNA, 641 bp, Homo sapiens
  misc_feature: GYAE6OF01CRY9G.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccaccctggtgtcagtcgtccccaggaacaaacgaccaggactccacctgctcgtggagattcattcgaaccaaaaagtatattacttgttggttccagcagaacgtcaggccacggccccttagtacctggtccacgtccagtgacggccaggtccgacgacaccgtccgggactcccgtgagagtacttctctcgccctccgagctcgaggacagtcggccctacgttgactactcgacggtcggccgaggtcggaacgagtacggaagcgtagtacttacgttagttacgtaccgacaacgacgtacgtaagtacggtcggtacgtagtacgggtaggggttacgtcggggaacgggtacgggtaaccgttaggttaccggtaccggtttccgttacgggtaccgaaccggtacccgaacgggtccctcccggtacccccgttcggtaccctaccgttcccgttacccccg

SEQ ID NO: 89027 - DNA, 635 bp, Homo sapiens
  misc_feature: GYAE6OF01DOD0S.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctcctatgagctgacacagccacccgtcggtgtcagtcgtccccaaggaccaaacggccaggactccacctgcctcgtgggatacttcattcgaaccaaaaagaattatacttggttcggttccagcaagaacgtcaggccacggccctgtactggtcactccatgacggcacggtcgaccgacaccgtccgggactcccgtagacgagtacttcgtctcgccctcagctacgagggacaggcgccctacgttgactatcgagggtcgggacctagggtaggacgtagtaggaacgtcgtacgacttaactagtttacgtaccgcaaccgagtaactaggtagtcggtacgtacgtcgggtagggggttatccggggtacgggtaacgggtaaccgtaacggttcggtacccgttccggttcggtaccaccggacccgaaggtccctcccggccccgttcggtaccctacgttcctcccgttcccctaccccg

SEQ ID NO: 89028 - DNA, 574 bp, Homo sapiens
  misc_feature: GYAE6OF01EOMOX.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatggacggccagtcgacgacaccgtccgggactccccgtagagagtattctctcgccctccgagctcgagggacaggtcggccctacgttgactatcgacggtcggggacccagggtcggacgagtaggaacgctagtacttacttagttcgttacgactacccgagactagtaggtgtactagtcggtaggggtattcgggacggaggaccgtagtcgtacccgttcgttgacgcggacccgaggcctccggcccccgttacgtcctaccgttccgttccccg

SEQ ID NO: 89029 - DNA, 646 bp, Homo sapiens
  misc_feature: GYAE6OF01A1AZI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggactcacctgctctggagattcattcgaccaaaagatatacttgttcggttccagcaagagtcaggccaggcccctgtactggtcatccatgagccagtcgacgacaccgtccgggactcccgtagagacgtacttcctctcgccctcgacgcctcgaggacaggtcgcctacttgactactcgaggtcggggccgagggtcggaacgtagtacggaagtcgtacgtaacttaacttagtttacggtaccgaccaaccgaacgaacgtaacggttaggtacggtacgtacggttacgggtaacgggggttacgttaccggggacgggtaacgggaaccggtaaggttccggtacccgttccggttacgggtaccgaccggtacccgtaaacgggtccgtaccccggtcccccgttaccggtccctaccgttcccgttaccccgg

SEQ ID NO: 89030 - DNA, 725 bp, Homo sapiens
  misc_feature: GYAE6OF01BSH7O.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctcctatgagctgacacagccaccctcggtgtcagtcgtccccaggacaaacggccaggactcacctgctctggagattcattcgaccaaaagaatatacttgtgttccagcaagaagtcaggccacggcccctagtactggtcacgtccagtgacggccagtcggacgaccaccgtccgggacttcccgtagacgacgtacttccgtcgtcgccctccgacgtctaccggaacgggtaccaacggtcgggacccctaccgttacgtaaccgttacgtaccgagggttaccgggggacccgtaggggtacgggaacgtaacggtacggaaacggtccgttacgtaaccgtttaacgttagtttacggttaaccgaccgtaaccgaaggtaaccgaaggttaacggttaccgggactaaggtaccgggttagggggttacgttacggggaccgggtaacgggtaacctacgggttaccggtaccggttccggtttacgggtaccggaccggaacccggtaaacgggcccgttacccggaccccccgggttccggttaccctccgttacccggtttcccccg

SEQ ID NO: 89031 - DNA, 557 bp, Homo sapiens
  misc_feature: GYAE6OF01BTT0K.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggaccaaacggccaggatcacctgctctgganattcattgaccaaaaagatatacttgttggttccagcagaagtcaggccaggccccctgtactggtcatccatgaggccagtcgacgacacgtccgggatccctgagagtattcctctcgccctccgagcctacgagggacaggtcgcctaccgttgactatcgaggtcgggcccgagggtacggacgatgaagctagactatattgtacgcaccagacagtagtgtactagtcgtaggggtagtcgggacggtagggacctaggttcgtaccgttccgttaggaccgcggacccgaaggtcctccggccccccgtggtccctccgttccgtcccg

SEQ ID NO: 89032 - DNA, 891 bp, Homo sapiens
  misc_feature: GYAE6OF01DDR64.21.8.A08.1.454.CMB.1.raw
  modified_base (171)..(171): a, c, t, g, unknown or other
  misc_feature (171)..(171): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctgcacagtctctgagcctctatgagctgacacagcccacctggtntcagtcgtacccaggacaaacggccaggactcgacctgtcctcgtaggagtattacagttacgaaacgtaaaaagtaattaacttaacgttttggttacggttaccaaggtaccgaaaggtaacggtcgaaccggccgacggtacccccgtggtaacgttcggtacctacttaccgagtcggaaccggaccgtaaggtaccggaaccgaacctaccggtacccggggtactaccccggtaggaacgtaacgtacctttccgttaccgtccgtacccgtacccgaggtccccttaacgggaacggggaactacgggtaccgggtaaccccttacggtttacggtaaccgttaacgtaccggtacggggtacccggggtaccccgaagggggttaccggaacggttaacgtaacggaacggtacgttaacgtaacccgtttaacgtttaacggtttaccggttaaccggaccgtaacccgtaagggtaacgttaacgggttaacggttaccgggtaccgtaacggggtttaacgggtaacggggggtttacggtaccggggtaaccggggaaacgggttaccccgttaaacggggttaccggttaaccccggttccggttacggtaacccgggtaccggtaccccgggtaaaccggtccccggttaccccggtaccccccggttacggttaccccgttaccggttaccccgtttacccccgg

SEQ ID NO: 89033 - DNA, 660 bp, Homo sapiens
  misc_feature: GYAE6OF01BCCPM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccgaggaccaaacggcaggatcactgctctggagattcattgaccaaaagatatacttgttggttccagcagagtcaggccagcccctgtctggtcagtccagtggacggccagtcgacgacacgtcccgggatcccgtagacgacgtacttctccgtacgccctccgagtccgtacgaacgggactacggtcgaccctaccgttcgtaactcgtcgtacggtccggggacccgtagggtcgggaacgagtaggaacgcgtacgaaccgttactagtttacgttacgaccaaccgagtaacgtagtaggttgtacgtagtcgggtaggggttagttacggggacgggacgggtaaccgtaacgggttacggtacccggttccggttgggtaccgtaccgggacccgtaaaccgggtcccgttcccggtaccccccggttgggttccccgtaccgttcccccggtttaccccggg

SEQ ID NO: 89034 - DNA, 727 bp, Homo sapiens
  misc_feature: GYAE6OF01DEPHL.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggaacaaacggccaggatcacctgctctgganattcattgaccaaaagatatacttgttggtccagcagaagtcacggccacggcccctgtactggtcactcagtggagccagtccgacgaccaccgtccgggactccctaggaagagtactttcctcgtcgccctccagtccgtacgagggacaggtccggacccaccgtttagacttacgtcgacgggtcggggtacccgagggtacgggacgtagtaggaaacgtcgtacgtaacgttaacttaacgtttacggttaaccgaccgtaaccgtaaggtaacgtaaaggttacgggttacggttacgtaacggttacgggtaacggggggttacggtttaccgggggaacggggtaaccggggtaaccggtaaacgggtttacccggtacccgggtttaccggttaccgggtaacggtacccggaccccggtaaacgggtccccggttaccccggtacccccccggtttccgggtacccctacccgtttcccgtttccccccggg

SEQ ID NO: 89035 - DNA, 766 bp, Homo sapiens
  misc_feature: GYAE6OF01DNIA6.21.8.A08.1.454.CMB.1.raw
  modified_base (129)..(129): a, c, t, g, unknown or other
  misc_feature (129)..(129): n is a, c, g, or t
tcagtcgtcgctcgcacgaccggtgctcgatttagcatactctacagggggctgtgggctcaggaggcagagctctgggaatctcaccatggcctggacccctctcctcgcctccccctctcactttcngcacagtctctgaggcctcctatgagctgacacacgcccacccgtcggtgtcagtcgtccccaggaaccaaacggccaggactccaccgtcgctctagggactacttcattcgaaccaaaagatatcttgttggttccagcagaacgtcgaggccaggcccctgtacctggtcactccatgacggctacggtcgacgacacgtccgggactcccgtagacgtagattcctactcgccctccacgtccgtacggtaacggactacgggtccgtacccgtaccgtttacgtaaccgttacgtaccgtaacggggtcccgggggtaaccccgtaacgggggtacgggtaaacccggaaggttaacgggaaactcgggtttaacgaaccgttttaaacgttacgttttaaacggtttacccggtaaccctaacccgtaaacggtacggtaaacggtttagggtaacccggttagtaacggttcgggtaacgggggtttaacgttccggggtaacgggaacgggtaaccgtaagggtttaccggacccgtttaccggttaggttacccgaacgggaaccccgtaaaggggtccctaccgggtacccccgtccgggttacctccgtttcccggttacccccgg

SEQ ID NO: 89036 - DNA, 705 bp, Homo sapiens
  misc_feature: GYAE6OF01ARG4R.21.8.A08.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagcatactctacagggggtgggctcaggaggcagagctctgggaatctcaccatggcctggacccctctcctgctccccctctcactttctgcacagtctctgaggcctcctatgagctgacacagccaccctcggtgtcagtcgtcccaggacaaacggccaggatcacctgctcgtgganattcattgaccaaaagatatacttgttggttccagcagaagtcaggccaggccctgtactggcatccatgagccagtcgacgacactccgggatcccgtgacgacgtattcctcgtcgcccgttccaaggccttacggaacggggtaccaagggttcggacccctaaccgtttggaaccttagtaccgaggttcgggggacccctaggggtacgggaacgtagtacggaaacgtccgtagtaaccgttacgtaacgtttcggttaaaccgcctaacccgaaggtaacccgaagggttaacggttcggtacgtaacggttacggtaagggggggttactttaccgggggaacgggtaacgggtaacccgttaagggttcggtacccggttacccgttgggtacccgtacggtaccccggaagggtccgtacccggtaccccccgttcggggtaccctacccgttccgtcccgtttcccccgtaaccccccg

SEQ ID NO: 89037 - DNA, 710 bp, Homo sapiens
  misc_feature: GYAE6OF01C9F48.21.8.A08.1.454.CMB.1.raw
  modified_base (129)..(129): a, c, t, g, unknown or other
  misc_feature (129)..(129): n is a, c, g, or t
  modified_base (370)..(370): a, c, t, g, unknown or other
  misc_feature (370)..(370): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgaggcctcctatgagctgacacacgcccacccgtcggtgtcagtcgtccccgaggaaccaaacggccaggactccacctgctcgtggatattcattcgaaccaaaagaatattacttgttcgttccagcagaacgtcgacggccacggccccttagtacctggtcacttccagtcggaggccagtccgacgacctaccgtccgggactcccgtagacgtagtactttccncgtcgtaccctcgacgtcctcggaacgggactacgggttccggacccttacgttggaccttacgtacggacggggtccggggacccgtagggtacggaacgtagtaaggtaagtccgtacgtaacttagttacgttacgttcccaacgaccgtagaactagggtaacggttacggtacttagggtacgggtacgggggtttacgtaccggggacgggtaccggggtaaaccgtacggtttaccgggacccggtttacgttagggttacccgaaccggtacccccgtaacgggtcccgttccccggtacccccttgggtaccctccgttcccggttccccg

SEQ ID NO: 89038 - DNA, 751 bp, Homo sapiens
  misc_feature: GYAE6OF01A8O5E.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtcctttttttgaggcctcctatgagctgacacagccaccctcggtgtcagtcgtccccaggacaaacggccaggactcacctgctcgtggagtattcattacgaccaaaagaatatactttgttggttccagcagagtcgacggccacggcccctgtacgtggtcactccagtgacgcgacgtacgacgacacgtccgggactcccgtagagagtattctctcgacactaccacgctcgacgggacacggtcggaccctaccgttgtacctagtcgagggtccgggggaccctagggggtacggaacgtagtacggaaacgtcgttaacggtaaccgttaaccgtttagtttaacggttaacccggaccgtaacccgaaggtaccgttaaacggggttagggttacgggttacccgtaagggtttaccgggggtaaacggggggggttttacgttacccggggggaccgggggttaaaccggggtaacccggtaaagggtttcccgggtaaccccggtttacccgggtttacgggacccgtaacccgggtaccccgaacggggttccccgtccccggtacccccccggtttccgggtaccttaccccggttccccgg

SEQ ID NO: 89039 - DNA, 714 bp, Homo sapiens
  misc_feature: GYAE6OF01BYSFU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctacctccccctcctcactttctgcacagtctctggacggcctctatgagctgacacacgcccacccgtggtgtcaggtccgtacccgaaggaaccaaaccggcaaggactccaccgtgctcgtaggatattactagtacgaaccaaaaagtacttattacgtttggttacgttaccagtaccgaaggtaacgtccgacgggaccaccggtacccctaggttacgtcggtacactaccgagtacggacggacctacggtaccgaaccggacctaccggtaccgggactacccgtagaagtacttcttaccgtcgtaccgtaccctacgacgtaccgtacggaacggggtacacgggttcgaccccttaacgttcgaacgttacgcggtacgggtccggggtaccgagggtacggacgaggtacgaacgtcgtacgtacgttaacgttagtacgtaccgacgtaaccgagtaacgtaggtacggtgtacgtacgtacgggtagggtacggtacgggacggacggtaacggtagtaccgtacggtcgtcggaccgacggccggtacgtccgtcccgtacccgtcgttacctcttcccgtccgtacccccg

SEQ ID NO: 89040 - DNA, 742 bp, Homo sapiens
  misc_feature: GYAE6OF01EARNI.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagccacctcggtgtcagtcgtcccaggacaacggccaggactcacctgctcgtggatnttcattcgaacaaaagattatacttgttcggtccagacagaacgtcgacgccacggcccctgtacgtcggtcactccatcggacgcctagtaccgacgactaccgtaccgggtacttcccgagagacgtacgttctccgtcgtccctccgagcgtacggacgggacctaggtccggaccctacgtttcgaacgttaacgtccggacgggttccgggacccgtagggtaccggtaacgtagtacggaagtccgtacgtaacgtttaacgttagtttacgtaaccgtaccgtaaccgacgtaacggtaacggtttacgggttacgtaccgtaaggttacggggttagggggttaacgttccgggggaaccggaaggggttaaacccgttaacgggttcccgggttaaccccggtttacggttaccggggttacccgaaccgggtaaccccggtaacgggtccccgttccccggtaccccccgggttaggtttaaccccgtaccgttcccgtttaccccccggg

SEQ ID NO: 89041 - DNA, 634 bp, Homo sapiens
  misc_feature: GYAE6OF01B5QN2.21.8.A08.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcacctgctctggagtattcattgaccaaaagaatattacttgttggttccagtacagaagtcaggccaggcccctgtactggcatccatgagccagtcacgacactcgggatccctganacgtattctctcgcctaccgagctaccgagggacctaggtcgccctacttggaacctatcgaggtcggggcccagggttcggacgagtacgaagctagtacttaactagtttacgttaacgccaacgaacgtagaacggttaggtacggtactaaggttacggtaaggggggttacttcggggacgggtaacggggtaacctaagggtttacggacccggtttccgttagggtacctaaccggaccccgtaaagggccccttacggacccccccggttaggtcccgtaacccgttccggtttaacccccg

SEQ ID NO: 89042 - DNA, 769 bp, Homo sapiens
  misc_feature: GYAE6OF01DTJTH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgacacagcccaccctcggtgtcagtcgtccccaggacaaacggccaggactcacctgctctggagtattcattcgaccaaaagtaattattacttgttcggttccagcaagaagtcaggccaggcccctgtactggtcatccagtggacgccgagtccgacgacacgtccggatccctagagagtacttcgtctcgccctcacgtcgtacggacggacacggtcggaccctaccgttacgaacgttacgtccgtagggtccggggacccgtaggggtacgggaccggtaagttacggaaacgtccgttacgtaacctttaacgttaacgtttacggtttaacccgacctaaccggtaacggtaaccgtaagggtttacgggttacggtttacccgtaacggtttaccgggggtaacggggggttttaaccggtttccgggggaaaccggggtaaccgggggtaaacccgttaaacggggttccggtaaaccccgggtttccggtttacgggtaccggacccgggtacccccggtaaacgggtcccccgtttacccgggtacccccccgtttaccgggttaacccctcccgtttccccggtttacccccccgg

SEQ ID NO: 89043 - DNA, 685 bp, Homo sapiens
  misc_feature: GYAE6OF01BNNNE.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtntcagtcgtcccaggaaccaaacggccaggatccacctgctcgtaggatattcattcgaaccaaaaagtatatacgttgttggttccagcaagagtcgaggccacggtcccctgtacgtcgtacacgtccagtggacgaccgacgtaccgaccgacctacggtaccggtactcccgtaggacgagtacttctcgtcgccctacgacgtcgtacggaacggactacgggtccgacctaccgttacgaacttacgtaccggtacgggtccgggaccccggtagggtaccgggtaacgtagtacggaacggtacgtacgtaaccgttaacgttacgtttacgtaccgtaaccgaaccgaacgtacgtaacggttacggttacggtacgtacgttacgggtaaggggtcgtaccgggacggtaacgggtaccgtaggttaccgtaccggttccgttacggccgacgacccgacgtcccgtacccgccccgtgtacctccgtccgttaccccg

SEQ ID NO: 89044 - DNA, 648 bp, Homo sapiens
  misc_feature: GYAE6OF01DUTLA.21.8.A08.1.454.CMB.1.raw
  modified_base (134)..(134): a, c, t, g, unknown or other
  misc_feature (134)..(134): n is a, c, g, or t
  modified_base (175)..(175): a, c, t, g, unknown or other
  misc_feature (175)..(175): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (517)..(517): a, c, t, g, unknown or other
  misc_feature (517)..(517): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacgntctctgacgcctctatgagctgacacacgccacccgtggtntcagtcgcccgaaggaccaaacggcctaggatccactgctnggatntcatcgaacaaagattntacgttgtgtccagcgagaagtcgacgccacggtcccctagtacctggtactactaccgatcgacggcacggtaccgaacggactaccgtaccgggtatcccgtaggacgagtactttccgcgtcgccctaccgaactcgtacgaaggtacacggtacggacctaccgtgaacgtacgtcgaacgggttccggggacctagggtaccggaagtagtacgaacgcgtagacttacgttacgtacgttacgacctaacgagtaccgaagttacggaccgtntaacgaccgggtaggggtactacggttcggggacgggtaacgggtaccgtaaaggttccggtaccggtacgtacggtaccgacggtacccgacggtcctaccgacccccggttctccgtaacgttccccgg

SEQ ID NO: 89045 - DNA, 678 bp, Homo sapiens
  misc_feature: GYAE6OF01EN2CN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacgacgcccacccgtcggtgtcagtccgtccccgaaggaaccaaacggccaggactccacctgcctcgtggagtacttcattcgaacaaaagtattattacgtttgttcggttccagcaagaacgtcaggccaggtcccctagtacgtggtcactccagtcggacggccaggtccgaacgaccaccggtccgggtactacccgtagaacgtacgttacttcgtcttccgccctacgacgccgtacggaacgggtactacgggtcgaccctttaaccgtagaaccttacgtccgaacggggttcccgggaccgtagggtacggaacgtataggaacgtctagtaccttacgttgttacgtacgacctaacgacgtaacgtacgtaggtcgtaacgtaggttcgggtaagggttaccgtcggggacgggtaacggaccgttaaggtaccgaccgtttcggtggacccacggacctagggccctcccggcccgttcggtccctaccgttccgttccccgg

SEQ ID NO: 89046 - DNA, 633 bp, Homo sapiens
  misc_feature: GYAE6OF01DT8WM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattcgaccaaaagatatacttgttggttccagcgagaagtcgacggccacggcccctgtactggtcatccatggaggccgacgtcgacgacgacgtccgggactcccgtagacgtagtactttctcgtcgcccttccacgtccgtacggacgggactaggtcggaccctaccgttgaacttgtaccgagggtccggggtacccagggtcggaacgtagtaggaacgtcgtacgtacttaacgttagtttcgttaccgacgaccaagtacaggttacggtgtacgagttcggagggggttaagtcggggacgggtacggtacgtaacgttcggtacccggttcgttaggccgacggacccgaaggtcccgtccggtacccccgttggtaccctccgttccgttccccgg

SEQ ID NO: 89047 - DNA, 635 bp, Homo sapiens
  misc_feature: GYAE6OF01BZYHE.21.8.A08.1.454.CMB.1.raw
  modified_base (558)..(558): a, c, t, g, unknown or other
  misc_feature (558)..(558): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgcttcttttaagaggtgtccagtgtcaggcgcaactgggtggagtcgtggggggagcagtggtccagccgtggggaggttcccctggacgccctctcctgtgcagcgtctggattcagtactcggcttcctttgcctatgcctacgtcggggtcccgccgaggtcctccgagggccgaagggggctgggaggttggggtggacgtaacgtttagtcgttgggtatggaagtggggaagttgaggaagtaattagttacgttcgagtaccgttccggtagggaacggggtccctacttcaaccctgtccctacccgagaagaactaagtcgaacccaaacaacacctacgttactattccttaacaacgttaccgaccggtctagacgacgaccggaggaccncggtactagtagttacgttacgtagtacggtgttcgttggtcgtagggtcgggaccgacgggtacccgtggtacccg

SEQ ID NO: 89048 - DNA, 787 bp, Homo sapiens
  misc_feature: GYAE6OF01E27NS.21.8.A08.1.454.CMB.1.raw
tcagtcgtcgctcgcacgaccggtgctcgatttagcatactctacgagggggggagaggagcccagcactagaagtcggcggtgtttccattcggtgatcagcactgaacacagaggactcaccatggagtttgggctgagcttgggttttcctccttgcttcttttaagaggtgtccagtgtcaggcgcaacgtggtggagtcgtgggggaggcagtcggtccagccgtggggacggtccctgacgtcctctccgtgtcgcacgcgtcgtggattcagttactcggtccttccgttgccagtcgctacgtcgggtcccgccgagcctaccgaggcgaaggggcgtagggaggtgggtggacgtagtttacgtcgttaggtatggagtagggaaggtggaaaggtagttaacgttattttaacgtaccgaacggtaccgttaccgggtagggaacggggtacccgtaagtttacccgaaccctaacgttaccccgtaaccgaaacggaacgaaccgtaaactccgaaaccccaaaaccgtaaacccaacccgttaacgttacgtttaaccttaccgtttaaacgaaacgttaccgggaaccccggtaccttaagggaaccggaccgggaacccgggaacgggaacccgtacgggtaccttaaacggttacgtttaaaccgtttaccggtaggttaacccggttagtttccggttttacgggtacgttaaccggggttaccgggggaaccccgtaaacccgggggttaccccgttcgggttacccccg

SEQ ID NO: 89049 - DNA, 772 bp, Homo sapiens
  misc_feature: GYAE6OF01CTEWE.21.8.A08.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctctactttctgcacagtctctgacgcctctagtgagctagacacacgcccacccgtggtntcagtccgacccgaaggaaccgaaacggccaaggactaccgacgtgcctgtaggatattacgagtacgaacaaaagtattacttacgttgttcggtaccagacaagtaagtcgacggccgacggtacccctaggtacgtggtactactaccagtacggacgacgacggtacgaaccgtaccaaccggtccgggaccttacccgaggaacgtacgttactttccgaccgtcggtaccctaccgacggtccttaccggaaggtacgtacggtccggtaacctaccgttagactaacggtcggaacggggtccgggaccggtaagggtacgggaaacgtacgtaaggaaccggtagttacggaaacctttaacggttagtttaccgggtaacaaccgaacggtaagtaacggttaaggtaggtttccggaagtaacggttacggggtacggggttacggtacgggaacgggtaaccggtaacgttaacgggtaccggtaccggtttaccggtacggaaccgtaacccggtaacccggacgggttccctcccccggtacccgttacgggacccttcccgtttcccgtacccccg

SEQ ID NO: 89050 - DNA, 724 bp, Homo sapiens
  misc_feature: GYAE6OF01EKNHH.21.8.A08.1.454.CMB.1.raw
tcagtcgtcgctcgcacgaccggtgctcgatttagcatactctacagggggctgtgggctcaggaggcagagctctgggaatctcaccatggcctcggaccctctcctgcctccccctcctcactttctgcacagtctctgacggcctcctatgagctgacacacgcccacccgtcggtcgtcagtccgtaccccgaaggaaccaacggccaaggactccacctgctcgtaggtacgtacttactattacgaacctaaaagtaattacttacgttggttcggttaccagactaagaacgtcgacggaccgtacggacccttaggtacgtcggtactacgtaccagtcggacggacgacgtacgacgacctacggtccgggactccgtaggacgtacgtacttctaccgtcgcctaccgagtccgtacggacggtacgtcggtaccggtacctacgttacgtaacgttacgtcgggtacgggtaccgggacggtacgggtacggacgtagtacgacgtaccgttagtaaccgttagttacgtttacggtaccgaccgtaacgacgtacggtacggttagtacggtagtacggttacgggttaacgggtcggtaccgggtacgggtaaccgtaacggttacggttaccggtacccggttcgtacggccgacggacccgtacggtcccgtcccgttacccgtccgtacctccgttcccgtcccccgg

SEQ ID NO: 89051 - DNA, 841 bp, Homo sapiens
  misc_feature: GYAE6OF01DKXHP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccctcctatgagctgacacagcccacccgtcggtgtcagtcgtccccaggacaaacggccaggactcacctgctcgtggagtacttcattacgaaccaaaaagtaattattaaccgtttggtttcggttacccaagccgaaggtaacgttccgaccggaccgtaccgggtcccccttaggtaccgtaggtacctaactttcccgaaagttcgggaacggcccgtaaggtcccgaaccgtaaccctaccggtacccggggtacttaccccgtagaacggtacgtactttcccgtaccgttcgaccccttacggacgtccgtaccggaacgggaactacgggtccggtacccgtaccgtttacgaaccgttaacgtaccggtacggggttaccggggaccccggttaaggggtacgggtaacccggtaagttacgggtaaaccgtccgttacggtaacgtttaaccgttagtttaccggttaaccgacctaacccggtaacggtacggtaacggttaggttacggtacgtaacggttcggggtaacggggtttacgtacgggggaccgggtaaccgggtaaccgttaacgggttaccggacccggtttccggtacgggttacgtacccggtaccccggaggttccccggtacccggtcccccggttacggtacccgttcccgttcccgttaccccccgg

SEQ ID NO: 89052 - DNA, 794 bp, Homo sapiens
  misc_feature: GYAE6OF01EWFNS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatcacctgctctggagattcattcgaccaaaagtaatatacttgttggtccagcagaatcgaggccacggcccctgtactggtcatccagtgacggccaggtcgacgacacgtccgggactcccgtaggacgagtacttctctcgccctccgacgcctacggacggactacgggtcgaccctaccgttgaaccgttacgtacgacgggttccggggacccgtagggttacgggaacgtagttacggaacggtccgttagtaaccgttaacgttacgttttacggtaacccgtaccgtaacccgtaggtaaccgtaagggttaacggttaccgggtaacgttaacggttacgggggtaacggggggtttaacggtttacccgggggcgggggtaaaccggggtaacccgggttaaagggtttacccggggttaacccccgggttttcccgggttttaacgggggttaaccccgtaaaccccggggttacccccgggtaaaccgggttcccccggttaccccggggttaccccccccggtttaccggggttaccccgttaaccccggtttccccggtttacccccccggg

SEQ ID NO: 89053 - DNA, 639 bp, Homo sapiens
  misc_feature: GYAE6OF01A2KPH.21.8.A08.1.454.CMB.1.raw
  modified_base (218)..(218): a, c, t, g, unknown or other
  misc_feature (218)..(218): n is a, c, g, or t
  modified_base (343)..(343): a, c, t, g, unknown or other
  misc_feature (343)..(343): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccagacaaacggcaggatcacctgctcgtgganattcattcgaccaaaagtatattacgttgttgttcagcagaagtcaggccgagcccctgtactggtcatcagtgaggccagtccgacgacaccgtccggactccctagagactacttactcgtcnccctccagcctacggacgggactacggtcggccctaaccgttgtaacctagtccgtagggtccgggacccgtaggtcggaacgagtacgaacgtcgtagtaccttaacgttacgttacgtaccgaccgaccgtaagaacgtagttaggtacggtacacggttacgggtagggggtacgttaccggggacggtaacgggaacgttacgggttcggtaccccgttcggttacggccgtacggacccgtaggtcccgtacccggtccccgtccggttcctacgttcccgtttaccccgg

SEQ ID NO: 89054 - DNA, 626 bp, Homo sapiens
  misc_feature: GYAE6OF01CA5E7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaacggccaggactcacctgctcgtggagattcattcgaccaaaagatatacttggttagttccagcgagaagtcaggccagcccctgtactggtcataccagtcggacgccgagtcgaccgacacgtccgggactcccgtagagacgtattcgctcgccctccagtcctcggaggtaccgagtgtcccaaccttcgtaccttatcgtacgggtcggggacccgtagggtcgggaacgaggtaggaaacgtcctacgacttacttagtttcgttaccgaccacgaagacgtagtagggtacgtcgtacgtacgggtagggttacggtcggacgggacggtaacgtaggttacggtcccggtccggttaggtaccgaccggaccccgtaaggtcccgtccggcccccggttacgtccctaaccgtccgttacccccg

SEQ ID NO: 89055 - DNA, 706 bp, Homo sapiens
  misc_feature: GYAE6OF01ATF0B.21.8.A08.1.454.CMB.1.raw
  modified_base (178)..(178): a, c, t, g, unknown or other
  misc_feature (178)..(178): n is a, c, g, or t
  modified_base (220)..(220): a, c, t, g, unknown or other
  misc_feature (220)..(220): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccctcctatgagctgacacagcccacccgtggtntcagtcgtccccaggacaaacggccaggatccacctgctcgnggatattcattcgaccaaaagtatattacttgttcggtcagcagagtcacggccacggtcccctagtaccgtggtacactccagtcgacggccagtccgacgacaccgtccggacttccgngaagntacttctcgtcgccctaccgagtcctacgaacgggctacggtccggaccttaccgttagacgtactcggacgggtcgggaccgtagggtacgggaacgtagtacggaacgtaccgttacgtaaccttacgttacgttttacggttaccaccgtaacgaacgtacgtaaggttaggtacggtacgacggttacgggaacgggggtttacgtaccgggaacggggtaacggtaaccggttaagggttacccggttacccggtttaccggttacggtacccgtacccggaccgtaaccggtcccggttacccccgtaccccccggttacgttacccccgtacccgtttccccggttacccccg

SEQ ID NO: 89056 - DNA, 678 bp, Homo sapiens
  misc_feature: GYAE6OF01AHFWM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggactccacctgctcgtggagtattcattagaccaaaagtattattactttggtttggttacccagcagtaagtcgacggccacggcccctgtacgtgtcatccagtgacgccgagtcgacgaccacgtccgggactcccgtgacgtacgtacttcctcgtcgtccctaccgagtcctacggacgggacctagggtccgtacccctaccgttacgaccgttacgtcggtacgggtccggggacccgtaggggtcggaacgtagtacggaacgtcgtacgtacttacgttacgttacgtaccgacaaccgagtaccgtaggttacgtcgtacgtacgtacgggtaggggttaccgtacggggacgggtacgggaccgttaaggttccggtaccggtttccgttgggaccgtaccggacccgtaacggtcccgttcccggtacccccgttcggtaccctccgttccgttacccccg

SEQ ID NO: 89057 - DNA, 732 bp, Homo sapiens
  misc_feature: GYAE6OF01DZV6O.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccgaggacaaaccggccaggactccacctgctcgtggatattcattcgaacaaaaagtattacttacgttggttcggttccaagacaaggaacgtcacggccacggtcccctgtactggtacatccagtcggacggccaggccgaacgaccgtaccgtccgggaactcccgtaggaacgacgtactttccgtccgtccgcccttaccgacggtcccgtaacggacggggacctacgggtccggtaccctacggtttacgaacttcgtacgtacgggtcgggacccgtagggtacggacgtagtaacggatccgtagtaccttaagttcgtttacgtaccgctaaccgtaagtacgtaaggtttacggtcgggtacgtacggtacgggttaaggggttacggtaccgggggacggtaaacgggtaccgttaacgggttcgttacccggttaccggtttgggacccgtaacggtaccccggtaacgggccccgtttaccccggaccccccggttaccggtaccgttacccgttcccgttcccccgg

SEQ ID NO: 89058 - DNA, 675 bp, Homo sapiens
  misc_feature: GYAE6OF01DIRLX.21.8.A08.1.454.CMB.1.raw
  modified_base (376)..(376): a, c, t, g, unknown or other
  misc_feature (376)..(376): n is a, c, g, or t
  modified_base (481)..(481): a, c, t, g, unknown or other
  misc_feature (481)..(481): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagccaccctggtgtcagtcgtccccaggacaaacggccaggactcactgctctggatattcattcgaactaaaagatatacgttgttcggtccagcaagaagtcacggccacggcccctgtacgtgtcatccagtcgacggcagtcgacgaccaccgtccggaattcccgtaggacgagtacttcgtctcgccctacgatccgtacggaggtacnggtcgacctacgtttcgacttagacgtacgggtccgggaccgtagggtcggaacgtagtaggaacgcgttagaacttacttagtttcgtaaccgtaccaccgtanaacgtaaggttacggtcgtacgtacgttaggggtaggggttacgtcgggggaacggtacgggtaaccgtaacgggtttccggtaacccggtttccgggtttaggacccgtaaccgggtacccggtaacccgggtcccgttccccggtacccccggttacgggttaacccctacccgttccccgtttacccccgg

SEQ ID NO: 89059 - DNA, 851 bp, Homo sapiens
  misc_feature: GYAE6OF01DU247.21.8.A08.1.454.CMB.1.raw
  modified_base (259)..(259): a, c, t, g, unknown or other
  misc_feature (259)..(259): n is a, c, g, or t
tcagtcgtcgctcgcacgaccggtgctcgatttagcatactctacaggggggtgggctcaggaggcagagctctgggaatctcaccatggcctggacccctcctcctgcctccccctcctctactttctgcacagtctctgacggcctctatgagctaggacacacgccctacccgtcggtcgttcgacgttccggtacccccgaagggaaccgaaaaccgggccgaacgggacttacccgaccgtgcctcgtaggaanatttctagttacgaaaccaaaagtaattacttacgtttggtttcgtaccgacgacgaaggtagtaccgacggccgtaccggtccctaggtacgttcggtacctacgtacccgtagtacggaccggaccgtaccggtaccgaccggaccgtaccggtaccgggtacctacccgttaggacggtaacgtactttccgtccggtcctcccgtccgaacggtaccgtacgggtaacggacggtaacggttccgtaccccgtagtaccggtaacttacggttaccgggtaacggggttccgggaacccggtagggggtaaccgtaacggtaacggttaacggaacggttacgtaaccggtttacgttaaccgtttaacgttaccggtaacgtacccgaaccgtacgggtaacgtacggtagggttaccgtacggtaacgtacggggttaagggttaccgggtacggggaacggaacgggtaccggtaaggttccggtaccgtccggttagggtccgtacccgacggtaccgggtccgtaccccggttccccggtaccgtcccgttacccgttcccggtccccgttccccgtaccccg

SEQ ID NO: 89060 - DNA, 605 bp, Homo sapiens
  misc_feature: GYAE6OF01D2XUP.21.8.A08.1.454.CMB.1.raw
  modified_base (337)..(337): a, c, t, g, unknown or other
  misc_feature (337)..(337): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctcgtggagattcattgaccaaaagatatacttgttggttccagcagaagtcaggccagcccctgtactggtcatccagtcgaggccagtcgacgactacgtccgggatccctgagacgacttcncgtcgtcctccgagcctcgagggactacggtcggacccctacgttagaaccttattaccgagggttccggggaccccgtaggggtacgggaacgtaggtagaacgcgtacgacttacgttagttacgttaccgcaaccgagacgagtagtggtactagtacgggaggggttagttacgggacggacgggtaccaggttacggacccgttcgttcggtccacggacccgtaggccgtccggaccccgttccggtcctccgttcgtcccg

SEQ ID NO: 89061 - DNA, 721 bp, Homo sapiens
  misc_feature: GYAE6OF01BJ6LL.21.8.A08.1.454.CMB.1.raw
  modified_base (701)..(701): a, c, t, g, unknown or other
  misc_feature (701)..(701): n is a, c, g, or t
  modified_base (707)..(707): a, c, t, g, unknown or other
  misc_feature (707)..(707): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgcctcgagatctactagtacgaacaaagtatacttacgttggttacgtcgacgacgaagtacgtacgacggaccgtacccgtcccgtacgttacgtcggtactacctacctagtacgggaccgaccgtacggtaccgaacgaccgtacccggtaccggtacccttaccgtagggaagacgttccgttaccgtcgtcccgtcccgtaccgtacgtccggtacggaacggtacgtacgggtccgaaccccgttaccgttacgtaccttacgtacgggtaggggtaccccgggaaccggtgggtaacgggacgtaggtaacggacgtccgtaacgtaacctttacgttaggtttacccgtaacgacctaacggtaacgtagttacggttaggttcgatacggtacggggttaagggtcgtacggggacggtaacggacgtttaggaccgtccgttcggtgacgaccgaccgaggtccctcccggacccgttancccgtnttccgttacccccg

SEQ ID NO: 89062 - DNA, 787 bp, Homo sapiens
  misc_feature: GYAE6OF01DM1KP.21.8.A08.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagcatactctacagggggctgtgggctcaggaggcagagctctgggaatctcaccatggcctcggacccctctcctcgccctccccctcctcactttctgcacagtctctgaggcctcctatgagctagacacacgccctacccgtggtntactagtcgtccccgaaggaaccgaaaccggccgaaggactccacctcgctacgtggagtacttactagttacgaacctaaaaagtaacttacttacgtttggtttacggttaccgagactaaggtaacgtccgacggccgaccggtccccttgtacgtggtacatccgagtcggacggccgacggtacgaccgtaccaccggtccgggactccgagacgtagtcttcctcgtccgtccctaccacgtcctacggacgggtactacggggtccgacccgttaacccgttaggaccttacggtaccggacggggtcccggggtacccgtaagggtaccggaacgtacgtaacgggaacgttcgtacgtaactttaaccgttacgtttacggtaccgtaccgaacgtaggtacgttaagttacggtacgttaccggagtaccgggtaaggggttacggtaccggggtacggggtaaccggaccgttaagggttacccggtacccggtttaccggttacggttacccggcccggtaacccgtacggtcccccgttccccggtacccccggttccgtaccccgttccggttccccgtttccccccggg

SEQ ID NO: 89063 - DNA, 668 bp, Homo sapiens
  misc_feature: GYAE6OF01D7CS9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcactgctctggatatcatcgaccaaagatatacttgttggtcagcagagtcagccaggccctgtactggtcatccatggacgcagtccgacgacacgtccggtactcccgtagagtagtacgttctcgtcgtccctcgacgtcgtacgacgggtacacggtcggaccctaaccgttggaaccttagtacgtacgggtcggggtacccgaggggtacggaagtaagagaacgtcgtacgtaacgtacgtttaagttagttacccggctaaccgagtaacgtaagttacggtacggttacgtaacgttacgggtaacgggggttacgttaccggggacgggtaacggggtaaccgtaaacggttcggtaacccgggtttcgttacgggtccgtacccggtaacccggtacggtacccgttcccggtaccccccgttacgtacccgtaccgtcccgtttaccccg

SEQ ID NO: 89064 - DNA, 624 bp, Homo sapiens
  misc_feature: GYAE6OF01DLG2H.21.8.A08.1.454.CMB.1.raw
  modified_base (219)..(219): a, c, t, g, unknown or other
  misc_feature (219)..(219): n is a, c, g, or t
  modified_base (359)..(359): a, c, t, g, unknown or other
  misc_feature (359)..(359): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagaatatacttgttggttccagcagaagtcaggccaggcccctgtactggtcatccatgaggccagtcgacgacacgtccgggatcccgtgacgagactttctctcgccctccagctcgagggacnggtcggcctacttgactagtcgaggtcggggacccagggtcggaacgtagtacgaagtcgtacgtacttacgttagttacgttaccgacctaaccgagaacgtagtaggttggtactacgtcggtaagggggttacgttccggggacgggtaacgggtaccgtaacgggttccggacccggtttccgttagggtccgaacggacccgtacgggcccgttcccggtaccccccgttcgggtaccctaccgttccgttacccccggg

SEQ ID NO: 89065 - DNA, 688 bp, Homo sapiens
  misc_feature: GYAE6OF01BG7T4.21.8.A08.1.454.CMB.1.raw
  modified_base (462)..(462): a, c, t, g, unknown or other
  misc_feature (462)..(462): n is a, c, g, or t
  modified_base (543)..(543): a, c, t, g, unknown or other
  misc_feature (543)..(543): n is a, c, g, or t
tcagtcgtcgctcgcacgaccggtgctcgatttagcatactctacagggggctgtgggctcaggaggcagagctctggggaatctcaccatggcctggacccctctcctgcctccccctcctcactttctgcacagtctctgaggcctctatgagctgaccacacgcccaccctcggtgtccgaggttccgaccccgaggaaccaaaccggccaaggactccacctggctcgaggatacttcattacgaacaaaagtattatacttggttcggtaccagtacagaacgtcgacggtccacggtcccctaggtacgtggtactactccagtcggaacgtccgtacgtaccgaaccgaccgtacgtccccggggatcccggtaggagtacgtactttccgctacgtccctcgaagtcgtacgaagggactacggtccgaccttaccgttagaaccgtttaccgnggtaccgggccgggggtaccgtagggtaccggtacgtaagtacggaacgtcctagtaacccgttatacgttacgtaccganaccgaagacgtaaggtacgtggactacggtaggtaggggttacgtacgggacggtacggaaccgttaggtcccgtacgttaccggtcggacgaccgaccgacggccgttcccgtaccccgtacgtccgtcctccggttaccccgg

SEQ ID NO: 89066 - DNA, 715 bp, Homo sapiens
  misc_feature: GYAE6OF01EW3JQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacgcctctatgagctgacacacgcccacccgtcggtgtcagtcgtccccgaaggaaccaaaccggccaaggactccaccgtgactcgtaggacgtattcaagttcgaaccaaaaagtattacgttacgtttggttacggtaccagtacgtaaggaacgtcgacggccacggtccccgtgtacgtggtaccacgtaccgagtggacggtccaggtaccgacgaccacgtcgggactccggtagacgtagtacttccacgtctcccctacgacgtcgtaccggacgggtactcgggtcccggacccttacgtacgttaacgtacgtacggtacgggtcgggacccgttagggaccggaacgtaggtacggaacgtcgttacgtaacctttaagttagttaccggttaaccgacctacgacgtaacgtgggttaacggtcgtacgtacggtacggggtaggggttaccgtcggggacgggtaagaccgttaacggttcgtacccggttcgttacggccgacggtacccggacgtcccgtccccggtacccgtacggtccttacccgtccgttccccg

SEQ ID NO: 89067 - DNA, 626 bp, Homo sapiens
  misc_feature: GYAE6OF01BF3CQ.21.8.A08.1.454.CMB.1.raw
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacaggctctgaggcctcctatgagctgacacagcccaccctcggtgtcagtcgtccccaggacaggacggccaggatcacctgctntgcagatggactgaccaaaagaatatgtacttattggtaaccaagagaanccaggaccacggcccctgtgttagtgatataataaagacactgagacggccctagagaacgatcccgtagacgtcgacttcgtcgttcggccttaccgacgtccgttacgaacggggaactacggacgtacgtcgtaacggttacggaacttactacgaagtacgaacgtaccagggtacgaaggtacgggaacgaggtactagtaacgttattacgtagtaacaaacgagtaacgtacgaagttaggacgtactagtagttgggtacggttacgggagggtacggaaaccgaggtccgtaggtaccccgttaccggtacgggtaccgaacccgaccggtaacgtcccggttacccccg

SEQ ID NO: 89068 - DNA, 745 bp, Homo sapiens
  misc_feature: GYAE6OF01B7QCG.21.8.A08.1.454.CMB.1.raw
  modified_base (333)..(333): a, c, t, g, unknown or other
  misc_feature (333)..(333): n is a, c, g, or t
  modified_base (388)..(388): a, c, t, g, unknown or other
  misc_feature (388)..(388): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtcccaggacaaacggcaggatcacctgctctggagattcattgaccaaaagatatacttgttgttccagcagaagtcaggccaggcccctgtactggtcatccatgagccagtcgacgacacgtccgggatcccgtagagagtactttccnctgccctccgagtctacgaagggacctaggtcggaccctaaccgtttgaaccttntcgtacgggtcggggccccgtagggtacggaacgaagtacggaaacgtccgtaaggtaacccttaacgttaacgtttacggttaacccgtaccgaacccgtaaagaaccgtaaggtaacgggttacggtaccgtaaaggttacccgggtaagggggggtttaaccgtttaccggggggaaccgggtaacggggggtaaacccccgtaaaaggggttttaccggtaacccccgggtttcccggttttaggggtaacccggttaaccggaacccccccggtaaaaggggttcccctacccgggtacccccccccgtttacgggggttccccttaaacccgtttcccgtttcccccgggg

SEQ ID NO: 89069 - DNA, 722 bp, Homo sapiens
  misc_feature: GYAE6OF01DETM2.21.8.A08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagcatactctacagggggctgtgggctcaggaggcagagctctgggaatctcaccatggcctcggacccctctcctgcctcccccctcctctactttctgcacagtctctgacggcctcctatgagctgacacacgccaccctggtntcagtcgtccccgaggaaccaacggccaggactcacctgcctcgtaggactattcagttacgaaccaaaagtattacgttactttggtttacggttaccaagaccgtaagaacgtcgaacggcctacggcccccttagtacgtcggtacactaccgagtcggacggcctaaggtcgacgacgaccgtccgggactcccggtagacgtacgtacttccgtactcgtccctaccagtcctacggaacgggactacgggtacgtcccctaacgttcgtactacgttacggacggggtccgggacccggagggtcggaaccggtatacggtaacgtaccggtacgtaacttaccgttacgtttacgttacccgactaaccgagtaacgtaggttacgtaggtactagtacgggtaacggggttcggtacgggacgggtaacgggtaccgtaaacggttcggtaacccgtttcggttagggaccggtccgaacccggtaacggtcccgttacccgtccccgtaccggtctaccccgtcgttaccccg

SEQ ID NO: 89070 - DNA, 821 bp, Homo sapiens
  misc_feature: GYAE6OF01DZD34.21.8.A08.1.454.CMB.1.raw
  modified_base (125)..(125): a, c, t, g, unknown or other
  misc_feature (125)..(125): n is a, c, g, or t
tcagtcgtcgctcgcacgaccggtgctcgatttagcatactctacagggggtgggctcaggaggcagagctctgggaatctcaccatggcctggacccctctcctgcctccccctctcactttcngcacagtctctgacggcctcctatgagctgacacacgcccacccgtggtgtcagtccgtccccaaggaccaaaccggtccaggactccactgcctcgtggactattcattacgaaccaaaagtattactacgtttgttacggtaccagtacgaagtaacgtcacggccgacggtccctgtacgtggtaccatccagtacggacggacctacggtaccgaaccgaccgtaccggtacccgggtacttcccgaggaacgtacgtacttcttaccgtccggccccttaccgaacggtccgtaaccggacgggtaaccgtacggtaccggtacccctaccgtttagacccgttacgtacggtaacggggtccgggtacccgaaggggttaccggaaggtacgtaggtaaacgtaccgttacggtaaacctttcgtttaacggtttaccggtaaccgacctaaacccgggtgttaaacgtacggttaacgggtccgtaacggtaacggtaccgggggttaacggggttacggtaccgggggtaccgggtaacgggtaaccggttaacggttaccgggtacccgtttcgggttaacccgggtaccgaacccgggtacccggtacgggtccccgttaccccggaccccgtttccgggtaccctacccggtttcccttccccgggtacccccctttacccccgg

SEQ ID NO: 89071 - DNA, 681 bp, Homo sapiens
  misc_feature: GYAE6OF01A9FHV.21.8.A08.1.454.CMB.1.raw
  modified_base (516)..(516): a, c, t, g, unknown or other
  misc_feature (516)..(516): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacacgcccaccctcggtgtcagtcgtccccgaggaaccaaaccggccaggactcacctgctcgtggatattcattcgaaccaaaaagtaattattacttggttcgttaccagcaagatcgagccgacgccctgtactggtacactcactggacgccgtagtcgaccgacgaccgtccgggactcccgtagacgacgtacgttactcgtacgccctacgtacgccgtacggaacgggaccgtacggtaccgtaccctaaccgttacgaacgttaacgttcgaccgggggttacccggaccggtaagggttacggacgtaagtaggacgtcgtaacgtactttacgttagtttcgtacncgtagaccgagtaccgagtcgaggttcgtactacggtacgggagggtacctcgggtacggacgggtaaccgggccgttacgggttacccgaccggttccgtaacggtcccgaccgggtacccgtaaccggtaccccgtccccggttcccccggttggtacccccg

SEQ ID NO: 89072 - DNA, 698 bp, Homo sapiens
  misc_feature: GYAE6OF01ETGLH.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggacaaacggccaggatcacctgctctgganattcattcgaccaaaagatatacttgttgtcagcagagtcaggccacggcccctgtactggtcactccatggacggccagtccgacgacaccgtccgggactcccgtagagagtacttcctcgtcgccctccgacgtctacgagggtacaggtcggccctacttgaaccttatcgtagggtccggggaccgtagggtcggaacgtagtacggaagtccgtagtaaccttaacgttagtttacggttaaccgacctaaccgaacggtaactaagggtttacggtcggtaacgtacggttacgggttaacggggggttaacgttccgggggaacggggtaacgggtaaacccggtttaagggttacccgggtaaccccggtttcggtttacggggacccgaaccgggtaccccggaaaggtccccggttacccggcccccccggttacggttccctacccgttcccgtttcccccggg

SEQ ID NO: 89073 - DNA, 637 bp, Homo sapiens
  misc_feature: GYAE6OF01D48DW.21.8.A08.1.454.CMB.1.raw
  modified_base (170)..(170): a, c, t, g, unknown or other
  misc_feature (170)..(170): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgcttcttttaagnggtgtccagtgtcaggcgcaactggtggagtcgtgggggagcatcggtccagccgtgggacgtccctgacgccttctccgtggtcgccggtcgttctggtacttcgagttagtccggtccttaccgttttcgacctagtcggcctaccggttccgggtcccgcgacggtcctccggagggacggaagggggctaggggaggttggggtcgacggtattacgtcgtggtatggagtggaagtgaagatattacttatacagtactcggtagaacgggtccgtattaccactacgtctaccgagacaactaacgtccgaacaaccgaacaccgatgtacttactacgaacgtcggaccgctagacgacgacggacgtacgacgtactagtagttattacgtaggtacgtaggttcgttacggtcgttacggtcgggtaaccgtacggtaacccgttcgtcccgtaccgg

SEQ ID NO: 89074 - DNA, 699 bp, Homo sapiens
  misc_feature: GYAE6OF01D4H6T.21.8.A08.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccctcctatgagctgacacacgcccacccgtcggtgtcagtcgtccccaaggacaaaccggtcaggatccacctgcttcgtggatattcattacgaaccaaaagaattattacgttgttaggttccagacgaagagtcgacggccgacggtcccctgtactcggtacatccagtcgacggaccngtaccgacgactaccgtaccgggactacccgtagacgagtacttcctacgtcgaccctaccgacgtccgtacggaacggaccgtacgggtccggacccgttaccgttacgtaaccgttacgtaccggtacgggttaccggggaccccgtagggtacgggacgtaagtaacggacgtacgtacgtacttacgttacgtttacgtaccgacgtacgaacgaactaggttacgtacgtacgtacgtacgggtaggggttacgtcgggacggtaacgggtaccgtaaacgttccggtaccgttccggttggtaccgtacgtacccgtacgtcccggtacccgtccccggttagtcccttccgtccgttacccccg

SEQ ID NO: 89075 - DNA, 713 bp, Homo sapiens
  misc_feature: GYAE6OF01CSJOH.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgacgctgacacacgcccaccctcggtcgtcagtcgtccccaggaacaaaccggcaggactcaccgtgctcgnggagtattcattcgacaaaagtaatatacttggttacggttcagctaagaagtcgaagccgacggcccctaggtactggtacactaccgatcggacggtccaggtaccgaacgaactaccggtccgggacctaccgagtagagttaccttctactccgtacctcgagtctacggacggaactacgtcggacctacgttacgtacctaagtccggaacggttacggggaccccgtaggggtaccggaacgacggtttaaggaaccgtacgtaaccgggttaacttacttaacggttcgttaaccggacctaacgtacgaacgttaacggtacgttacggttacgaacgttaccggggtaaggggttacgttaccggggaacgggtaacgggaccgtaaaggttaccggacccggttcgttacggtaccgacggttacccggaaagttcccgtacccggtccccgtacggaccttccgttcccgttaacccg

SEQ ID NO: 89076 - DNA, 702 bp, Homo sapiens
  misc_feature: GYAE6OF01DADH1.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgcttctttaagaggtgtccagtgtcaggcgcaactggtggagtcgtggggagcagtggtccagccgtggggacgtccctgagcctctcctgtgcagcgtctggacttcgagtactcggcttcctttgacctatcgctacgtcgggtcccgaccgaggccttccgaggccgaagggggtccttggggagttggggtggtaccgtaatttagtcgtggtatggagtaggaagttgaagtagtaattagtttactcgtaaggtaccgtaccggtaggaacgggtccctaacgtttcaacccgtacgttactacccgaaggtaacgaaccgtaagtaccgaacccgtaaaaccgaaccgaacttaacggtattaacgtaccctttaaacgaacggttacgaccccggtcgttaaggaccggaacggaccggtaacggaccgtacggttactaggttaacgttaacgttaggtacgttaaccggtagtttcgtttaccgggtcgtaaacgggtttcgggaaccgtaaccggggaaccccttgggtaccccg

SEQ ID NO: 89077 - DNA, 646 bp, Homo sapiens
  misc_feature: GYAE6OF01EXVC2.21.8.A08.1.454.CMB.1.raw
  modified_base (86)..(86): a, c, t, g, unknown or other
  misc_feature (86)..(86): n is a, c, g, or t
  modified_base (167)..(167): a, c, t, g, unknown or other
  misc_feature (167)..(167): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
  modified_base (508)..(508): a, c, t, g, unknown or other
  misc_feature (508)..(508): n is a, c, g, or t
  modified_base (525)..(525): a, c, t, g, unknown or other
  misc_feature (525)..(525): n is a, c, g, or t
tcagtcgtcgctcgcacgaccggtgctcgatttagcatactctacagggggctgtgggctcaggaggcagagctctgggatcctcnccactggccgtcggacccgtcctcctccgtcctcccctccctcctacttcttcgcacagtctctcgaggcctcctatgagnctcgacaccacgccgacccgtcggtcgtcgtacgtcgacgaccgaacgacgaacgaacgacgacgtactccnctcgtcgtcgtagtagtacnaactacgtaacgtaaacgtacgtaaagttacgttacgattcggttaccgtacgacgtagtaaccnanggnggtaacggccctacggtaccctggtaccgtacggtacccgtaccgtacggtacgtaccgtacgtaccgtaccggtaaccgaccggtaccggtaccgtaccggtacgccgaacgtaccgtaccgttaccgttaccgnttaccgacgaccngtaccgtaccggtacggtaccgtaccggtnacccgtaccgttacggnccttaaccgtacggacgtacgggtccgtacggtacggtaccgacgtacgaacgtcggtacgtacgtacgtacgtacgtacgacgtacgtacgacgtacgacgtacgtacgtgtcgtacggg

SEQ ID NO: 89078 - DNA, 701 bp, Homo sapiens
  misc_feature: GYAE6OF01COZSF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacggcctcctatgagctagacacacgccccacctcggtgtcaggtccgtccccaaggaacaaccgggccaggactccacctgctcgtggagtattcattacgaaccaaaagtatattacgtttgttcggttaccagacgaagaacgtcgacggccacggcccctaggtacctggtacctactaccgagtcggacggccgacggtccgaacgaccgtaccggtaccggtactccgtaggacgtagtactttctacgtccgtccctccgacgtccgtacggaacggtacctgggtccgacccttaccgtacgtaacgtcgtacggtacgggtaccggggtaccgtaggggtcggaacgtagtaacggtaaacgtccgtagtaaccgttaacgttaccgttacgtaccgtacgaaccgtaacgacgtaaggtacggtgtacgtaggtacgggtagggtacggtcgggaacgggtaggtacccgtaggtccgtaccgttcggtagttaccggaccggaccgtacggcccgtccggtaccccgtagtccctcgtcccgtccccg

SEQ ID NO: 89079 - DNA, 847 bp, Homo sapiens
  misc_feature: GYAE6OF01A7RA7.21.8.A08.1.454.CMB.1.raw
  modified_base (476)..(476): a, c, t, g, unknown or other
  misc_feature (476)..(476): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacggcctcctagtgacgctagaccacacgccctacccgtcgggtgtcaggtccgtaccccgaaggaaccaaaccggccgaggactccgacctgcctacgtggtaatacttacaacgttacggaaacctaaaaagtaacttacgttaacgtttggtttaggtacgaaagtacgtaaggtaacgtaccgacggacccgtaccggtcccccgttaggtaaccgtggtaccactaccgtagtacgggaccggtacccgtacggtaccggaccgaaccgtaccggtacccgggtactcccgtaggaagtacgttacgttccgtactccgacctaccganccgtaggacggtacgtacgggtaccgtaccctacgttacgaccgttacggtaccgggtacgggtacccgggggaccgtaggggtaagggtaacccgtaaggtacggaaaccgtcgttacgggtaaactttacgttaagttaccggtaacccgacgtaacccgaagtacgttaaggttacgggttacgtaacgtacgggtacgggttaacgggggtacgttccggggaacgggaacggggtaacccttacggggtttaccggtaaccccggttcggggttaacccgggtacccggaaccgggtacccgtaacgggttccccgtaccccggtacccccggttaggtacccctccccggtttcccgtacccccg

SEQ ID NO: 89080 - DNA, 837 bp, Homo sapiens
  misc_feature: GYAE6OF01COQDF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccctacccgtcggtgtcacgtcgtccccgagggaaccaaaccggccaaggactacctaccgtgccttacgtgggtaagtacttaccgaatttacggaacccaaaaaagtaaacttactttaaccgttttggtttcggttaccctagaccgtaagtaaaacggtccgaacggtcccgaaccgggtcccccgttaaggtaccgttcgggtaccctaacgttacccgaagtcgggaaccggtcccgaaacggttaccggaaccgtaaccgtaacccggttcccgggtaccttaccccggtagggaaaccggtaaggtttacctttccggtacccgttacggtccccccgttaccggacgttacccggttccgggaaacggggtaacccggtacgggtaccgggtaccccgttaaccgttaacggtaacccgttacgtacccggtacgggggttcccggggaaccgtaacgggttacgggaacggtagtacggtaagaccgttacgtaacttacgttacgttacgtaccgacaaccgaagtacttaaggtacggtacgtacgtagtacgggaggggttacgtcgggacggtacgtacgtaccgtcggtacgtccgttaggacctcggaccgtagtcccggtccgaccccggttgcccttaccgtccgttcccccg

SEQ ID NO: 89081 - DNA, 760 bp, Homo sapiens
  misc_feature: GYAE6OF01CRMBH.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttcngcacagtctctgagcctctatgagctagacacacgcccacccgtggtcgtctaggttccgtaccccgaaggaaccgaaaaccggccgaaggtactccaccgtgcctcgtaggatacttacagttacggaaactaaaaagtattattacgttggttcgtaccaagcgaagaacgtccgacggtaccgaccggtccccttaggttacgtcggtacctacgtaccgagtaggaccggtacccgaacggttaccggaaccggtaccgtaccggttacccggggtaaccttccccggtaaggacgtacgttacctttccgtccgtaccgtccccgtaaccgccgtaccggtacggaacggggtacctaccggggtctaaccccgttacggttacgtaaccgttacgtaccggtacgggtccgggaccggtagggtacggaagtacggtagaacgtctacgtacttaacgttcgttacgtacgacacgacgtacgtaaggtacggtagtacgtacggtacgggtacgggttaggtacgggacgggtacggtaccgtagttcggtaccggttccggtacgtacggaccggacccgacggtccctaccggtccccgtaccgtcctccgtccgtcccgg

SEQ ID NO: 89082 - DNA, 719 bp, Homo sapiens
  misc_feature: GYAE6OF01CKUSN.21.8.A08.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggaacaaacggccaggactccacctgctctggagtnttcattgaccaaaagaatattacgttgttcggttccagtcgaagtaagtcgaacggccacggtccccctagtaccgtggtctagtccagtcgacggtccaggtcgaacgacaccgtccggactcccgtagacgtagtactttcgtcgtcgtccctaccacgcctacggaacgggtacctacgggtcggacccctaaccgtttacgaacttacgtacggtacgggtccggggacccgtacgggtacgggaacggtagtaggaacgtcgttacgtaacttacgttacgtttacggtaccgaccgaaccgtaacgtaacgtaaggttacggttacggtacgtacggtacggtacggggggggttacttacggggacgggtaacgggtaaccgttaacggttccggtacccggttcggttacggtaccgtaccggacccgtaacggtcccgtccccggtacccccgttcggtacccttcccgttcccgttcccccgg

SEQ ID NO: 89083 - DNA, 769 bp, Homo sapiens
  misc_feature: GYAE6OF01EVY01.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctagacacacgcccacctcggtgtcagtcgtacccaggacaaacggccaggactcactgctctggatattcattcgaaccaaaaagtatattacgttgttaggttacaagcgaagaacgtcgaacggccacggccccttagtactacggtcactaccgatacggacggaccacggtacgaaccgtacctacggtacccgggactcccgtagaacgagttacctttctcctcggtcccttacgacgtccgtacggaacggagtaccggttcggacccctaaccgtttacgaaccgttacgtaacccgggtaacgggttacccggggtaaccccggtaagggggtttacggaaaccggttaaacggttacggtaaacggtcccggttaacgttaaccgtttaaactttaaccggttttaccgggttaaccgtacccgaacccgtaagaaccgttaagtaccgggttcgtacgtacggttaacgggtaacgggggttacgtacggggtacggggaacggtaacccggttaaaggtccgtacccggtttacggtcgggtacctaccggacccgtagtccccgtccgaccccgtacggtcctacgtcccgttaccccg

SEQ ID NO: 89084 - DNA, 591 bp, Homo sapiens
  misc_feature: GYAE6OF01EZYDC.21.8.A08.1.454.CMB.1.raw
  modified_base (329)..(329): a, c, t, g, unknown or other
  misc_feature (329)..(329): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaatcaggccaggcccctgtgttggtcatccagtgaggacaggagaccgaccgtcggatccctgagagtatctntggctcaacgtcgacgggtacggtcggccgtaacgttgacgtttcgtacgaggttcgggggccccgaagggttgggacgggtagttggaaacggtcgtaggaaccttaacgtacttagttacttaccgagtacgaagtacgagtacgagtggtacagtcgaaggggcaagttcgggacggaagggccgtaggttccgaccggtacctacgggtcgtacgccccgaaggccgtacgcccccgtggttcccacgtcttccccgg

SEQ ID NO: 89085 - DNA, 829 bp, Homo sapiens
  misc_feature: GYAE6OF01CEFNM.21.8.A08.1.454.CMB.1.raw
  modified_base (254)..(254): a, c, t, g, unknown or other
  misc_feature (254)..(254): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacaggctctgaggcctcctatgagctgacacacgcccacccgtggtgtcacgttcgtccccgaggaccacggaccggccgaggactccacctgctctgcagatcggactagaacaaagaatntgtaccttagtacggtaaccaaacgaagaacgaccgaggacccgaacggtcccccgttggttacggtttaaggtaggtaattaagttaaacgtaaaaacggacctaacgttaggaacggtaccggaccccttacgaaggtaacgtaccttcccgtaaggtacggtaccgttacgtttccctcggtacggtccctaccgacggtccgtacggaacgggactacgacgaacgttacgtacggtttagaaccttacgtacgaagggttacggaaacgtacccggaaagggaccgaaggggtaacgggtaacggacgggtaccgttaacgttaagttaaccgttttaaccggtaacgtaaactaaaacgggttaacggtaaacgtacggtaaaggttaacgggtaacggttacccgtagggttaacgggtttacgggggttacggtttaacccggggacgggggtaaaccgggaaccgtaaacgggtccccggttaaccgggtaaacccggttaccggttaaaccgggaaccgttacccgggaaaccccggtacgggttaccccggttacccccccggg

SEQ ID NO: 89086 - DNA, 808 bp, Homo sapiens
  misc_feature: GYAE6OF01CFAS5.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgacgcctcctatgacgctagacacacgcccacccgtggtgtcacgtccgtaccccgaaggaaccgaaaccggccaaggactaccaccgtgcttcgtgggaatactttaccaattcggaacctaaaaagtattacgtttacgttggtttcggttaccaagaccgtaagtaagttacgacgggacccgtaacggtccccccgttaggtaccgttgggtacctaacgttacctaggttcggaaccggtacccgtaacggttaccggaaccggaacccgtaacccggttacccgggggaaccttacccccgttaggaacggtacgtaacttttccgtcgtcggtcccctacgtacgccttacggaacgggtacgtacgggtccggaccctacgttacgtaccgtagtaccggacggggttccgggacccggtaacggggttcgggaacggtagtaacgggaaccggtcgttacgtaacctttaacgttacgtttacggtaccgaccgtaaccgagtaacgtagttacggttacggtactaacggtacgggtaacgggttacgtccggggaacggtacgggtaccgtaggttaccgacggtttccgtacgggaccgtaccgaccgaaccggtccgtaccggacccccgtacgtccgttacgtcccgttccccgg

SEQ ID NO: 89087 - DNA, 827 bp, Homo sapiens
  misc_feature: GYAE6OF01CDT4R.21.8.A08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagcatactctacagggggctgtgggctcaggaggcagagctctgggaatctcaccatggcctggaccctctcctgctcccctcctcactttctgcacagtctctgaggcctcctatgagctgacacagcccaccctcggtgtcagtgtccccaggaccaaacggccaggactccacctgctctggagtattcattcgaccaaaagtaatntacttgttgttccagacagaacgtcgaggccaggtcccctgtactggtacatcagtggacgccagcgacgacaccgtaccgggatcccgtaggagtacgtactttctccgtacgccccgttaccacggtcccgttaacggacggggtaccacgggttacggtacccccttaacccggttggtaaacccttagttaccggtaacggggttcccgggggtaccccgtaaggggttacgggaaaccggtaacggttaacgggtaacggtaccctttagggaaacccttttaaacggttaccggttttaacggtttaaccccggacgtaaccccgtaaggttaaccggtaacggtttaagggttccgggtaacttacgggttaccggggttaagggggtttaaccgggtttccggggaaaccggggttaaccggggtaaacccgttaaagggtttacccggtaaccccgggttttccggtttaacccggggtacgtaacccgggtaacccccggtaacggggttacccgtcccccgggttaccccccgttcgggttaccctacccggtttcccggtttaccccccggg

SEQ ID NO: 89088 - DNA, 699 bp, Homo sapiens
  misc_feature: GYAE6OF01EG1OB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacagcccaccctggtgtcagtcgtccccaggacaaacggccaggactcactgctcgtggatattcattcgaccaaaaagatatacgttgttcgttccagcagaagtcgaggccacggcccctgtacgtcggtacatccagtgacggccaggtccgacgacacgtccggatcccgtagagtacgtacttctactcgtaccctccgacgtccgtacgaacggggactaggttccgggaccctaaccgtttaggaaccttacgtccggtaacgggtcccggggaacccgtaggggtacggtaacgtaacggtacggaaaggtccttacgtaaccttaaccgttaagtttacggttaacccgaccgtaaccgtaacgaacgtaaggtaacggttcggtacgtacgtacgggtaacgggggttacgttacggggacggtaacgggaaccttacggttacggtacccgttcggttaggaccggtacgaccccggaaggtcccgtacccgtcccccgttacggtacctacccgttccgttacccccg

SEQ ID NO: 89089 - DNA, 722 bp, Homo sapiens
  misc_feature: GYAE6OF01C8YA8.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttcngcacagtctctgacggcctctatgagctagacacagcccaccgtggtgtcagtcgcccaggacaacggcaggatcactgctgtggatatcatcgaacaaaagatatacgttgttcgtacagacaaggaactcgacggtaccgaccggtacccgttacgtacgtggtctacgtaccaagtcggacggccctaacggtacggaaccgaccaccggttccgggactcccgaggaacgtagtactttcctacttccgaccctaccgagggtacctacgggaacgggacgtacgggtcccggtaaccccttaacgttacgtaaccgttagacggtacggggtacggggacccggaaggggtacgggaacgtaaggtaggaacgacgttacgtaaccttacgttaactttacgttacgacctaacgacggtaacgtaagggtaggttacggtaccgtaggtacgggttaaaggggttacggtacggggacgggaacggtaacgttaacggtcggtacccggttcggttacggaccggaccggacccggaacggtccgtaccccggtaccccttcggacctacccgttccgttccccgg

SEQ ID NO: 89090 - DNA, 695 bp, Homo sapiens
  misc_feature: GYAE6OF01ATHDP.21.8.A08.1.454.CMB.1.raw
  modified_base (130)..(130): a, c, t, g, unknown or other
  misc_feature (130)..(130): n is a, c, g, or t
  modified_base (227)..(227): a, c, t, g, unknown or other
  misc_feature (227)..(227): n is a, c, g, or t
  modified_base (322)..(322): a, c, t, g, unknown or other
  misc_feature (322)..(322): n is a, c, g, or t
tcagtcgtcgctcgcacgaccggtgctcgatttagcatactctacagggggcgtgtgggctcaggaggcagagctctgggaatctcaccatggcctggacccctctcctgcctccccctcctcactttcngcacagtctctgaggcctcctactgagctgaccacacgcccacccgtcggtgtcagtcgtccccaggaccaaacggccagatccacctgctctgganatcattgacctaaaagattatacttgttcggtccagtcaagagtcacggccacggcccctagtacctcggtcactccatgacgccagtcgacacnccgtccgggactcccgtgagtacgtacttcctccgtcgtccctaccagtcctacggaacgggtacctacgggtcccggtacccctacgttacgtaccttacgtcgacgggttcccgggaccgtaggggttcgaacgtaggtacggaacgtcgtagtaacctttacgttacgtttaccgttaaccggacctaaccgtaacgtaacgtaagttaacggttacggtacgtaacggtacgggttaacggggttaccggtaccggggtacgggtaaccgggtaaccgttacggttaccgggtacccggttcgttacgggcctaccggaccggtaacgtcccgtaccgtccccgtaccggtactcccgttcgtaccccc

SEQ ID NO: 89091 - DNA, 810 bp, Homo sapiens
  misc_feature: GYAE6OF01CZ3RM.21.8.A08.1.454.CMB.1.raw
  modified_base (528)..(528): a, c, t, g, unknown or other
  misc_feature (528)..(528): n is a, c, g, or t
  modified_base (787)..(787): a, c, t, g, unknown or other
  misc_feature (787)..(787): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgacggcctcctatgagctagacacacgcccaccgtcggtgtcagtcgtcccgaggaaccgaaccggccaggactccacctgctcgtaggacgtattccagttcgaaacctaaaagtaacttaacttacgtttcggttacggttaccaaggtacgaacggttaacgccggaacggtacccgaaccgggtccccctttaggtaccgttgggtacctacctaccgtaggtacggaccggtaccgtaacggtaccggaaccaacccggaccggttacccggggtacttacccggtaggaacggtacttacctttccgtccgtccgacccttaccgacggtccgtacgggaacggggaccttaacgggtcccggtaacccttaaccggttanaacccggttaagtccgggtacggggttaccggggaaccccggtaggggtaccgggaacggtaacggtaggtaacggtcgtacgtaaccgttaacgttacgttacgtacgtaccacgacgtaacgttaggtacgttcggtacgtacggtaccgggtaggggttacggttcgggacggggtaaccggtaccgtaacggtccggtacccggttcgtacggtccgtaccggacccgggtacgtcccgtcccggtaccccggtntaccgtccttcccggttaccccg

SEQ ID NO: 89092 - DNA, 735 bp, Homo sapiens
  misc_feature: GYAE6OF01BOEHC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaaggaccaaacggccaggactccacctgctcgtggatattcattcgaaccaaaagtattatacgttgttcgttccagcaagacgtcgacggccacggtcccctaggtacgtgtcactccagtcggacggccaggtaccgacgaccgaccggtccgggtactcccgtaggaacgtacgtactttcctccgtccgccctccgacgtccgtacggaggtaccgtacggtaccgtacccgtacgttacgtacttacgtacggtacgggtacccgggaccgtagggtacggacgtagtacggaacgtccgtagtaccgtttacgttacgtttacgtaccgaccgtaaccgtacgtaacgtaggttagtacggtagtacggttacgggtacggggttacggttaccggggaacgggtaacgggtaccgttaacgggttcccgtacccggtttccggttacgggtacccggacccggtacccggtaaccggttcccgttcccggttacccccggttacgggttacccttacccgtttcccggttacccccgg

SEQ ID NO: 89093 - DNA, 685 bp, Homo sapiens
  misc_feature: GYAE6OF01CYFK6.21.8.A08.1.454.CMB.1.raw
  modified_base (131)..(131): a, c, t, g, unknown or other
  misc_feature (131)..(131): n is a, c, g, or t
  modified_base (175)..(175): a, c, t, g, unknown or other
  misc_feature (175)..(175): n is a, c, g, or t
  modified_base (230)..(230): a, c, t, g, unknown or other
  misc_feature (230)..(230): n is a, c, g, or t
  modified_base (430)..(430): a, c, t, g, unknown or other
  misc_feature (430)..(430): n is a, c, g, or t
  modified_base (469)..(469): a, c, t, g, unknown or other
  misc_feature (469)..(469): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctctactttcngcacagtctctgagcctctatgagctgacacagcctacctggtntcaggtcgtcccgagggaacaaaacggccaagtactccaccgtgcctgtggaatnttcagttgaaccaaaaagtatatacgttgttgttaccagactaagaagtcaacgggccaacggtccctggtactggtaccaatccaaggtcgagggaccctaaggaccgaaccgaacctacgggttacccggcttcccgagacggtatacgtttcacgtcgaccgcaagcgtacgagggactcggtcgaccctaagtttnaactagtaccgagggtcggaccgagggtaccggaagtanacgggaactgtacgaacctttaagtacgtttacgtaaccggactaaacgacgaagtacgtaagggtcggtaacgtactaacggggtaggggttactacggggaacgggtaaacgggtaccgtacggtttaccgccggtttaacgtaggaccggcggtaacccggaagttccccgttacccggaccccgtttggaacctccgttcccgttaccccgg

SEQ ID NO: 89094 - DNA, 716 bp, Homo sapiens
  misc_feature: GYAE6OF01C2U62.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccgaggacaaaccggccaggatccacctgctcgtggagattcagttcgaacctaaaagaatattacgttgttggttccagacaagaagtcaggccacggcccctgtacgtgcactccagtgagcacgtcgacgacacgtaccgggactcccgtagacgtagtactttccttacgtccgtccctacccgtacgtcctacggaacgggaccgtacggtaccgggtacccctaacgtttacggacttacgtacgagggtaccggggaccgtagggtacggacgtagtagaagctacgacttacgttacgttacgtaccgacaaccgtaagaaccgtaaggttacggttacggttaccgtaacgttcgggtaagggggttacggttaccggggacgggtaaccggggtaaccgtaacgggttacgtaacccgggttcggttacgggtaccgtaccggaccccggtaacgggtccccgtaccccggttaccccccgtaccggttacccgtcccgttcccggtttaccccccgg

SEQ ID NO: 89095 - DNA, 712 bp, Homo sapiens
  misc_feature: GYAE6OF01CZ4RD.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgaggcctcctatgagctgacacacgcccacccgtggtcgtcagtcgtccccgaggaaccaaacggccaggactccacctgctcgtaggagtattcattcgaaccaaaaagtaatattaaccgtttggtttcggttaccaagtaccaaggtaaacgtcgaacggaccaacggcccccttagtaccgtggtcctaacgttcccagtcggacggaccaacggtccggaacgaccgtaccgtaccgggactccccgtaggaacgtagtactttccgtaccgtacggtccccttaccgacggtccgttaccggaacgggaaccgtacgggtttaccggccccttaaccgtttacgaaccgttagtacggtacgggtccggggacccgtagggtacgggaacgtagtaggaacgtctacgtacttaacgttagttacgttacaccaacgagacgtaagtaggttcgtacgtacgtaggtacggggttacgtcggacgggtacggaaccgaggttacgaccgttcgtagtcgacgacccgagtcctcccggtacccttggacctcgtccgttaccccg

SEQ ID NO: 89096 - DNA, 1059 bp, Homo sapiens
  misc_feature: GYAE6OF01B9XJ0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccacccgtcggtgtcagtcgtcccgaggacaacggcaggactaccacctgctcgtggagtattcagttacgaaccgtaaaaagtaatttacttacgttttggtttacggttacccaagtaccgtaaaggtaacggtaccgaacgggacccgaaccgggtccccccgttaggttaaccgttcggggttaccctaaccgttacctaacggttaccggaaccggtaccccgtaacgggttaacccggaaccccggttaaacccgtaaccccgggtttacccccggggggtaaaccttttaccccccggtaagggtaaacccggtaaacggttttaaaccgtttccccggtttaacccgtcccggttaccccccgttaacccgaacgggtccccgttaaccgggaaaccggggtaaccgtaaccggggttacccgggtaacccccgttaaaccccgttttaacggaacccgtttaccgttaaccgggtaacgggggttacccgggggtaacccggtaacggggggttaccggggtaaacgggttaacggttaacggggtaaaaccggttaccggtaacgggttaacctttaaaccggtttaacggttttaccggttaacccgggaaccctaaccggtaaacggtaacggttaaacgggttaacgggttaccggttaaacgttaaccgggttaacggggttaacggggggtttaaccgggttaccgggggtaaccggggtaaaccggggttaaccgttaaacggggtttacccgggttacccggtttacccgggtttacgggtacccggtacccgggtaaccccggtaaaccggtccccgtttacccgggtaccccccggttaggtaccccgttcccggttccccgttttaaccccccgg

SEQ ID NO: 89097 - DNA, 929 bp, Homo sapiens
  misc_feature: GYAE6OF01BLJ6R.21.8.A08.1.454.CMB.1.raw
  modified_base (184)..(184): a, c, t, g, unknown or other
  misc_feature (184)..(184): n is a, c, g, or t
tcagtcgtcgctcgcacgaccggtgctcgatttagcatactctacagggggtggggctcaggaggccagagctctgggaatctcaccatggcctcggaccctctcctgccttccccctcctcactttctgcacaggtctctcgacggtccttccgtatgagctagacacagcccaccctcggtntcagtcgtacccaggacaaacggccaggactcaccgtgctacggtaggacgacgttccaagttcgaaccgaaaaaaggtacttacttaaccgtttggttacgggttcccaaggccgtaagtaaacgttccgaacgggaccccgtaacgggtccccctttagtaacccttcggggttaccctaacgttccccgaagttacgggaacgggaccccgtaaggtacccggaaccggtacctaccgtaccgggggtacttaccccgtagggaacgtaggtaactttacccgtaccgtacgtacccttccggaacgtccttaacgaacggggttaaccaggttaccgggaaccccttaaccgttttaaggaacccgttaaggtttaccggacgggtttaccggggaccccgtaaaggggttaccgggaaccggtaagttacggaaacgtccgtaacggtaaccttaacgttacgttaccggttaaccgaccgtaacccgtaacggtaccgtaaagggttacggttacgggtaactaacgggttaccgggtaaaggggggtttaccgttaccgggggtaacgggttaaccgggaaacccggtaaggtttaccgggtaaccccggtttaccggtttacgggtacccgttaacccgggtacccggtaaacggtccggttaacccggtccccccgtttacggggttacccttaaccggtttccccggtttacccgtttccccgttaaccccccgg

SEQ ID NO: 89098 - DNA, 633 bp, Homo sapiens
  misc_feature: GYAE6OF01EPD0S.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccacccgtcggtgtcagtcgtccccaggacaaacggccaggatcacctgctctgganattcattgaccaaaagatatacttgttgtccagcagagtcaggccacggcccctgtactggtcatccagtgaggccagtccgacgacacgtccgggattcccgtagagagtattcctcgtcgccctcagtctacgaggacaggtcggacctacgttgaactagtcgacggtcggggaccgagggtcggaacgtagtacggaacgtccgtacgtaaccgttaacgttacgtttacggttaaccgaccaaccgagtaacgtaaggtaggtcgtacgtacggtacggtaagggggttagttaccggggacgggtaacgggtaccgtaaggttccgtacccggttcgttacggtaccgaccggacccgaaggtcccgtccggtacccccgttacggtcctaccgtccgttaccccg

SEQ ID NO: 89099 - DNA, 826 bp, Homo sapiens
  misc_feature: GYAE6OF01CMY6F.21.8.A08.1.454.CMB.1.raw
  modified_base (230)..(230): a, c, t, g, unknown or other
  misc_feature (230)..(230): n is a, c, g, or t
  modified_base (421)..(421): a, c, t, g, unknown or other
  misc_feature (421)..(421): n is a, c, g, or t
tcagtcgtcgctcgcacgaccggtgctcgatttagcatactctacagggggctgtgggctcaggaggcagagttctgggaatctcaccatggcctggacccctctcctgcctccccctcctcactttctgcacagtctctgacggcctcctatgagctgacacacgcccacccgtcggtgtacagttccgtccccaaggaaccaaaccggccaggactccacctgctcgnggatattcattgaaccaaaagtaactatacgttggttcgttaccagcaagagtacaacggtacccacggtcccctagtacgttcggtacacgtccaagtcggacggtaccgaggtaccgaaccggtaaccgaccggttacccgggactcccggtaggaacgtaacgttacttccgtctccgtacctaccgngtaccgtacggaacggaccgtagtcccggtccctaacgttacgtaactacgtaccgggacggggtacccgggtacccgggtagggtacggaaccggtagtaaggtaacggtcttacggtaaccgttaacgtttacgttaccgttacccgacgtaaaacccgaggtaacgtaagggtcggttacgggtaccggtagggttaccggggtaaggggggtttaaccgttaccggggaaccggggttaaccgggtaacccgggtttaaaggttaccccgggttacccggtttaccgggttacgggaacccggtaccggtaaaccccggtaacgggtccccggtaacccccggttccccggttaccgtcccggttaacccccttcccgggtttacccccgttcccccccgg

SEQ ID NO: 89100 - DNA, 757 bp, Homo sapiens
  misc_feature: GYAE6OF01D1722.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacacgcccacccgtcggtgtcacgtcgtccccgaaggaccaaaccggccaggactccacctgctctggatagttccagttacgaaccaaaagtaatacttacgtttggtttacggttccaagtcgaagaacgtcgaacggaccgaccggtcccctagttaccgtcggtccaacgtttccgaagttacggacggaccgtacggtaccggaaccgacccgtaccggcccggggtaacctcccgttaggaacgtaggtctttccgtcgtaccgtcccctacgacgtcctacggaggtaccgtacggtaccggaccccttacgttacgtaacgttacgtaccggtacggggtccggggtaaccccggtagggtaacgggaaccgtagtacgggaacgtcggtacgtacctttaagtagtttaccggtaccacaaccgacgtaagtacggtaagtcgtacgtaaggttcgggtacggggttacgtccggggaacgggtaggaacccgtaggtttaccggtacccggttcgttacgggtacgcccgtacggacggtacccgtcccggtacccccttaggcccctacccgttcccgttacccccg

SEQ ID NO: 89101 - DNA, 654 bp, Homo sapiens
  misc_feature: GYAE6OF01D4RXP.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggacaaacggccaggatcacctgctctgganattcattcgacaaaagaatattacttgttggtccagcaagaagtcgaggccacggcccctgtactggtcatccagtggacggccagtcgacgacacgtccgggactcccgtaggagtacgtactttcctctcgcccctccgacgcctacggacgggaactacggtcggaccctaccgttgacttacgtacgacgggtcggggcccgtagggtacgggaacgagtaggaacgtcgtagtaaccttacttagtttacggttaccgacctaacgagtaacgaggtacggtggtactaggttaccgggtagggggttacgttacgggacgggtaacgggtacgtaaacggttcgtaccggttccgttaggtacccgacggacccgtaaggtcccgtcccgggtaccccgtcggttacctacgttcccgttccccgg

SEQ ID NO: 89102 - DNA, 654 bp, Homo sapiens
  misc_feature: GYAE6OF01CIXSN.21.8.A08.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (335)..(335): a, c, t, g, unknown or other
  misc_feature (335)..(335): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccgaggaccaaacggccaggactcacctgctcgtggagtnttcattgaccaaaagaatnttacttgttcggttccagcgagaagtcgaggccacggcccctgtactggtcactccagtgacgccagtcgacgcacgtccggactcccgngagacgtacttcctctcgccctcacgctcggaacgggtactacgggtcgaccctacgttacgacttagtccgacgggttcggggacccgagggtcggacgtagtaggaacgtctacgtactacgttacgtttcgtaccgcaacgtaagacgtaggttaggtgtaccgtaggtacgggtaaggggttcgttaccgggacggggacggtaaccgtacgggttaccggtacccggttcggtttacggaccgtaacgggtaccccgtaagggtcccgttacccggccccggtttacggtacccgtacccgttccgttaccccg

SEQ ID NO: 89103 - DNA, 709 bp, Homo sapiens
  misc_feature: GYAE6OF01D581N.21.8.A08.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgttcggtgtcaggttccgtaccccaaggaccaaaacggccaaggactcactgctcgnggatattcaattcgaactaaaagattatacttgttcgtcagacagaagtcgagccgacggtcccctagtacgtcgtacactaccgagtacggacggaccgtacgtacgaaccgtaacgtaccgtaccgggtacctcccgtaggaacgtaacgtactttcctacgtaccgcccttacgacgtccgtacggaacgggtactacgggtccggtaccctaacgttacgaccgttaagtaccggtaacgggtaccggggaccggtaagggtacgggtaacgtaaggtacggtaaacgtccgttaagtaaccttagttaacgtttacgtaccgaccgaacgtaagaacgtaaggttacgtgtacgtagtacgggtaggggtacgtacgggaggaacggtactacggttacgtaccgttccgtaggactacccggacgtaacggtcccgtacccgtccccgtaccgttactccgttcccgtaccccg

SEQ ID NO: 89104 - DNA, 714 bp, Homo sapiens
  misc_feature: GYAE6OF01BJR1B.21.8.A08.1.454.CMB.1.raw
  modified_base (660)..(660): a, c, t, g, unknown or other
  misc_feature (660)..(660): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgacgcctctatgagctgacacacgccctacccgtcggtgtcgtacgtccgtccccgaggaaccgaaaccggccgaaggactaccaccgtcgtactcgtaggtactattcagttacgaacaaaagtaattacttacgttgtttacggttaccagacgaagtaacgtcgaacggacccgacggtaccccgttaggttaaccgtcggtacctacttaccgagttacggaccggaccgtacggtaccgacgaacctccggtaccggtaacctcccgtagacgtacgtactcctctcgcctaccacgtcacggacggcgtacgtccggtacctaccgtcgaacttacgcggtacgggtccgggaccgtagggtacggacgtaagtacggaacgttcgtagtaccgtttagtacgtttaccgtacaccgacgtacaggttaacgtagttacggactacggtacgggtagggtcgtacggaacgggtacggaacgttacggtccgtacccgtttgtacgccggaacncccggtacgtacccggtcccgtaccgtaccggtcctccgggttacttcccccgg

SEQ ID NO: 89105 - DNA, 627 bp, Homo sapiens
  misc_feature: GYAE6OF01E09CU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccgaggaccaaacggccaggactccacctgctctggatattcattgaccaaaagatatacgttgttggttccagcagaagtcaggccacggcccctgtactggtccatccagtggacggccaggtccgacgacacgtccgggatcccgtgacgagacttcctctcgccctccagtcctacgacgggacacggtcggacccaccgtttagacgttactcgaggttccggggaccgtagggtcgggacgagtaggacgtcgtagacttacgtagttaccggtacgaccaaccgagaactaggtaggtcgtcgagtcggtaggggtacgttcggggacgggtacgggaccgttaaggtccggtacccggttcggttacggacgaccgacccgaacggccgttacccggcccccgttacggccctaccgttccgttccccggg

SEQ ID NO: 89106 - DNA, 720 bp, Homo sapiens
  misc_feature: GYAE6OF01DG0TZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccctcctatgagctgacacacgcccacccgtcggtgtcagtcgtcccccagggaaccaaacggccaggatccacctgcctcgtggatattcattcgaaccaaaagtattaacttacgtttgttggttccaagcagaagtcaggccaggcccctgtactcggtcatccagtcggacggtccaggtccgaaccgacacccgtccggactcccgtgagacgtattcctctcgccctccgagtcctcggaggacacggtcgccctaacgttagaccgttatcggaacgggtccggggacccgtagggtacgggaacgtagtacggaacgtaccgtacgtaaccgttaccttacgtttcgttaacccgacgtaacccgaacggtaacgtaaggtttaacggtacggtcgtaacgttaccggggtaaggggttacggttaccggggtaacgggaccggggtaaccgtaacggttaccggtccccggttaccggttacgggaccgtaccggaaccccgtaacgggccccttacccgggtacccccgtccgggtttaccccgtacgttccccggttacccccgg

SEQ ID NO: 89107 - DNA, 838 bp, Homo sapiens
  misc_feature: GYAE6OF01CT7UC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctctatgagctgacacagcccacccgtcggtgtcagtcgtacccgaggacaaaccggccaggactccacctgctcgtaggagtattcagttacgaacctaaaaagtaacttattaaccgtttggtttacggttacccgaagtaccgaaggtaaacggtcgaacgggcccgaacgggtcccccgttaggttaaccgtcggggttacctaaccgtcccgtaaggttacggaaccgggtaccctaagggttacccggaaaccggaacccgtaacccggtttccccgggggtaacctccccggttagggaacggtacggttacttttcccgtcgttaaccggccccttaccggaacggttccgtaccgggaagggtaccgtacgggtacccgggaccctacggtttagaccttaacggtacgacgggtaccggggaccggtagggtacgggaacgtagtacgaacggtcgtacgtacgttactacgttacgtacgacaacgacgtacgtacggtacggttacggtacgtaggtacgggtacggggttacggttacggggacggtaacgggtaacccgtaagggttccggtaccgggtaccggtttacgggtaccgtaaccgggtccccgtaaacgggtcccgttacccggtaccccccggttcggtaacccgtcccgttccggtttaccccccggg

SEQ ID NO: 89108 - DNA, 596 bp, Homo sapiens
  misc_feature: GYAE6OF01CV10S.21.8.A08.1.454.CMB.1.raw
  modified_base (223)..(223): a, c, t, g, unknown or other
  misc_feature (223)..(223): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcacttttctgcacagtctctgaggcctcctatgagctgacacagcccaccctcggtgtcagtcgtcccgaggacaaacggccaggactcactgctctggaanattcattcgacaaaagatatacttgttggtccagcagaagtcacggccacggcccctgtactggtacacgtccagtgacgccagtacgacgacnccgtacggactcccgngagagtacttctcgtcgccctcagctcgaggacagtcggaccacttgaactatcgagggtcgggcctagggtggaacgtagtaggaagtctacgtaacttagttacttacgttaccgactaaccgagtaacgtggttaacgcggtactagtacgggaaggggttacgtcgggaccggaaggacccgtaaggttccggaccggttcgttaggtcacggtaccgaacggccgtccggccccttacgggccttccgtcgttccccg

SEQ ID NO: 89109 - DNA, 796 bp, Homo sapiens
  misc_feature: GYAE6OF01BNGLH.21.8.A08.1.454.CMB.1.raw
  modified_base (130)..(130): a, c, t, g, unknown or other
  misc_feature (130)..(130): n is a, c, g, or t
  modified_base (553)..(553): a, c, t, g, unknown or other
  misc_feature (553)..(553): n is a, c, g, or t
tcagtcgtcgctcgcacgaccggtgctcgatttagcatactctacagggggctgtgggctcaggaggcagagctcgtgggaatctaaccatggcctggacccctctcctgcctccccctctctactttcncgcacagtctctggacgcctctagtgacgctgacacacgcccaccgtcggtctacgacgtaccgacccgggaacaaaccggcaaggactaccgaccgtcgtcctcggtaggagtacgtcgtacttaagttaaccgtaaaaacctttaaaaagttttcggtttttaggtttttaaccggaactacggtaacgtaaggtaacgtacggaccggacccgtccggtacccgttggttcgttacggactacgtcgaagtaggaaacggacgaacgggaccgacccggtacccggtaccggtacctaccgtaggtaacgtacgttacgttccgtacgtaccggtaccaaccggtacgtacgggaacgggtccggtacgtaccgttaaggtcgttacgttcggacggttacgggacggtccggtaagggngggtaacggtagacgagtcgtaacgttactaacgttacgttacgtaacgtacgacggtacgaacggtaccagttcgtacggtaccggaacgtacgggtaccggggcggtaacgtggggtaaccgggaacggggttcgtaacggtccggttaccgggtactacgggtacccggacgaaccgtaccggacgtcccgacccggttcccgtacgtcctccggtacccgttcccgtccctcccgtccg

SEQ ID NO: 89110 - DNA, 653 bp, Homo sapiens
  misc_feature: GYAE6OF01DGTH0.21.8.A08.1.454.CMB.1.raw
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgagcctcctatgagctgacacagcccaccctcggtgtcagtcgtccccaggaacaaacggccaggactcacctgctctgganattcattcgaccaaaagaatatacttggttgttcagcganaagtcacggccacggcccctgtactggctatccagtgacgccaggtcgaacgacgacgtccgggactcccgtaggagtagtacgttctcgtacgtcccctcgacgtctcggaacgggacaggtaccggaccctacgtttacgacttacgtcgtacggtcgggacccgtagggtcggtaacggagtaacgaagtcgtacgtacgttacttagttcgttaaccgtaccaccgtaagacgtagtaggtcggttacgtaggtacggtaggggttacgttacgggacgggtacggtaaccggtaacggttcggtaccgttccggttcggtacgtaccggacccgtaacgggtccccgtcccggtacccccgtggtccctaccgttccgttacccg

SEQ ID NO: 89111 - DNA, 724 bp, Homo sapiens
  misc_feature: GYAE6OF01CG92T.21.8.A08.1.454.CMB.1.raw
  modified_base (123)..(123): a, c, t, g, unknown or other
  misc_feature (123)..(123): n is a, c, g, or t
  modified_base (360)..(360): a, c, t, g, unknown or other
  misc_feature (360)..(360): n is a, c, g, or t
  modified_base (675)..(675): a, c, t, g, unknown or other
  misc_feature (675)..(675): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcnctttctgcacagtctctgaggcctcctatgacgctgacacacgccctacccgtggtgtcagtcgtccccgaggaccaaccggccaggatccgacctgctcgtggagtattacattacgaaccaaaagaattattacttggtttcggttacccagacgaagtaacgtcacgggaccgtacggtccccccttggtaccgtcggtacctactccagtggacggcccaggtcgaccgaccnccgtacccgggacctcccgtaggacgtagtacctttctaccgtcgtaccccttacccgcgtaccgtaccggaagggaccgacggttcgggacccctaccggtttacgaccttacgtcggacggttcccggggacccgtagggtacggacgagttaacggaagtcgttacggaactttacgttacgtttccgaccggtacctaaccgagtaacggtaagtacgggttcgtaaccgtgtaacgggtaggggttacctacgggggacgggaacgtacggttaaggtcccggtacgttccggtcgacgcccgtacccgnggaccccgtcccggttccccgtcgtccctccgttcccgttaccccccgg

SEQ ID NO: 89112 - DNA, 663 bp, Homo sapiens
  misc_feature: GYAE6OF01E5A4J.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgccaccctcggtgtcagtcgtccccaggacaacggccaggatcacctgctcgtggagtattcattacgaccaaaagatattacttgttcgtccagcagagtcaggccacggcccctatcgtgtcatccatgacgccaggtaccgacgacaccgtccgggacttcccgtagacgacgtactttctccgtcgtccctcccgacgtccgtcggaacgggtacctacgggttcggacccctaaccgtttaggaaccttacgtacggacgggttccggggacccgtaggggtcggaacgtagtaggacgtcgtagtactttacgtagtttacgtaccgtcaaccgagtaacgtgttaggtcgtacgtacgtacgggtaggggttacgtccgggacgggacggtaaccgtaggttccggtacccgttcggttacggacccgtacggacccggtaacggtcccgttcccggcccccgttacggtcccgttccgtccgtttccccggg

SEQ ID NO: 89113 - DNA, 750 bp, Homo sapiens
  misc_feature: GYAE6OF01ACJEG.21.8.A08.1.454.CMB.1.raw
  modified_base (125)..(125): a, c, t, g, unknown or other
  misc_feature (125)..(125): n is a, c, g, or t
  modified_base (178)..(178): a, c, t, g, unknown or other
  misc_feature (178)..(178): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagtcgtcgctcgcacgaccggtgctcgatttagcatactctacgagggggtgggctcaggaggcagagctctgggaatctcaccatggcctggaccctctcctgcctccccctctcactttcngcacagtctctggacggcctcctatgacgctagacacacgcccaccgtcggtntcagttcgcccgaggaaccaaacggccaggactcaccgtgctcgtggagtnttcatgaacaaagtatnttacttgtcgtacagacagtacgtcacggccgtacggccctagtacgtcggtacactccagtcggacgccgacgtccgacggaccgtaccggtccgggtactcccggtagacgtacgtacttccgtctccgacctaccgacgtacgtacggacggacgtaggtaccgtacccgtaccgttagaccgtacgtcggtacggggtaccgggccggtaacgggtcgggaacgtaggtaaggaacgtacgtaccggttaacttacgttacgtttaacgtacccgtacgtaaccgtaacggacgttaacgggttaggttcggtaaccgtacgggtaggggtaacggggttcgttacggggaaccgggtaacgggtaaccggttaacgttccggtacccggtttacgggttaccgtacggtaacccgaccgggtaccgggtcccggttaccccggtccccggttaccggttacctacccggttccccgttccccgttcccccgttaccccg

SEQ ID NO: 89114 - DNA, 738 bp, Homo sapiens
  misc_feature: GYAE6OF01DNBH6.21.8.A08.1.454.CMB.1.raw
  modified_base (128)..(128): a, c, t, g, unknown or other
  misc_feature (128)..(128): n is a, c, g, or t
  modified_base (175)..(175): a, c, t, g, unknown or other
  misc_feature (175)..(175): n is a, c, g, or t
  modified_base (352)..(352): a, c, t, g, unknown or other
  misc_feature (352)..(352): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgaggcctcctatgagctgacacagcccaccctggtntcagtcgtccccaggaacaacggccaggactcacctgctctggatattcattgaaccaaaagatattacgttgttcgttccagtacagtaactcgacggccacggtcccctgtacgtcgctactaccgagtggacgccgagtccgacgacgacgtccggtaactcccgtgagtactntttctcgtcgccctaccgagtctacggacgggtacctcggtccgacccttaccgtttagaacctttagtaccgtacggggtcccgggtaccgtaacggggtacggtaacggttagaacggtaaacggtccttacggtaaccgtttaacgttcgtttaacggttaccccacgtaaccgtaagtaacgtaaggttacggttacgggttaactcggttacggggttaacggggttacgtacggggaacggggtaaccgtaccggttaaacgggtttaccggtacccggtttccgttacccgggttacgaccccggaaccggttaccggtaccccgttccccggtaacccccgttccggtttaaccctcccggttcccgttaccccccgg

SEQ ID NO: 89115 - DNA, 720 bp, Homo sapiens
  misc_feature: GYAE6OF01DU46E.21.8.A08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagcatactctacagggggctggtgggctcaggaggcagagctctgggaatctcaccatggcctggacccctctcctgcctccccctctcactttctgacacagtctctgaggccttcctatgagctagacacacgcccaccgtggtntacagttcgtccccagaaccaacggccaggactcaccgtgctcgtaggacattcattcgaaccaaagattatacgttgttggttaccagacgagacgtcgagccgtaacggcccctgtactcggtactacgtaccagttcggacggcctacggtccggacgaccgtaccggttccggaacgttccccgtaggacgtaacgtacgtttcgtccgttccgacccgtctaacggccttacggaacggacctaggtccggaccctacgtttcggaactacgtcggtaacggtccgggaccctaggggtcggaacgtcgttaacggaaacgttcgtcgtaacgttactttacgttacgttacgacctaaccgacgtaacgaacggtttaccggttaggtaccgtagttaccgggaggggttaccgttacgggaaccggggtacggtaaccggttacggttaccgttacccggtcggttaggtaccggtaaccgtcgaacgtcccgtacccggttccccgtcgttacccgactttccgggtacccc

SEQ ID NO: 89116 - DNA, 691 bp, Homo sapiens
  misc_feature: GYAE6OF01ATJJV.21.8.A08.1.454.CMB.1.raw
  modified_base (178)..(178): a, c, t, g, unknown or other
  misc_feature (178)..(178): n is a, c, g, or t
  modified_base (408)..(408): a, c, t, g, unknown or other
  misc_feature (408)..(408): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacgcctcctatgagctgacacagcccacccgtcggtntcagtcgtaccccgaggaccaaacggccaggactccacctgctcgtggatattcattcgaccaaaagatatacttgtcgtaccagcagaagtcacggccacggtcccctgtactgtcatccagtcggacgccagtccgaccgactaccggtccgggactcccgaggatacgtacttcctcgtcgccctaccgagtcctacggacggtactacggtcgaccctaccgttanaaccgttagtcggtacgggtccggggacccgtagggtacgggaacgtagaggtaacgtcctagtaaccttaagttacgtttacgtaaccaccgtaacgaacgtacgtacggtacggtacgtactaacggttcggggtaacggggttcgtaccggggacggtaacgggtaaccgttacggttaccggtacccggtttaccggtacggtaccggaccggtaccccgtaacggtcccgtcccccggtaccccggttacgtacccttacccgttcccgttcccccgg

SEQ ID NO: 89117 - DNA, 1010 bp, Homo sapiens
  misc_feature: GYAE6OF01AGKTM.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccaccctcggtntcagtcgtccccgaaggaaccgaaacggccaggactccacctgctctggatattcattacgaaccaaaaagtaattattaccgtttggttcggttacccagtaccgaaggtaaacggtccgaacgggacccgtaaccgggtcccccttaggtaaccgttcgggtacctaacgtccctaaggttacggaacggtacccgtaacggttacccgggaaaaccggtaaaacccggttccccggggtaacttcccccggtaggtaacggtaacgttaacttttccgtaccgttccggtaccccttacccgaacggtcccttaaccgggaaacgggggtaacctaacgggggtacccggtaccccgttaacccgtttacggaaacctttaccgtaccgggtaacggggttcccggggggaccccggtaacgggggttacggggaaaccggttaaacgggtaagggtaaaccggtccggttaacggtaaacccgttttaaccgtttaaacggttttaccggtttaacccgacccgtaaacccggaacggtaaccgttaacgggttagggttaaccgggttacgtaacggggtttaccggggtaaggggggttttacccgggttaccggggggaaccgggggtaaccggggttaaacccggttaaccgggtttacccgggttaaccccgggttttacccgggtttaccgggggttaccccgtaaacccgggtcccccgggtaaaccgggttaccccggttcccccgggttacccccccgggtttacgggtaaccccgttaccccgtttccccggtttacccccggttttccccccccgg

SEQ ID NO: 89118 - DNA, 749 bp, Homo sapiens
  misc_feature: GYAE6OF01B4EYL.21.8.A08.1.454.CMB.1.raw
tcagtcgtcgctcgcacgaccggtgctcgatttagcatactctacaggggggctgtggggctcaggaggcagagctctgggaatctcaccatggcctcggacccctctcctcgcctccccctcctctactttctgcacagtcctctggacggtcccttcctatgacgctcgacacacgcccacccgttcggtcgtcacggtccgtaccccgaagggaaccgaaaccgggccaaggtactcctacctcggtccttcgtagggatacttactaagttacgaaaccgaaaaatacttatttacggtttggtttacggttacaaggacgtaagtaacggtcggacggaccgaccggtacccctgtacgtcggctactaccgagtacggacggaccgtacggtaccgaacgaccgtaccggtacccgggacgttcccgtaaggacgtacgtacgttcctccgtacgccctaccgagccgtacggacggtacgtacggtccgacctacgttacgacttcgacgtcgggtaccgggaccggtagggtacgacgtaggtacgaacgtcgtactacttaacgtactttacggtacgaccgaacgacgtacgttaaggtacgttacggacgttacgggtacggggttaaggggttacggtccgggacgggaacgtaccgtacggttaccggtaccgttcggtacgccggtcgacccgtacggccctccggacccgtacgtcctaccgttcccgtacccg

SEQ ID NO: 89119 - DNA, 759 bp, Homo sapiens
  misc_feature: GYAE6OF01DNJ8D.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctggacccctctcctgcctcccccctctctactttcngcacagtctctgacggcctcctatgagctagacacacgccctacccgtcggtgtcaggttccgtaccccgaagggaaccaaaccggccaggactccaccgtgctcgtaggatacttcagttacgaacctaaaaagtacttacttacgttggttcgtaccagactaagaagtcacggccgtacggccccttaggtacgtggtacctaagtcccgtagtcggaccggaccgtaggtacccggaacgtacccgtaccggttacccgggacttacccggtaggaacgtagtacctttcgtccgtacgtcccgtaccgtacgtacgtaccggaaggggtactacgggtacccggacctttacccgttagtaaccgttacggtaccgtaacgggggtccggggtacccgtaaggggtaccggtaaacgttacgtaacggaacgtaccgtacgtacttaacgttacgttacgtaccgacaacgtagaacgttcggtaggtacggtactcggtacgggtaggggttacgtacgggagggtaacggtaccgtacgggtaccgtaacccgtttcggtagtaccgacggtcccgtaacggccgttacccgtcccggtagtaccctccgtccgttaccccg

SEQ ID NO: 89120 - DNA, 777 bp, Homo sapiens
  misc_feature: GYAE6OF01C7WR6.21.8.A08.1.454.CMB.1.raw
  modified_base (131)..(131): a, c, t, g, unknown or other
  misc_feature (131)..(131): n is a, c, g, or t
  modified_base (135)..(135): a, c, t, g, unknown or other
  misc_feature (135)..(135): n is a, c, g, or t
  modified_base (159)..(159): a, c, t, g, unknown or other
  misc_feature (159)..(159): n is a, c, g, or t
  modified_base (615)..(615): a, c, t, g, unknown or other
  misc_feature (615)..(615): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcactttcngcanagtctctgacgcctcctatgagcngacacacgcccacccgtggtgtcagttcgcccccgaaggaaccaaaaccggccgagactaccacgtgccttgaggatacttacgtagtacgaaactaaaagaattacttcgttaggtttcgaccaagacgtaagtaacggcgaccggaccgtaccgtcccttagtacggttcgactactaccgaggtacggaccgtaccgtacgtaacccgaacgtaaccgtaccggttacccggacttccgaagggaacctggttacctttccgccgtaccgtacccacgtacgtccgaacgggacggaactcgggtccccaacctttacggtaacaccgtttaacgccggtagggggtacccggaaccgtaggggtaacacgtaagtaacggtaacgtcgtaaacgttaacttaacggttaacgtttcggtaaccccaaccggaagtacgtaaggtttaacggngttaccgaacgtagggtaacggggtaggttaccggtacgggaacgggaaacttaccgttacggtaccggttcccggtaacggtaccgaaccgcccggtaaaccggccggttcccgttccccggtaacccggttactaccgtttccccttccggttacccccg

SEQ ID NO: 89121 - DNA, 743 bp, Homo sapiens
  misc_feature: GYAE6OF01C4GVL.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggccctctatgagctgacacagcccaccctcggtgtcagtcgtcccaggaccaaacggccaggactccacctgctcgtggatattcattcgaaccaaaaagtattattacgttggttcggtccagcaagaacgtcacggccgacggccctgtactggtcactccagtcggacggcctaggtaccggaaccgaccgtaccggtcccgggacttccccggtaggacgtaacgtacttttccgtaccttccggccccttaccgaacgtccgttacggaacggggactacggtccggacccctacgtttcgaaccttacgtcggtacggggtccggggtacccgtaggggtacggacgtagtacggaacgtctacgtaccttacttagtttaccggtacgacctaaccgaggtaacgtagggtaacggttcgtaccgtaggttacgggtagggggttacgttaccggggacgggtaccgggtaacccggttacgggtttcgaaccccggtttccggttacgggtaccaccgggtacccgaacgggtcccgtacccggtcccccggttcggtaccctaccgttcccgttccccgtacccccgtacccccg

SEQ ID NO: 89122 - DNA, 828 bp, Homo sapiens
  misc_feature: GYAE6OF01DH5BE.21.8.A08.1.454.CMB.1.raw
tcagtcgtcgctcgcacgaccggtgctcgatttagcatactctacagggggctgtgggctcaggaggcagagctctgggaatctcaccatggcctggaccctctcctgcctccccctctcactttctcgcacagtctctgaggcctcctatgagctgacacacgcccaccctggtgtcagtcgtacccaggaacaacggccaggactcactgctcgtgggatattcagttgaacctaaaagtaactacgttacgttggttacggttccaacgacgaaaggtaacgtccggaacggacccgaccggtaccccttagtaccgttcggtactactaccgagtcggaaccgcccgtaaggtccgaacggacctaccgggttcccgggaacttcccggtagggaacgtacggttactttccgttacggtaccggtcccttaacccggtaacgttaccggggaacgggggtaccggttccggaccgttaacggtttcgtacgtttcccgtacgggtacgggggtaccgggggacccggtagggggtacggggacggtaaggttacggaacgtacgtaacggtaaccttacgtttaacgtttaccgttaacgtacgacgacgaacggtacgacggttactacgggttcggtacgtacgggcggggtaacgggacggttccggggttaccggggaccgggggtaacggacccgggttacgggtacccgggtaaccggttaccggtaaccgggttcccgaaccggtaccccgggtaaccgtccccggttacccccgggtacccggtttacccggtcccggttccggtttacccccgg

SEQ ID NO: 89123 - DNA, 639 bp, Homo sapiens
  misc_feature: GYAE6OF01BXFJS.21.8.A08.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctntggagtattcattgaccaaaagatatacttgttcggttccagcagaagtcaggccaggccctgtactggtcatccatgaggccagtccgacgacacgtcccgggatccccgtggagagtattcctctcgtccctccagcctcgacgggacgagtcgggccctaccgtttgaaccttatccggacgggttccgggggaccccgtaaggggtgggaaccggtagtaggaaacgtcgtagtaaccttacttaacgtttcgtaccgtaccaaccaagactaggtaggtcgtactagtacgggtagggggttacgttcggggacggacggaccgtaggttcggacccgttccgttacggtccgaggacccggtaggtcccgtcccgtcccccgtacggtcctacgttcccgttcccgttcccccgtcccccg

SEQ ID NO: 89124 - DNA, 858 bp, Homo sapiens
  misc_feature: GYAE6OF01B5QJH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggtcctcctatgagctgacacacgcccacccgtcggtcgtcgacgtccgtacccgaggaaccgaaacggccgaaggactccaccgtgactcgtggacgtacttcacttcgaaccaaaagacttattacttgttcgttacgagacaagtagaccgacggccgacggccccttaggtaccgtcggtacacgtccaggtcggaccggtaccgacggtccgaaccgtaccgtaaccgggttaccccgggtactaccccggtaggaacggtacgttaacgttccgtaccgttaccgaccccgtacctaacgggccccgttacgggaacgggtacgtaacgggttcccgtaaccccgtttacgttaacgggttaacccttacggttacggtaacccggggttaccgggggtaacccgtaacggggggttaccgggaacggttaacggttaagggtaaaccgtcggttaaacggtttaaccgttaacggtttaccgtttaaccggttaacccgtacgtaaaccggtacggtaacgttaaccggggtacggttaaccggttacggttaacggttaccggggttacggggttaccgttacgggggaccgggttaaacggtaccggttaaacggttaccggtaccggtttccggtacggtcgaacccggacccggtaaggccccgttaccgtcccgttacggtcccgtaaccgttccgttaccccg

SEQ ID NO: 89125 - DNA, 698 bp, Homo sapiens
  misc_feature: GYAE6OF01BMFM9.21.8.A08.1.454.CMB.1.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggccctcctatgagctgacacagcccacccgtcggtctcacggtcgtaccccgggacaaaccggccgaggatccacctgcctcgtggagatgactattgaacctaaaaattntttgtttttacgacancagaagtcaggccacggtccctgtcgttgctactcagtggacggacgaggacgaccggacccgtccgggtactcccgtaggagtagtacttccgtcgtcggtacctaccgaacgtcggacgggtcggtacgaccgtagttcgtattccgtacggtacgggtccgggtaccggtagggtagggaacggtaggtacgacggtcgttacggtaacttaacgttaacgttcgttacctacgtacgaaccgagacgaggactagggtcgtacggtagtacgggagggggtactacgggttcgggacgggtagggaccgtagggttaccgaccggttccgtacgggtcccgaaccggtcccggaacggtccccgttacccgtacccccggttcgtaccctccggttcccgttccccgtcccccgttacccccg

SEQ ID NO: 89126 - DNA, 794 bp, Homo sapiens
  misc_feature: GYAE6OF01CF05S.21.8.A08.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacggccttcctatgagctgacacacgcccacccgtcggtntcagtcgtccccgaggaacaaaccggccaggactccactgctcgtggatattcattacgaaccaaaagtaatattacttgttacggttccagacaagaacgtcgacggccgaccggtcccgtgttacgtcggtactactaccgagtacggacggaccgtacggtaccgaacgtaccgtaccggtcccgggactcccgtaggtaacggtagttacctttcgtaccgtccgtaccccgtaccgtacgtacccgtcgggaacgggtaacctaccgggtaccggacccccgttaaccgttaccgtaacgttacgaccggtaacgggggttcccgggaaccggtacggggtacgggaacgtaggtacggtaacgtaccgtactaacgtttaacttacggtttaccgttaaccgaccgtaaccgtaacgaacgttaaggtacggttacggtaacgttaacggttacggggtacgggggtttaagtcggggaaccgggaaccgggttaccgttaaacgggttcccggttacccggtttcggttacgggacctaccggaacccggtcggtccctccccgggtaccccgttacgtcccgttaccgttccggttaccccccg

SEQ ID NO: 89127 - DNA, 614 bp, Homo sapiens
  misc_feature: GYAE6OF01AW3WU.21.8.A08.1.454.CMB.1.raw
tcagtcgtcgctcgcacgaccggtgctcgatttagcatactctacaggggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggactcacctgctctggagatcattgaccaaaagaatatacttgttggttcagcagagtcaggccacggcccctgtactggtcactccatgacgccagtcgacgacacgtccgggactccctgagagtacttctctcgccctccagtcctcgacgggacgtacggtcggccctaaccttcgacttaatcgacgggtcggggccccgagggttcgggacgtagtggaagtcgtagtaccttacgttatttagttaccgacgaacccaagaccgtaggtacggttggtacctagttcgggtaagggggttacgttacgggacggggtacgggacgtaacggttggtacccgttcggttcggtacgcggaccccgaaggtccgtcccggtccccgtcggtcctccgtcgttccccg

SEQ ID NO: 89128 - DNA, 745 bp, Homo sapiens
  misc_feature: GYAE6OF01A9P9O.21.8.A08.1.454.CMB.1.raw
  modified_base (175)..(175): a, c, t, g, unknown or other
  misc_feature (175)..(175): n is a, c, g, or t
  modified_base (336)..(336): a, c, t, g, unknown or other
  misc_feature (336)..(336): n is a, c, g, or t
tcagtcgtcgctcgcacgaccggtgctcgatttagcatactctacagggggtgggctcaggaggcagagctctggggaatctcaccatggcctggacccctctcctgcctccccctcctcactttctgcacagtctctgaggcctctatgagctgacacacgcccaccctcggtntcagtcgtccccaggacaaacggccaggatcacctgctcgtggagtattcattgaaccaaaaagtattacttacgttgttcggttccagcagaagtcacggccacggtccctgtactggtcatccagtggacgccaggtcgacgactacgtccggatcccngagagtacttcctcgtcgtccctacgacgtcctacggaacgggtactacggtacggaccctaccgttacgaacttcgtacgacggggttccggggaccgtaggggtacggaacgtagggttacgaacgtactacggtaacctttacgttaacgtttacggttacccggacccgtaccgtaaggtaaccggtaagggtttacggttacgggttacctagggttaccgggggttaagggggtttacggttaccgggggaacggggttaaccgggtaaccggttaaacggttccgggttacccggttacggttaccgggttaaccgaccggacccggtaaacggtccggttacccccgacccccggttcggtacccgtacctttcccggttccccgttccccggttcccccc

SEQ ID NO: 89129 - DNA, 681 bp, Homo sapiens
  misc_feature: GYAE6OF01BCO92.21.8.A08.1.454.CMB.1.raw
  modified_base (306)..(306): a, c, t, g, unknown or other
  misc_feature (306)..(306): n is a, c, g, or t
tcagtcgtcgctcgcacgaccggtgctcgatttagcatactctacgagggggctgtgggctcaggaggcagagctctgggaatctcacccatggcctggacccctcgtcctgctccccctcctcactttctgccacagtctctgaggcctcctatgagctgacacagccaccctcggtgtcagtgtccccaggacaaacggccaggatcacctgctctggacgattcattgccaaaagtatatacttgtgttccagcagagtcagcaggcccctgtactggtcatccatggagccagtcgacgacncgtccgggatccccgtagagagtacttcgtactcggcccttccagtccgtacgaagggacctaggtcggaccctaccgttcggaacttagttccgaagggttccgggggacccctagggttacgggaacccgtagtcgggaaagtccgttagtaacgttaccttagtttacggttaccgctaacccgaagtacgaacgttaagggtggttaccctaagttaccgggttaagggggttacttaccgggggaccgggtaacgggtaaccgtaagggttaccggtaacccggtttccggttaggtacccgtacgggtaccccgaagggtaccccgtcgtaaccccccggttggttaccctaccgttccgttcccccgg

SEQ ID NO: 89130 - DNA, 857 bp, Homo sapiens
  misc_feature: GYAE6OF01DXTUW.21.8.A08.1.454.CMB.1.raw
  modified_base (237)..(237): a, c, t, g, unknown or other
  misc_feature (237)..(237): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtcttgagcctcctatgagctgacacacgccctacccgtcggtcgtacctacggttccgtacccccgaaggaaccgaaaccggccaggactccacctgctcgnggagtattcattcgaaccaaaagtattacttacgttggttacgtaccagacaagaacgtacgacggccgaccggtcccctgtaccgtcggtcctactccgtaggtacggacggtaccgtacggtaccgaacggtacccgtaccggttaccgggtaacttccccgtaaggtaacgtacgtaccgttttttccgaccgttccgtacccctacgtaccgaccgtacggaaacggtaccgtacgggtacccgtaacccgttaccgttacgtaaccgttaccgtacgggtaccgggtccggggtaacccgtaggggtaacgggtaacgtaaggtacgaacggtccgttaacggttacctttaacgtttacgttaccgtaccgacccgtaacggaacgtaaccgtaaggttacggttaaccggtacgtaacgggttacgggggtaacggggtttcggtacccggggggacggtaaaccggggtaacccgttaaggttccccgggttaccggttccgggttacccggtacgaacccgggaacccgggtaacggtcccccggttaccccgtacccccggtttcgaacccgtttaccccggtttccccggttcccggtttccccccccg

SEQ ID NO: 89131 - DNA, 664 bp, Homo sapiens
  misc_feature: GYAE6OF01CW926.21.8.A08.1.454.CMB.1.raw
  modified_base (131)..(131): a, c, t, g, unknown or other
  misc_feature (131)..(131): n is a, c, g, or t
  modified_base (184)..(184): a, c, t, g, unknown or other
  misc_feature (184)..(184): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (355)..(355): a, c, t, g, unknown or other
  misc_feature (355)..(355): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcactttcngcacagtctctgacggcctctatgacgctagaccacacgcccacccgtcggtntcaggtccacccgaggaaccaacggcagganccactgctcgtggatnttcatacgaacaaaagattattacgttgttcgtacagacgaagaacgtcgacggccgaccggtccctagtacgtggtacatccagtcggacgaccaggtcgaacgactaccgacgggactccgngaacgagtctctcgtcgccacgcgtcgacgaggacacggtccgcctacgtcgtactacgtgacgggtcgggccagggtacgacgtagaacgagtctacgaactttactagtttacgaccgacgtacgaacggtaacgtggtacggtaggacttaacggtaggggtacgggttacgggtcgggaacggaccgggttaaacgtacggggttccgtaacccggtttccgggttagggaaccctccgggacccaacgggttccccgtacccgtaccccgttacggtccctaaacgtttccccggttacccccg

SEQ ID NO: 89132 - DNA, 851 bp, Homo sapiens
  misc_feature: GYAE6OF01DMJJK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagcccaccctcggtgtcagtcgtccccgaggaaccaaacggccaggactccacctgctcgtaggatacttcagttcgaacctaaaaagattattacgttggttcggttaccagtacaaggtaacgtacaacggccgacggtccccctagtaccgtggtacaactccgagtcggacggcccgaaggtccggaacgaccgaccgtaccgggtactccccgtaggacgtcgtaactttccgtcgtcggtcctaccgaacggtcctaacgggaagggtaaccacgtaccgtaacggttacccgtaacggttttacgaacgtttaataccggtaaggttaacggaaacggttacccgaaggggacgtaagggtaaacggggacgggtaacgggtaccgtttaacgggaaaccttttaacgttaaccggtttagtaaacccgtaaaaacggtaacggttaaacggtaactaaacggggttaacgttaaacgggttaaccgttacggttaaggggttttaccggggttacggggtttacccgggaccggggttaaaccggggaaccgtaaacggggtccgtttaacccgggtaaccccggtttacccggttaaaccggggtacccgtaaacccgggaccccgttaaacggggtccccgtttaacccccgggcccccccggtttacggttaaccccccg

SEQ ID NO: 89133 - DNA, 709 bp, Homo sapiens
  misc_feature: GYAE6OF01C8MBN.21.8.A08.1.454.CMB.1.raw
  modified_base (291)..(291): a, c, t, g, unknown or other
  misc_feature (291)..(291): n is a, c, g, or t
tcagtcgtcgctcgcacgaccggtgctcgatttagcatactctacagggggctgtgggctcaggaggcagagctctgggaatctcaccatggcctggacccctctcctcgctccccctcctcactttctgcacagtctctgaggcctcctatgagctgacacgacgccacccgtcggtgtcagttcgtcccaaggaccaacggccaggactccgacgtcgcctcgtagggatattacagttacgaaccaaaaagtattactacgttgttacggttaccagtacaggtaacncgacggccgcggcccttggtactggtacactcagtcggacgccgtagcgaccaacgtcgtacccgggatcccgagacgagtcttcgtcctacggtaccctccgacgtctaccgggacgggtaactaccgggttccgaaccctaccgtttaggaaccttagtaccggacgggtaccgggaccggtacggggtacggacggtacgtacggtaacggtcgtagtacgttacgttagtttacgttacgaccgaacgacgtacggtagtacggttcggtaagtaggtacgggtaagggttcggtacgggacgggacggtaacgttacggttaccggtacccggtcggtttacggacctcgggtaacccgacggtcccgtacccggtacccgtcccggttaccgtacccgtccgttacccccgg

SEQ ID NO: 89134 - DNA, 713 bp, Homo sapiens
  misc_feature: GYAE6OF01AMBZI.21.8.A08.1.454.CMB.1.raw
  modified_base (231)..(231): a, c, t, g, unknown or other
  misc_feature (231)..(231): n is a, c, g, or t
  modified_base (449)..(449): a, c, t, g, unknown or other
  misc_feature (449)..(449): n is a, c, g, or t
  modified_base (496)..(496): a, c, t, g, unknown or other
  misc_feature (496)..(496): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcactttctgcacagtctctgaggcctcctatgacgctgacacacgcccacccgtggtgtcaggttcgtccccaggaaccaaaccggccaaggctccaccgtgcctcgnggactacttccagttacggacctaaaagacttattaccgttggttacgttccagcgaagaacgtccacggtccacggtcctggtacgtcgtcacttccgagtacggaccggccgtacggtaccgaccgtaccgccgtacccggggtaacttccccgtaggaacggtactacggtttccacgttcgaccctccgtacgcccttacgggaacggtaccgngtaccggccctaacgttacacgttcgccgtacgggtccgggtaccgnggttacggacgtagacgtaacgtctgtaacttacgtgtttcgtaccgctaaccgagtacgttagtaccggtgtaacgtgtacgggttaggggtacgttccgggacgggtacgggacgttacggtaccgtaccgttcggttaccggtacggtaccgaccggtaccggttccctcccgggttaaccccgtggtaccctccgggttaccttccccccggg

SEQ ID NO: 89135 - DNA, 804 bp, Homo sapiens
  misc_feature: GYAE6OF01AODJ0.21.8.A08.1.454.CMB.1.raw
  modified_base (419)..(419): a, c, t, g, unknown or other
  misc_feature (419)..(419): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctggtgtcagtcgtccccaggaaccaaacggccaggactccacctgcttcgtggatattcagttcgaaccaaaagaattatacgttgttcgtaccagcgaagacgtcacggccacgggtcccctaggtaccgtggtacacgttaccgagttcggacggaccgtacggtacccgaacgtacccgtaacccggttcccggggtaactccccgtaaggaacggtaacgttactttcctccgccggtaccccncgtaacgtccggtacggaacggggtactacgggtcccggtacccttaacgttcgaaccgtttaacgtcgggtaccgggtaccggggtaccggagggttacggacgtacggtagaaacgtcgtacgttaacttacgttacgttacgtaaccgaccgtaacgaagggtaaccgttaaggtacggtacggtacgttagtaccggggttaagggggttaccggtacgggtaacggggtaccgggtaacttaaccggggttacccggttaacccgggttcgttacggggtaccccgtaaccgggtacccccggtaaggtaccccccggtttccccgggtacccccccggttccgtaccccgggttacccgtttccggtttacccccccgg

SEQ ID NO: 89136 - DNA, 613 bp, Homo sapiens
  misc_feature: GYAE6OF01DUMFO.21.8.A08.1.454.CMB.1.raw
  modified_base (182)..(182): a, c, t, g, unknown or other
  misc_feature (182)..(182): n is a, c, g, or t
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
  modified_base (449)..(449): a, c, t, g, unknown or other
  misc_feature (449)..(449): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacggcccttcctatgagctgaacacagcccacccgtggtntcagtcgtccccgaggaaccaaacggccaaggactcacctgctcgtggatattcgattcgaaacctaaaaagtaacttaattacgtttggtttcggttaccgaagaccaagaagtccaggccacggtcccctgtactggtcatccgatgacgcacgtcgacgacacgtccggactcccgagacgnattctctcgccctcngctacgacggactgcggtcctacgttgacttagccgagggtcgggaccgagggtacggacagtaganctatacttactagttgtaaccgcacgagacgtaagtcgtacggtatagtacgggtaggggttacgtcgggacgggaacggtacgtaaggttccgaccgttcgtaggtcacggaccccgtaggcccttaccggcccccgttgtaccctccgttccgttacccccg

SEQ ID NO: 89137 - DNA, 829 bp, Homo sapiens
  misc_feature: GYAE6OF01C593B.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgagtcctctatgagctagacacacgccctaccgtggtgtacaggtccgaccccgaaggaaaccgaaaccggtccaaggtactccgaaccgtgccttcgtagggtaacttacttcgaagttacgaaaaccgtaaaaagtaacttacgtttacgttaggtttaacggtacaagtaccgaaggtaacgtcgaaccggccgtaaccggtcccgttagtaccgtcggtacctaacgttccgaagtcggacggtaccaacggtccggtaaccgaccgtaaccggtcccgggtaactcccgtaggacgtacgtacctttccgtctaccgtcccgtaccgtagtaccgtacggaacgggtaactacgggtaccggtacccctttaacgtcgaaccgtttcgaccgtacggggtaccgggaccgtaggggtaacggaacgtcgtaacgtaacggtaccgtagtaacctttaacgttagtaacgtaaccctaaccgaacgtaacggtaacgttacggttaacggtaggtacccgtaaggtcgggggttaaaggggttccggtaccgggggaacgggtaaccggtaaacccggttagggttacccggttaccggtaccggttacggtaacccgaccggtaacccggtacgtcccgtaccccggtacccgttcccggtaactcccggttcccgttacccccg

SEQ ID NO: 89138 - DNA, 193 bp, Homo sapiens
  misc_feature: GYAE6OF01CHC54.21.8.A08.1.454.CMB.1.raw
  modified_base (181)..(193): a, c, t, g, unknown or other
  misc_feature (181)..(193): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggacgcctctatgagctagacacacgcccaccgtcggtgtnnnnnnnnnnnnn

SEQ ID NO: 89139 - DNA, 584 bp, Homo sapiens
  misc_feature: GYAE6OF01B84HE.21.8.A08.1.454.CMB.1.raw
  modified_base (221)..(221): a, c, t, g, unknown or other
  misc_feature (221)..(221): n is a, c, g, or t
  modified_base (326)..(326): a, c, t, g, unknown or other
  misc_feature (326)..(326): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattcgaccaaaagatatacgttgttggttccagcagaagtcaggccaggcccctgtactggtcatccatgacggccagtcgacgacacgtccgggatcccngagagacttctctcgccctccagctacgagggacaggtcggacctacgttgacttatcgaggtcgggaccgtagggtcggacgagtacgaacgtcgtagtaacttacgttagttcgttaccgccaacgagtacgtaaggtacgtcggtacgtagtcggtaggggttcgtcgggacggtacggaccgtaaggttccggtaccgttcgttaggcgacgtaccgaggccgtccgccccgtaggtcctacgtcccgttcccg

SEQ ID NO: 89140 - DNA, 675 bp, Homo sapiens
  misc_feature: GYAE6OF01D6TI8.21.8.A08.1.454.CMB.1.raw
tcagtcgtcgctcgcacgaccggtgctcgatttagcatactctacagggggctgtgggctcaggaggcagagctctgggaatctcaccatggcctggacccctctacttcctcccccctcctcactctctgcacaggctctgacggcctcctagtgagctgacacacgcccacccgttgggtcgtcaggttccgtccccgaggacaggaccggccaggactccacctgcctcgtagcagagtggactagaacaaagaatatgtacttagttacggaaccaaacgacggaacgccgagggaccctaccgggtccccttggtttaggttacgtagtaattaaacgtaaataaacggaactacgtaggaacgtaccggcctaagagacgtactccgagacggcttagttcctcgtggactccgagtctacgaaggacacgacgttacgtcgtacgttactacttagacgtagtacgacgtacgaggacggaaggacggacgtcggactaggtatttaccgtacgtacgaaacaagtaggtaacgacgtaaggtaacgtacgttacgtacggttcgggtttacgggtacggtacgggaccgggtaaagacccgacggttacgacccggttacgttacccggaggtacccaaccgggtaccgtccgtcccgttaccccgg

SEQ ID NO: 89141 - DNA, 560 bp, Homo sapiens
  misc_feature: GYAE6OF01E41SB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggtccagcagaagtcaggccaggcccctgtactggtcatccatgagccagtcgacgacactccgggactcccctgagagtatttcctctcgccctccgagctcgagggacagtcggcccaccttgacctagtcgaggtcggggcccgagggtcggacgagtgaagctgactactattgttacgcaccagacagtagtggtacagtcggagggggttatcggggacgggacgggaaccgtaaggttcggaccgttccgttgggacctacggacccgaaggccgtccgcccccgtcggtcctaccgtcgttcccgg

SEQ ID NO: 89142 - DNA, 694 bp, Homo sapiens
  misc_feature: GYAE6OF01A8ELS.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctccccctcctcactttctgcacagtctctgacggcctcctatgagctgacacacgcccacccgtcggtgtcagtcgtaccccaggaccaaacggccaggactccacctgctcgtggagtattcattcgaccaaaaagtatacttacgttggttggttccagacaagtaagtcgacggccacggtcccttgtaccgtcggtacctactcccgagtggacggccgtacggtccggaacgaccgtaccgtccgggacttcccgtaggaacgtacgtactttccctacgtccgtcccgtaccgacgtccgtacggaacgggactacggtccggtaccctaccgttgacttacgcggagggtcgggacccgagggtcgacgtagtaggaacgtcgtacgtacttacgttacgttacgtaccgacctacgacgtacgtaggtacgtcgtacgtaggtacgggtaggggttaccgtcgggacggggtacggtaacggtaagttccggtaccgttcggttaccggcgaccggcccgtacggcccgtccggtcccccgtacggtacctcccgttccgttcccgtcccccgtcccc

SEQ ID NO: 89143 - DNA, 816 bp, Homo sapiens
  misc_feature: GYAE6OF01A68IA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggccttcctatgacgctgacacacgcccacccgtcggtgtcagtccgtaccccgaggaccaaaccggccaggactccacctgcctcgtggactattcattacgaaccaaaagtaattacttagttcggttacgttaccgagtacgtaagtaacgtacgaccgggcccgaaccggtcccccttaggtacctaggtacctactccgtagtacgggaccggcccgtaacggtccgaaccgaccgtaccggtcccgggacttcccgtaggacgtacgttccgttacctcgtaccgtccctaccgtgtacccgtacggacggtactacggtccggaaccccttagttcgaacgttacgtcggtaccggtacgggtacccgtagggttaaccgggaacgttaaggtaacggaacgtccgttaaccgtaacgttacgttaacgtttaccggaaccgtaccgtaaccggacggtaaccgtagggtttaccggtacgttcggtaaacgggttccgggtaaggggttacccgggacgggttacggggtaaccgggtaaccggtttacggtacccgggtttaccggtcggtttaccgggaccgtacccggtaaccgtaaccgggtcccttacccccgggtcccggttaccgttcccgttaacccggtttcccgttaacccccgg

SEQ ID NO: 89144 - DNA, 741 bp, Homo sapiens
  misc_feature: GYAE6OF01BDIS8.21.8.A08.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgcttcttttaagaggtgtccagtgtcaggcgcaactgggtggagtcgtggggggagcagtggtccaggcctggggagtccctgagcctctcctgtgcagcgtctggattcgagttatccgggtcttcctttgccctattcggcctacgtcggggtacccnccgagggtcctccgagggccgaagggggcttaggggaggttgggggtcggacgtaagtttagtcggttgggtaatggaagtggggaagtggaagtagtattaagtttacgttcgaagtaccgttccggtaggaaccgggtcctattaccaaccttacgtccttacccgaaggtaaccgaactaagtaccggaacctaaaccgaaacccacgtaccgttacgttaacttccgtttaacgaaacgtccggaacccggtccgtaggaacgtacggacccgggtaacggaccgtaaccgggtacttaacgtacggttaacgtttacccgtaggttaaccggtcggtttacccgtttttacgggtacgttaaccggggttacgggggacccccggttaaacggggtaacccccggtttcggtacccccgg

SEQ ID NO: 89145 - DNA, 727 bp, Homo sapiens
  misc_feature: GYAE6OF01CYIA8.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctcgtgacggcctcctatgagctagacacacgcccaccgtcggtgtcacgtccgacccgaaggaaccaaaccggccaggtactccaccgtgacttcgtaggatacttcattacgaaaccaaaaagtacttacttacgtttgttcggtaccagacgaagaagtcgacggccgacggtccccttagtacgtggtacactcagtcgacggcctaggacgaaccgacgtaccgtccgggacttccgaggaacgacttacgttctcgtcgaccctacgcgtacctcggaacggactaggtcgacctacgtaggactacgcggacgggtcgggaccgtagggtacggacgtagacgtaacggtctacgggtaacctttaagtcggtttaacgaccgacctaacgaaggtaccgtaaggttacggtcgtaacgacgggtacggggtaaggggtttacgacgggggtacgggtaacgggtacgttaaccgggttcggtaccccggtttcggtacggtccgaaccgggtaccccggtaacttcccgggtacccccgtaccggttacccggtacttacccggttccccgttcccccggg

SEQ ID NO: 89146 - DNA, 717 bp, Homo sapiens
  misc_feature: GYAE6OF01AMBDQ.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggagcagtcggtccaggccgtgggacggtccctgacgcctctcctgtgcacggcgttcgtggcttcgagttgtccggtcttccgttgtaccacgttcgaccgtacgtcgggtcccgaccgaggtccgtccgagggacgaacggggctggggtaggtcgggtaggccgtaattcgtcgtggtagtggagtgggaagtcggaagtagttagttagtttacgtaccgagtacccgtccgggttaggaaccggggtaccttactaccgtaaccgtagttacccgtacccgaaggtaaccgtaactaaacgtccgaaccctaacgaaaccgtacctaccgttacttaacgtaccttaacgaaacgtcggtaacccggacgttacggacgtacggacccgtacgggacgtaaccggtcgttaagtacgttacgtaacgttacggacgttcggttaccggttacggttaccgtaccgggttacggggtaacccgtacggggtacccgttggtaaccccg

SEQ ID NO: 89147 - DNA, 790 bp, Homo sapiens
  misc_feature: GYAE6OF01CP4M1.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggccctcctatgagctgacacacgcccacccgtcgggtgtcagttcgtccccaaggaccgaaaaccggccaaggactccaccgtgcctcgtaggatattcattacggaaccaaaaagtattatacgtttgttcggtaccagacaagtaacgtcgacggccaccggtcccttgtaccgtggtaccactccgagtcggacgaccacggtccgaacgtaccgtaccgtccgggaaccttcccgtagacgtacgtacttctctcgtccctccgaacgtccgtacggacgggtacacggttccggaccctacgttacgtaacgttacgtaccggtcggggtaccggggtacccggaggggttaccggacgtaacggtaggtaaccggtcgttaacggtaaaccgtttacgttaagtttacccggttacggacctaaccgtaagacgttacgggttaggttacggtaccgtaagggttacggggtaagggggtttacggtaaccggggtacggggtaacgggtaaacccggttagggtaccggttaccccgggttcgttaccgggtaccgacccgggaaccggtaaccggtcccgtaaccccggttccccgtacgtaccccttcgtttcccgttaccccgttacccccgtcccccgg

SEQ ID NO: 89148 - DNA, 796 bp, Homo sapiens
  misc_feature: GYAE6OF01D6ASQ.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctcgcctcccccctcctcactttctgcacagtctctggacgcctcctatgacgctgacacacgcccacccgtggtgtcagtcgtaccccgaggaaccaaaccggccaaggactcacctgctcgtggatacttcattacgaaccaaaagtattacttacgttgttacgtccagacgaagacgtcgacggccacggtcccctagtacgtcggtacacgtccagtcggacggcgtacggaccgacgacctaccggtcccgggtactcccgtaaggacggtatacctttccgtctaccgaccctccgagtccgtacggaacggtacaccgggtcggtacccttaaccgttacgtaacttacgtcggtaacgggttccggggaacccgtaggggtaacggaaccgtaagtacggtaacgttccgtaacgttaaccgtttaaccgtttagtttaaccgtaacccgaccgtaaacccgtaaggttaacgtaagggtttaacggtacggttaacgttacgggtaacggggtttacgggggttaccggttaccgggggtaaccggggaaacggtaccggttaacggttacccggtaccggtttcccggtagggtaccccgaacggtaccccggtacggtaccccgttccccgggtaaccccgtttcgggtacccttacccggttccgttaaccccccg

SEQ ID NO: 89149 - DNA, 727 bp, Homo sapiens
  misc_feature: GYAE6OF01AUHVY.21.8.A08.1.454.CMB.1.raw
  modified_base (157)..(157): a, c, t, g, unknown or other
  misc_feature (157)..(157): n is a, c, g, or t
  modified_base (166)..(166): a, c, t, g, unknown or other
  misc_feature (166)..(166): n is a, c, g, or t
  modified_base (473)..(473): a, c, t, g, unknown or other
  misc_feature (473)..(473): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggccttcctatganctagacacncgcccaccctcggtgtctagtccgtaccccaggaaccgaaaccggccaaggtactccacctcgctccgtggatattactattcgaaccaaaagtacttaattacgttcgtttacggttaccgagtaccgaagtaacgtcgaccggccgaccggtaccctgtacgtcggtcacttccgagtaggaccggccgtacggtaccgacgtaccgaccgtacccgggtactccccggtagacgtaacgtctttcctcgtaccgtccctacgacgtcctacggaacgggactacgggtccgtacctaccgttanaacgttgtaccggtcgggttaccgggacccgtaaggggttcggaacggtaacgtcggaaacgtctacgtactttacgttacgttacgtacgacaccgacgtaacgtagtacgtggtacctagggttaccggtaggggtacggacgggtacgggtaacgtaccggtacgttaccggtacccgggttcgttacggacggtacccgaccggtaccgccgtcccgggtacccctacggtccttacgtccccgttcccg

SEQ ID NO: 89150 - DNA, 761 bp, Homo sapiens
  misc_feature: GYAE6OF01CDET6.21.8.A08.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattagacctaaaaaatttnttggtttttaggaccagcagaagtcaggccaggccctgtgttcggtcatccatgaggacgaggagaccgacccgtaccgggactcccgtgagacgtacttccgtctcggtctacctaacgtcggacggggtacgggtcggtacctacggtttagtacttcgtacgaggggttccgggggacccgtaggggtacggggagggtaacgtagggaacgtcgtaacggtaaccttacgttacgttacgttacctacgacgtacaaggtaacgacgtacgtaaggttcgggtacctaggtaccggggaacgggggtaccgtaacgggtttccgggggaaccggggtaacggggtaacccggttacgggggttaccggtaaccccggttaccgggttacggtacccggaaccggtacccccggtaacgggtccccgttccccggccccccgttaccgggttaccctaacccgtttcccggtttacccccggtttccccccgttccccgtttcccccgtttacccccgg

SEQ ID NO: 89151 - DNA, 756 bp, Homo sapiens
  misc_feature: GYAE6OF01DCHYE.21.8.A08.1.454.CMB.1.raw
  modified_base (181)..(181): a, c, t, g, unknown or other
  misc_feature (181)..(181): n is a, c, g, or t
  modified_base (397)..(397): a, c, t, g, unknown or other
  misc_feature (397)..(397): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacggcctcctatgagctagacacacgcccaccctcggtntcagtcgtaccccaggaacaaacggccaggactccacctgcttcgtaggatacttcagttacgaacctaaaaagtattaacttacgtttggttacggttacccaagacgaagtaacgtcgacggcccgtacggtccccctagtacgtcggtacactccgagtacggcggacctacggccgaccaccgtaccgtcccgggactcccgtagagtactntttccctcgtccgtccctaccgtacgccgtacggacggtacgtacggtccggtaccccttaaccgttacgtaaccgtacgtaccggtaacggggtcccgggaccggtaggggtaccggaacggtagtaacggaacggtcgtacgtaacgttacgttacgttacgttaaccgacctaacgacgtagtacggttaggtcggtacgtacggtacgggtaggggttacggtcggggacgggtaaccggtaaccgtacgggttaccggtaccggttccggttaccggtaccgtacccggaccggtaccggtcccggttcccggttcccccggtacgttcccgtaccgttccccggttcccccgg

SEQ ID NO: 89152 - DNA, 733 bp, Homo sapiens
  misc_feature: GYAE6OF01BGWCD.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctcgtgacggtcctctatgagctgacacgacgcccacccgtggtgtcagtccgtaccccgaggaaccaaacggccaggactccaccgtgctcgtaggatattcagttcgaaacaaaagtattattacgtttgttcggtaccagacaagaagtcgacggccacggtccctgtacgtgtcactccagtcggaccgtcgaaggtccgaacggacctaccggtaccgggtactcccgtaggaacgtacgtacttccgtcgtccgccctacgacgtccgaccggaggaccaggtccgacctaccgttacgtacttacgtacggtcggggtcgggaccggtagggtacggaacgtaggaacgtacgtccgtagttaaccgtttaacgttacgtttacgtaccgacgaaccgagtaacgtaggttaacggttcggtacgttaacgggtcgggtaagggggtttaccgtcggggaacgggtaacggtaaccggttacggttacccgggttacccgttcggttaccgggaccgtaccgggacccggtaacgttccccgggtcccgtaccccggttaccgtaccttcccgttaccccggtttcccccg

SEQ ID NO: 89153 - DNA, 743 bp, Homo sapiens
  misc_feature: GYAE6OF01EI1ZO.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccacccgtcggtgtcagtcgtcccaggaaccaaacggccaggatccacctgctcgtggagattcattgaaccaaaaagtattattacgtttgttcggttaccagacagaacgtcgaggtccgaacggtcccttagtacgttcggtctacgtccagtcggaacggtaccgtaggtacccgacgaaccgtaccggtacccgggacttcccggtagacggtaagttactttcctcgtaccgcccttaccgacgtacgtacggaacgggtaccgtaggttaccggtacccttaccgttagtaaccgttacgtcccgggtaacggggtccggggacccggtacgggtacggtacgtacgtaggacgtacgtacgtaccgttaattacgttacgtaccgacgaccgtacgaacgtacgtaggttcgtacgtacggtcgggtaaggggttacgttacgggacggggtacggtaacggttacgggttacgtaccgggttccggttacggtaccgtacggacccggtaaccggtccgtacccgtcccccggttacggtacccttccgtccgttccccgttccccgtccccg

SEQ ID NO: 89154 - DNA, 694 bp, Homo sapiens
  misc_feature: GYAE6OF01DTZKY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacacgcccacccgtcggtgtcagtcgtaccccaggaacaaacggccaggactcaccgtgctcgtaggagtattcattacgaccaaaaagtatattacgttgttcggttacaagcgaagaacgtcgaacggccacggcccctagtacgtcggtacatccagtcggacgccaggtccgacgacaccgtccggaactcccgtagagacgtcttcctacgtcgaccctccgacgccgtacggaacggactacggtcggacccctaccgttagaaccttagtccgtaggggtcccggggaccgtaaggggtcggaacgtagtacgaagtcgttacgtacttacgttagttcgtaaccgctaaccgagaacgtagtacgtacggtacgtagttacgggtaaggggttacgttaccggggacgggtaacggaccgttaacggttccggtacccggttcggttacggacggacccggacccggtaaggcccccgttaccggaccccccgtttggtacccttccgttacccgtttccccccggg

SEQ ID NO: 89155 - DNA, 732 bp, Homo sapiens
  misc_feature: GYAE6OF01AXIZW.21.8.A08.1.454.CMB.1.raw
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (161)..(161): a, c, t, g, unknown or other
  misc_feature (161)..(161): n is a, c, g, or t
  modified_base (164)..(164): a, c, t, g, unknown or other
  misc_feature (164)..(164): n is a, c, g, or t
  modified_base (166)..(166): a, c, t, g, unknown or other
  misc_feature (166)..(166): n is a, c, g, or t
  modified_base (170)..(170): a, c, t, g, unknown or other
  misc_feature (170)..(170): n is a, c, g, or t
  modified_base (173)..(173): a, c, t, g, unknown or other
  misc_feature (173)..(173): n is a, c, g, or t
  modified_base (182)..(182): a, c, t, g, unknown or other
  misc_feature (182)..(182): n is a, c, g, or t
  modified_base (193)..(194): a, c, t, g, unknown or other
  misc_feature (193)..(194): n is a, c, g, or t
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagtcgtcgctcgcacgaccggtgctcgatttagcatactctacgagggggggagaggagcccagcactagaagtcggcggtgtttccattcggtgatcagcactgaacacagaggactcaccatggagtttgggctgagcgtgttcnctagctnttagngtncntgcngcncagtggtgngtcgtggggannagnggtccagccgtggacgcctgacgtctctcgtgtcacngtcgtctgattccgagtcgtccgtcttccgttcgacctgtcgcgtaccgtcgggtacccgaccgaggtcccgtaccggaggtacggtaaccgggtctgggtacgggttcgggtaccggacggttatttaccggcgtttaggggtaagttcggaagttacggggaaggttgaacggtaagttagtttaacgttactaccgaaacggttccgtaccgggtaagaccggtaccgtacgttaccgtaccgtacgtaccgtaccgaacgtaacgtaacgtaacgtaccgtaaccgtaacctaaccgtaaccgttaacgttaacttaacggggggggggggttaaccttaaccggtaaccggtaaccggtaaccggtaccggtaacggtacggtaacggtaaccggacggtaacgtacggtacgttacgtacgttacgtacgtacgtacggtcgttaccgttacgtacgtacggtacggtaccggtacggtcccgtcggtaccg

SEQ ID NO: 89156 - DNA, 697 bp, Homo sapiens
  misc_feature: GYAE6OF01DM74L.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccacccgtggtgtcagtcgtccccaggaacaacggccagactcacctgctcgtggagtattcattacgaactaaaaagaacttattacttggttacggttaccagcgaagaacgtcgacggccacggccctagtacgtggtacatccagtgacgccagcgacgactacgtccggactcccgtagacgtacgtctttacctcgtaccgtcctaccgacgtcctacggaaggaactacggtaccgacccgtaccgttacgaaccgttagtccggtaaggggtccgggacccgaagggtacggaacgtagtaggtaacgtccgtacgtaacttacgttacgttacgttaccgacctaacgacgtacgtaaggtacggttacggtacgttacggtacgggtaacgggttacggttcggggacgggttaaccggaacggttacggttaccggaccggttccgttacggaccgcggacccgtacggacccgttcccggtaccccgtccggttaccctcggttcccggttacccccgg

SEQ ID NO: 89157 - DNA, 655 bp, Homo sapiens
  misc_feature: GYAE6OF01EJTQV.21.8.A08.1.454.CMB.1.raw
tcagtcgtcgctcgcacgaccggtgctcgatttagcatactctacaggggggtgggctcaggaggcagagctctgggaatctcaccatggcctggccctctcctgctcccctcctcactttctgcacagtctctgaggcctcctatgagctgacacagccaccctcggtgtcagtcgtcccaggacaaacggccaggactcacctcgctcgtggagtacttctattacgccctaaaaaggaattaagtaacctttgttagggtttcccaaggctaggaaggtcaaggcccagggccctgactgtcattccatgagcagtcgacgcactccgggatcccgtgacgagtacttctctcgcctcgacgcgtcgacggacgtacggtcgtaccgtaccgttacgtacgtacgtcgtacggtcgggaccggacgggtacggtacggacgtagacgcgtacgtacgtacgttacgttacgtaccgaccgacgacgaacgtacggtaggtaggtcgtacgtacggtacggggttacggttacgggtacgggaacgggtacggtacggttaccggtaccggttccggttcggtacgaccggacccggacggtccgtacccgtccccggtaccggtacccgttccgttcccgttcccgtccccg

SEQ ID NO: 89158 - DNA, 900 bp, Homo sapiens
  misc_feature: GYAE6OF01AU5TC.21.8.A08.1.454.CMB.1.raw
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactgggtggagtcgtgggggagcatggtcccagcctggggaggtccctgacgcctctcctgtcgcaggcgtctggtacttcgagttactcgggtcttccgtttgccctaagtcgctaccgttcgggggtccccgaccgtagggtccctacccgaagggggtaccggaaacgggggggtctgggggacgggttggggggtcgggtaccgtaagttttacgtcggttgggtaaagttggtaagtaggggtaaaggttggaaaggtaacggtaatttaagtttaaactttaccgaaacgggtaaccccgtttcccggggtaaaggggtaaaaccggggggtcccgttaacgttacccgaaccccgttaatttaccccgttaacccgaagggtaaaccggaaacctaaaccgttaccgggaaaccccaaaaaccgtaaaccctaaacccgtaacgtttaacggtaaccttttacccttaaaccggtaaaacgtttacccggggaaccccgggttaccgtacggggaaaccgggaacggaccccgggtaacggaacccggtaaccgggtactttaacggttaacggtttaaacttaaccgttaaccgggttaacggggtacgtttacgggtttttaccggggtaaccgttaacgggttacgggggggtaaaccccggtaaaccggggttaacccccggttagggggttaacccccg

SEQ ID NO: 89159 - DNA, 756 bp, Homo sapiens
  misc_feature: GYAE6OF01C01R0.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtntcagtcgtccccaggacaacggccaggactcacctgctcgtggagtattcagttcgaaccaaaaagaattatacttggttcgttcagcagaagtcaggccaggcccctgtactggtacatccagtgacgtcgaggtcgacgacgaccgtccgggactcccgtagacgagtacttcgtactcgtccctcgtacggccgtacggaacgggaccgtacgggttaccggaccccttaaccgtttcgtaaccgttacgtaccggtacggggttaccggggtacccccggtaaggggttacgggaaaccggttaacggttacggtaaacggtccgtttaacgggtaaccgtttaaccgtttaacggtttacggtttacccgaccctaaccggaacggttaacgtacggttacgggtacggttacgaggttaccggggtacggggtttacggtacggggaccgggtaacgggtaaaccggttacggtttaccggtaccggttccgtttcgggaccgtacggtaccccgtacgggaccgttccccgggtacccccgttaccgtccgttacccgttccgttacccccgg

SEQ ID NO: 89160 - DNA, 710 bp, Homo sapiens
  misc_feature: GYAE6OF01DIYVQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggcctctatgagctgacacacgcccacccgtcggtgtcagtcgaccccgaaggaaccgaaacggccaaggactccacctgctcgtggatattcattacgaacaaaaagacttattacgttgttcggtacagcgaagaacgtcgacggccacggccctgtactggtcactcagtcgacgcagtcgaacgactacgtccggactcccgaggacgaacgtactttccgcgtccgtccctaccgacgaccgtacggaacgggaactacggtaccggacctaaccggttagtaccgtacgtcgtaacgggtcgggtaacccgaggggtacggaacgtagtaggaacgtcgtaacgtaacttaacgtttaacgtttacggtaacgtacccgaacgtaacgtaacgtaggtaacggttcggtaacgtagttaccggggtaaggggtaccgttcgggggaacggtaacgggtaccgttaaaggtaccggtaaccggttcgtaacgggaccgtaccgggaaccgtaaccggtccgtacccggttaccccgtacggtacctaccgtccgtttaccccg

SEQ ID NO: 89161 - DNA, 898 bp, Homo sapiens
  misc_feature: GYAE6OF01DLOVF.21.8.A08.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagcatactctacagggggctgtgggctcaggaggcagagctctgggaatctcaccatcggcctcggacccctctcctgtcctcccctcctcactttctgcacngtctctgacggtcctcctatggacgctagaccacacgccctacccgtcggtcgtccacggtccgtacccgaggaaccaaaccggcgacggactaccaccgtcgtccgtcgtacggtacgtactttactaacgttacgaaaccgaaaaagttacttaacgtttaacgtttcggttacggttaccgaagtacgaaggttaacgtccgaacggaccgaccggttaccccgttacgtacggttacggtacctaccgtaccgaagttacgggaccggtaccgtaacgggttaccggaaccgtaaccggtaacccggttccgggtaaccttcccggtaaggtaacgtacggttaccttttccgtcgtcccgttacccgtacgtaaccggtccgttaaccggaggttaacccgtacgggttccgacccgttaacgttcggttaacgtaccggttaccgggtacgggtaccggggtaaccccgtaaggggtaccgggtaccggtaaagtacgggtaacgtcggttaacgtaacgtttacgttaacggtttacccgtaacgaccgttaaccgaggtaacggttaggtttaccggaacgggttaccgttacggttaaacggggggttcgggttaaccgggtacgggtaaccggggtaaccggttacgttaaccggggttacgtacccggttcccggttaagaccgttaccccggaccggttaccggccccgttacggtccccgttaggtaccctccgttcccgttcccccgg

SEQ ID NO: 89162 - DNA, 988 bp, Homo sapiens
  misc_feature: GYAE6OF01B0QFE.21.8.A08.1.454.CMB.1.raw
tcagtcgtcgctcgcacgaccggtgctcgatttagcatactctacagggggctgtgggctcaggaggcagagctcgtgggaatctcaccatggcctcggacccctctcctgcctccccctcctctactttctgcactgtctctgacgcctctatgacgctacgacacacgcccaccgttcggtctcgtaggttccgaccccgaaggaaccgaaaccggccaaggtactaccaccgtgccgtacgtaggtaacgttacttctaacgttacgaaacctaaaaagtaacttacgtttaaccggtttggtttacggtaaccgaaggtaccgtaaacggtaacggtaccggaaccgggtacccgtaaccgggtcccccgtttaaggttaaccggttcggttaacctaacgttaccgtaacggttacggaaccggtaccgtaacgggttaacccgaaccgtaacccggtacccggttaccgggtaaccgttacccgaaggtaacggtaacggtttacctttccggttaccgtccgttaccccgtaccgtacgtacccggttaccggaaggggtacccgtacggggttaccgaacccgttaaccgtttacggtaaccgttacggtaaccggtccgggggtttacccgggaaccggtaaggggttaccgggaaacgtaacggtaacgggtaaccgttaccgttaaacgttaaccgtttaacggtttacgttaaacccggtaccgaccgtaaacccggaggttaacccggtaagggttaccggttaacggtacggttaaacggggttaccggggttaacggggtttccggtaccgggaaaccggggttaaccggtaaaccgtttggggttaaccccgttacccgggtttcgttaacgggtacccggtaacccccgggaccgggtttaacccggcccggtttacccccgccccggttaaacccggttaccgtcccgtttacccccggttaccccccgg

SEQ ID NO: 89163 - DNA, 657 bp, Homo sapiens
  misc_feature: GYAE6OF01DJJJ8.21.8.A08.1.454.CMB.1.raw
  modified_base (642)..(642): a, c, t, g, unknown or other
  misc_feature (642)..(642): n is a, c, g, or t
tcagtcgtcgctcgcacgaccggtgctcgatttagcatactctacagggggctgtgggctcaggaggcagagctctgggaatctcaccatggcctggaccctctcctgcctccccctctcactttctgcacagtctctgaggcctcctatgagctgacacagccaccctcggtgtcagttcgtaccccaggaacaaacggccaggactcactgctcgtggatattcattacgaccaaaagatattacttggttcggtcagcaagaacgtcacggccacggcccctgtacgtcggtacatccatggacgccgtagtccggacgacgaccgtcccgggactcccgtagagtagtacttcgtcctcgtccctccgacgtctacggacgggtacgtacggtcggacccctacgttacgaaccgttatccgtacgggtccggggaaccccgtaggggtacggacgtagtacggagtccgtagtacttacttagttacgtaccgacaccgagtacgaggttacgtcggtacgtacgtgggttacggggttacgtcgggacgggtaacgggaacgttaacggttccgtcggttaccggttcggacgtcgtacccggtacggacccgttccggaccccgttccggtaccncgttcccgttcccgg

SEQ ID NO: 89164 - DNA, 733 bp, Homo sapiens
  misc_feature: GYAE6OF01AEJ2O.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccaccctggtgtcagtcgtccccgaggaccaaacggccaggactccacctgctcgtggagtattcattcgaaccaaaagaattatacgttgttcggttccagtcagaagtcacggccacggccccgtagtacgtggtcatccagtcgacgccgaggtccgacgacctacgtcccgggactcccgtaggagaggtacttccgttcgtcgcccctcgagtcctacggaggtacctaggtcgacccctacttacgacctagtcgaggtccggggaccgtagggtcggaacgtagtacggaacgtcctaggtaacttacgttacgtttacggttaaccgaccgaaccgtaacgtacgtagggttaacggtcggtaccgtaacggttacgggttaaggggggttacgttaccggggacgggtaaccgggtaccggttaaacgggttcccggtaacccgggtttaccggttcgggttaacccggacccggtacccccggtaaagggttccccgttacccccggtcccccggttacccggttaccccgttacccgttcccgttttacccccgg

SEQ ID NO: 89165 - DNA, 779 bp, Homo sapiens
  misc_feature: GYAE6OF01BFN7R.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtggtgtcagtccgtaccccgaggaaccaaacggccgaaggactccaccgtcgactcgtaggacgtacttacattacgaaccaaaaagtaattaacgttacgtttggtttacggttaccaagtacgtaagtaacggtccgaacgggtacccacgggtcccccgttaggtaccgttcggtactactccgagtcgggaccggaccgtacggtaccggaaccgaccgtacccggtaccgggtaccttacccgtaggaacgtacgtacctttccgtcgtcccgtacccctaccggaacgtccgtaacggaaccggggtacctacgggtacccgtacccttaccgttacggtaaccttacgtccgggtacggggtcccgggacccggtagggtacggtaactaggtagtaacgtccgttaacgtaactttacgttacgtttccggtaaccacgtaacgagtaacgtaggttacgtacggtacgtacgggtagggtaacggggttacgtccggggaacggtaacggtacgtacgttaccggtacgttcgtacggccgacccggtaccgacgtcccgtacccgtcccgtacgtcctcccgtccgttacccccg

SEQ ID NO: 89166 - DNA, 674 bp, Homo sapiens
  misc_feature: GYAE6OF01AVXTI.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtntcagtcgtccccaggaccaaacggccaggatccacctgctcgtggagattcattgaccaaaagatatacttgttggttcagcagagtcgaggccacggcccctgtacctggtcactccatgacggccagtcgacgacaccgtccgggactccctgagacgtactttctctcgccctccgagtcctcgaggacaggtcggaccctaccgttgacttacgtcgacggttcgggggacccgtaggggtacggaaccgtagtacgggaacgtaccgtacggtaactttaactacgtttcggttaacccgcaaccgtagaacgtaggttacggtcggtactacggttcgggtaagggggttacgttccggggacggggtacgggtaacccgttaacggttccggttaacccgttcccggtttagggaccgtacccggccccggtaaacggcccgtaccccgggttcccccgttacccgggtccttcccgtcccgtttcccccg

SEQ ID NO: 89167 - DNA, 698 bp, Homo sapiens
  misc_feature: GYAE6OF01D83IU.21.8.A08.1.454.CMB.1.raw
  modified_base (128)..(128): a, c, t, g, unknown or other
  misc_feature (128)..(128): n is a, c, g, or t
  modified_base (220)..(220): a, c, t, g, unknown or other
  misc_feature (220)..(220): n is a, c, g, or t
  modified_base (499)..(499): a, c, t, g, unknown or other
  misc_feature (499)..(499): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgaggcctcctatgagctgacacagcccacctggtgtcagtcgtccccaggaaccaacggccaggactcacctgctctgganattcattcgacaaaagtattatacgttgttacgttcagcaagaagtcaaggccacggcccctgtacgtggtactacgtccaagttggacggaccgtacgtaccggaccgtaacgtaccgtacccgggaacttccccgtagggaacgtacggtactttcctccgttacggtccccttaccgaagtccttacgggacggtaactacgggtcggtaccctaacgtttcggaaccttacgtaccggtacgggttccggggacccgtagggtacgggaaaccgngtacggaaagtccgtagtaacgtttactagtttcgtacgaccacgtacgacgagttagtgacgtagttcgggaggggttcgtacgggcggaacgggtacgacggttaccgtaaccggttcgttacggtaccgtaccgtacccgaaaggttccccgtaccggtccccccgttacggttacctccgttaccggttcccccg

SEQ ID NO: 89168 - DNA, 995 bp, Homo sapiens
  misc_feature: GYAE6OF01EIPGC.21.8.A08.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagcatactctacagggggctgtgggctcaggaggcagagctctgggaatctcaccatggcctcggacccctctcctcgcctccccctctctactttctgcacntctcgtgacgtcctactagtgacgcgtagacaccgtaccgcccgtacccgttcggtcgtacgtacggttccgtaccccggaagggaaccgaaaaccgggcccgaaggaccttaccgacccgttgtaccgttccggtaggtaacttactttaccgtaattaccggaaactaaaaagtaactttacgtttaaccgtttggtttccgtaccgtaagacgtaaggtaacgtcggacggtacccgtaccggtccgttacggttaccgttcggtacctacgtacctacggtacgggaccggtccgtaaccggtacggaacccggaaccgtacccgggtacccgggtacgttacccggtagacggttaaccgtctttcccgtactccgtacccgtaccgacgtccggtaggaacgggtaacgttacgggtcccgtaacccgttacggttataacccggtacggttacggtaccggggtccccggggttaacggggtaggttaacggggtaaccgttaagggtaccggaaaccggtttaccgtaccgtttaaaccgtttccggtttaacggtttaacccgttacccgaacggtaaaccggttaacggttaacggtcgggtttaacggggtacgtttaacccggtacggggtttacgggggttaacgggtttaacgggacccgggggtacggggttaaaccccggtaacgggtttcggttaaaccccggggtttcccgttaacggggttaccccggtacccggtaaaccccggtaccccgggggttacccgttacccccggtacccccgggggttacccccttaaaccggtttcccgtcccccggtttccccggttttaacccccccg

SEQ ID NO: 89169 - DNA, 679 bp, Homo sapiens
  misc_feature: GYAE6OF01BUJEC.21.8.A08.1.454.CMB.1.raw
  modified_base (219)..(219): a, c, t, g, unknown or other
  misc_feature (219)..(219): n is a, c, g, or t
  modified_base (321)..(321): a, c, t, g, unknown or other
  misc_feature (321)..(321): n is a, c, g, or t
  modified_base (621)..(621): a, c, t, g, unknown or other
  misc_feature (621)..(621): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctggtgtcagtcgtccccaggacaaacggccaggactcacctgctcgnggatattcattgaccaaaagatatacttgttcggtccagcagaagtcacggccacggccccttgtaccgtggtaccatccgatggacggccagtcgacgacnccgtacccgggatcccgtggaagtacgtacttcctacgtcgccctccgagccgtacgaagggtcacggtccggaccctacgtttacgacttacgtaccggacgggtccgggggaccctaggggttacgggaacgtaaggtaggtaacgtccgtaaggtaaccttacgtttaagtttccgtaaccgacctaaccggagtaacgtaggtacggttacgtacgtagtacggggtacggggttacgttccgggacgggtaacgggtaaccttagggttaccggtacccgtttcggttcggaccnccggaacccgtacggtccctcccggcccccgttacggcctacccgttcgttacccccg

SEQ ID NO: 89170 - DNA, 717 bp, Homo sapiens
  misc_feature: GYAE6OF01E5Z2A.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcactgctctggagattcattgaccaaaagatatacttgttgtcagcagaagtcagccaggccctgtactggtcatccatgacggccaggtcgacgacaccgtcccgggatccccgtaggagacgtacgtttcctcctcgcccttaccgacgtcccgtcgaacggggtacctagggtccggacccctaaccgtttacgacttacgtccgtaacgggtcggggaccccgtagggtacgggaacgaagtaggaacgtaccgttacggtaactaaccgtttaactttcgggttaaccgtacccgaaccgtaacggaacgtaggttaacgggttcgtaccgtaacgttaccgggtaggggggttacgttaccggggtaaccggggtaacggggtaccggttaaacggttaccggtacccggttccgttacgggtacccgtaccggtaccccggtaacgggtcccgtacccggtcccccggttaccggttcccctacccgttccccgtttaccccggg

SEQ ID NO: 89171 - DNA, 726 bp, Homo sapiens
  misc_feature: GYAE6OF01EUBP9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccttcggtgtcagtcgtccccaggacaaacggccaggatccacctgctctggagtattacattgaccaaaagtatacttactttgttggttccagcagtaagtcgaggccacggcccctgtacgtggtcatccagtggacggcctagtccggacgacctacgtcccgggtattccccgtaggagtacgtactttcgtccgttcggccctccgagtccgtaccggaacgggtaccaacgggtccgaccccgtaacctttcggaacttacgtaccggacgggttcccgggggacccgtaggggttcggaacggtagtaggaacgtcgttacgtaacctttcgttagtttaccgttaccgaccaaccgtagtacggtaagtacgggttcgtacgtaagttcgggttaagggggtcttaccggggggtacgggtacgggtaaccgttacggttacgggtaccccgttcgggttagggtaccctaaccgggaccccgtaacgggtccccgttccccgggtaccccccgttggttaccccgtccgttcccggtttaccccccg

SEQ ID NO: 89172 - DNA, 805 bp, Homo sapiens
  misc_feature: GYAE6OF01D3GIQ.21.8.A08.1.454.CMB.1.raw
  modified_base (443)..(443): a, c, t, g, unknown or other
  misc_feature (443)..(443): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagtctgacacacgcccaccgtcggtgtcaggtcgtaccccgaggaaccgaaacggccgaggactccacctgtcctcgtggagtacttcgattacgaaccaaaagtaattacttacgttggtttcggtaccagacgtaagaacgtccgacggccgtacggtccccttagtacgtcggtcacgtaccgagtcggaccggccgtacggtcgaaccggtactaccggtccgggtactcccgtaggacgtagtaccttctcgtccgtcctaccgagtccgtaacggacgggaacncgggtccgtaaccctacgttaacgtacttacggtcggtacgggtccggggacccgtaggggtaccgggaacgtaagtacggtaaccggtcttaacgggtaacttttaacgtaacgtttaccggaacccgaccgtaacggtaacgtaacggtaaggtttacgggtacgggttaacgtaacgggttacggggttaaggggggtttcccgtacggggggaacccgggtaacgggtaacccggttaaacgggttccgggttacccggttcccggttagggttacccgacccggtaacccggtaacggttcccgtcccccggtaaccccggttcggtaaccccgttccgttcccggttaccccccgg

SEQ ID NO: 89173 - DNA, 606 bp, Homo sapiens
  misc_feature: GYAE6OF01ELG03.21.8.A08.1.454.CMB.1.raw
  modified_base (335)..(335): a, c, t, g, unknown or other
  misc_feature (335)..(335): n is a, c, g, or t
  modified_base (380)..(380): a, c, t, g, unknown or other
  misc_feature (380)..(380): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctggtgtcagtcgtcccaggacaaacggccaggatcacctgctctggagattcattgaccaaaagaatatacttgttcggtccagcagaagtcaggccacggccctgtactggtcatccatgacggccagtcggaccgacaccgtccgggatccctgacgagtacttccnctcgccttcgagcctcgagggacaggtcggcctaccttgacctancgtaggtcggggcccagggtcggacgagtaggaagctagaacttactattcgtacgcaaccagactagtggtgtacagtacggagggggttacgttccgggacgggtaacgggtaccgtaaaggttcggtacccggttccgttcgggtaccgaccggtaccgacggtacccgccggtcccccccgtcgggtaccctaccgttccgttcccgttcccctaccccccg

SEQ ID NO: 89174 - DNA, 780 bp, Homo sapiens
  misc_feature: GYAE6OF01DGFL5.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacacgcccacccgtcggtcgtcacgttcgtccccgaaggaccaaaccggccgaggtactccaccgtgcctcgtaggacgtatttcaattacgaaccaaaaagtattattacgtttggtttcggttaccagaccgtaagaacgtacgacggacccacggtccccctagtacgttggtaccactccgaagtcggaacgcccgaaggtccgaaccgaccacgttcccgggtactcccggtaagagaacgttcttactcgtcgacccctcaggtccgtacggacggactacggtccgaccttacgttcgaacttcgtaccggtacgggttccgggaccccgtagggtacgggtaaaccgtagtacgggtaaactccggttaaggtaacctttaacgttacggttttaccgttaacccgcccgaaagtaccgtaacgttcgggttaacggtacggtaccgttaggaccggggttaacggggttacggtacggggaacgggttaaccggggtaaaccttcggggttaccggttaacccgtttcggtaggtaacccggacggttacccggaccggttccctacccgggttccccctaggttacctcccgttccggtttaccccccg

SEQ ID NO: 89175 - DNA, 708 bp, Homo sapiens
  misc_feature: GYAE6OF01D0148.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctcggacccctctcctcgcctcccctctctactttcngcacagtctctgacggcctctatgacgctagacacgacgccctaccgtcggtctcgacgtccgtacccgaaggaaccgaaacggccaaggactcaccgtcgccttagtggatacttacacgttacgaaaccaaaaagtacttacttacgtttggttacgtaccagtcgaaagtacgtcgacgccgacgtcctagtacgtgtacactcgagtacgacgctacgacgacgctacggtcgtactcgtagactacgtacttcgcgtcgaccctacgacgtccgacggacggtctacggtccgtacctagttacgacgtacgtacggtacgggtcgggaccgtagggtacggtacgtagtacggacgtacgtacgtacgtacgttacgttacgtaccacgtacgaacgtacgtaggtacgttacgtacgtacggttacgggtagggtacggtacgggacgggtaacggtaacggttacggttaccgggttaccgttccggttacgggtacccgtaaaccggtaccgttaaccggcccggttacccggtccccgtaggtttaccctccggttccgttcccccgg

SEQ ID NO: 89176 - DNA, 797 bp, Homo sapiens
  misc_feature: GYAE6OF01D1M3S.21.8.A08.1.454.CMB.1.raw
  modified_base (259)..(259): a, c, t, g, unknown or other
  misc_feature (259)..(259): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatggacgtctagacacacgcccacccgtcggtgtcaggtcgtaccccaggacaggaccggccaggactccacctgtcctctagtagagtggactagaccaaaagaatntgtacttagttacggtaaccaagaacgaacgccgacggacccgtacggccccgttggtaggtttaagtacgtaattaaataaacgttaaaacgacctaacggttaggaacggtaccgggtacccccttaggaaacggtacgtacccgttacccgtagggaaccgtcggtttaacctttcgtcgtaccgggtcctacccgtaacggtccgtaacggacgggtaccaacggtcgtacgttacgtacggtttacgaacttacgacggtagtacggtaaaccgtcgaacggagaacggaacggggacgtaggtcccgttaaggtactttaagtttaccgtacgtaacgtaaacgtacggttaaagacgttaggttaagggtaacgttaacgttcggttaaggggtttcgggttagggttacccgggggaaggtaaccggggaaccttaagggtaccggttccgggtaaacccggttaccgtaacggggtaccctaaacggacccccggggttaacgccccgttcccccgggttaccccccgg

SEQ ID NO: 89177 - DNA, 674 bp, Homo sapiens
  misc_feature: GYAE6OF01AV7WU.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggatattcattgaccaaaagatatacttgttggttccagcagaagtcaggccacggccctgtacgtggtcatccatcgacgccagtcgacgaccgaccgtccgggactccctgagtacgtacttctcgtagccctcgacgctcgaacgggtacaggtcgaccctacgttcgaactacgtacgaacgggtccggggacccaggggttacggaacggtagtaggaaacgtcgttacggtaaccttacgttaactttacggtaccgtaacctaccgtaagacgtaagggttaaggtcggtacaaggttaccgggtagggggttacgttcggggacgggtaacgggtaacccgtaggttaccggtaccgttccggttacggtacgtaccggacccggaacggtcccgttcccggtaccccccgttcggtaccctaaccgtccgtttaccccgttcccccgtaccccg

SEQ ID NO: 89178 - DNA, 855 bp, Homo sapiens
  misc_feature: GYAE6OF01APS4R.21.8.A08.1.454.CMB.1.raw
tcagtcgtcgctcgcacgaccggtgctcgatttagcatactctacagggggctgtgggctcaggaggcagagctctagggaatctcaccatggcctggacccctctcctgcctccccctcctcactttctgcacagtctctgacggcctcctatgagcctgacacacgcccacccgtcggtgtacagtcgtccccagggaccaaacggccaggatccacctggccttcgtaggtagtaactttcagtttacggaacctaaaaaaggactttaacttacgtttcggtttaggttacccaaggtccaaggtaacgttaccgacgggaccctacggggtccccccttgggtaaccttcgggtaccaccgtttccgaattcgggaacgtcccgtaaggttccggaaccggaccgtacccggtcccgggtaactaccccgtaggaacgtacgtacgtttacccgtcgttcccggtaccctcccgtaacggtacccgttccgggaaacgggggttacccacggggttacccggtaacccctttaaccggttttacggaaacctttaaccggttccggtaaccggggttcccggggaaccccgtaacggggttaccgggaaaccgtaacggtacggaaacgtacgtacgttaaaccgttacgttaacgtttacggttaccgaaccgtaacgtacgaacgtacggtaacggtaccggtacgtacgttacgggaacggggtttagtccggggacgggtacgggaacccgtaagtccggtaacccgggttcgtcggtacggaccggacccgtagggaccccttccggacccccgttaggtccccgtaccgttcccggttccccgg

SEQ ID NO: 89179 - DNA, 852 bp, Homo sapiens
  misc_feature: GYAE6OF01C5Q32.21.8.A08.1.454.CMB.1.raw
  modified_base (128)..(128): a, c, t, g, unknown or other
  misc_feature (128)..(128): n is a, c, g, or t
  modified_base (831)..(831): a, c, t, g, unknown or other
  misc_feature (831)..(831): n is a, c, g, or t
tcagtcgtcgctcgcacgaccggtgctcgatttagcatactctacagggggtgggctcaggaggcagagctctgggaatctcaccatggcctggacccctctcctgcctcccccctcctctactttcngcacagtctctgacggccctcctatgagctagacacacgccacccgtcggtgtcagtcgtccccgaggaaccaaaccgggccaggactaccaccgttgacctcgtcgggagtacttcaacgttacgaaacctaaaaagtaattactttaacgtttcggtttacgggttacccaagtactaaacggaacggttaccgaccgggacccgtaaccgggtccccctttaggtaacccctttcgggtaacctaaccgtacccgtaaggttacggaacgggtaccccgtaggtaacccggaacccggtacccgtaacccggtacccgggtaaccttccccggtaaggaacggtacgtactttccgtacgtaccggtccccttaccgacggtaccgttaccggaagggtaccctagggttcccgaccccttaacgttcgaaacttacggtaccggtggggtacccggggcccgtaggggtacggtaaccgagttacggaaacgtccgttaaacgtaacctttaacgttacgtttacggtacccgaacaccgtaagacgtaagtggtacgtagtacgttacgggaggggttacttccgggaacgggtacggtaaccgtagggttaccggtaccggttccgtacgggtacccgaaccggtaccgtccggggtccttcccccggcccccggttacgttacccgactttccccnccccggttttccccacccccg

SEQ ID NO: 89180 - DNA, 754 bp, Homo sapiens
  misc_feature: GYAE6OF01CX8TL.21.8.A08.1.454.CMB.1.raw
  modified_base (429)..(429): a, c, t, g, unknown or other
  misc_feature (429)..(429): n is a, c, g, or t
  modified_base (735)..(735): a, c, t, g, unknown or other
  misc_feature (735)..(735): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcacagtcctctgacggcctcctatgagctagaccacacgccctacccgtggtctctacgtcgacccccgaaggaaccaaaaccggccaaggtactccaccgtgccgtgtaggatattacatacgaaccaaaagtattattacgtttgttcggtaccagacgagaacgtcgacggaccgtcggccctagtacgtgtaccagtaccagtacgacgcccgtaagtccgaaacgaccgaccgtaccggaccttcccgaggaacgacgttactttcccgtacgtaccgccctacctaggtacncgggaacggactacgggtaccggacctaccgttagtaaccttacgtacggaacgggtcgggtacccgaggggtaaccggaggtaacgtaaggaaccgggtacttaccgaaccgttttaacgtaaccgtttacggttaacccggacaaccggtaacgtaacggtaacggttaggtaccggtacgtaacgggttacgggaagggggttttaccgacggggtaacggaacgggtaccgtaacgggttacgtacccggttcggtcgaccgtaccgggacccgtacggccctaccggccccgttcgtaccncggtttcccgtaccccggg

SEQ ID NO: 89181 - DNA, 739 bp, Homo sapiens
  misc_feature: GYAE6OF01CXIFG.21.8.A08.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgacggtccctctatgagctacgacacacgcccacccgttcggtgtacacgttccgtaccccgaagggaaccgaaaccggccaaggactccacctgaccttcgaggatacttcagtacgaaaccgtaaaaagtattattacgttggtttacgtacgagacgaagtaacgtcgacggaccgaccggtcccttagtaacgtcgtacactaccagtcggacgccgaggtccgaacgtccgaccgtccggacttccgaggacgtactcttcncgtcgaccctacgcgtacgtcggaacgggactcggtaccgccttaacgtgacttacgcggagggacccgggtacgagggtacgacgtagaagtcgtacgtaacgactttattacggttccgtaccgacaaccggtagtaacggtacggtttagccggttaaacgtggttacgggggaaggggttccgttaccgggggaacgggttagaaacccggttttgggacccggtttacgttccgggtacggtaccgaacccggaccgggtacgtccccgttacccgggtacccctccgggttaacctccgttaccccgttccgtttaccccccgtacccg

SEQ ID NO: 89182 - DNA, 790 bp, Homo sapiens
  misc_feature: GYAE6OF01E1308.21.8.A08.1.454.CMB.1.raw
  modified_base (126)..(126): a, c, t, g, unknown or other
  misc_feature (126)..(126): n is a, c, g, or t
  modified_base (160)..(160): a, c, t, g, unknown or other
  misc_feature (160)..(160): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttcngcacagtctctgacggcctctatgagctgacacncgccaccgtcggtgtcagtcgtcccaggacaacggccaggactcacctgctcgtaggatattcattacgaacctaaaagtatattacgtttgttcggttacagcaagacgtcgacggccgacggtccctgtactcggtactactcctagcggacggcctacggtaccgacgaaccgtaccggtccggtactcccgtaggaacgtacgttactttcctacgtccgtcccttaccgacggtccgtaacgggacgggtaaccacgggttaccgtaccccgttacgttacgtaaccttacggtaccggtacggggtaccgggacccggtaaggggtacgtaacggtacggtacggtaacgtacgttacggtaacttacgtttacgtttaccggtaccgtaacccgaacgtacggtaacgtacggttacggtacggtaacgtacggttacggggtaaggggttaccggttacggggaaccggggtaacggtaaccgtacgggtttaccggtaccccgggttacggtttccgggaccgtaccgggttaaccccggtcgggtccccgttaccccgggtaccccccgtttaggtaccccttaccgtttccccgttccccgttacccccggttcccccg

SEQ ID NO: 89183 - DNA, 782 bp, Homo sapiens
  misc_feature: GYAE6OF01AX9QL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctagacacacgcccacccgtcggtgtcaggtcgtccccaggaaccaaacggccaggactccacctgctcgtggagtacttacattcgaaccaaaagtattattacgttgttcggttaccagtacgaagaacgtcgacggccacggtcccctgtacgtcggtacactccgatacggacggtccgtacggtaccgaccgtaccgtaccggtcccgggactaccccgtaggacgtaacggttacctttccgtcgttaccggtcccctccgtaacgtccgtacggaacgggtacgtacggttcggaccccttacggttcgtaacttacggtacgtacggggttaccgggacccgtaggggtacggtacggtagtacggtaacggtctacgtaaccttaacgttacgtttacgtaccgtaaccgtaacgacgtaacgtaggttaacggtcgtacgtaacggttacggggttaacgggttacggtaccggggtacgggtaacgggtacggtaaccgggttaccggttacccggttcccggttcgggtaccgaacccgggtccccggtaacgggtccccgtcccgggttacccccgtacgggtttacccttacccggtccgtttaaccccccgg

SEQ ID NO: 89184 - DNA, 768 bp, Homo sapiens
  misc_feature: GYAE6OF01A5I49.21.8.A08.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctgganatgcattgaccaaaaaattntgttttttagaccagcagaagtcaggccaggccctgtgtggtcatccatgaggacaggacgaccgacccgtccggggaactccccgtaggacggagtacttcctcgttcggcctacccgaaaccgttcgaacggggtaaccgggtcggacccgtaacggtttcgaacttttcccgtacggtaacgggttccggggggtaccccgtaagggggttcgggaacggggtaacgttagggaaaacgggtccttaacgggtaaaccttaaccgttaaccgttacggttttaacctcgtaacggaccgtaacggaacgtaacggccgtaagggttcgggtaacctacgttaccgggtaaggggggtccttaacggttccggggacggggaaccgggggtaccgtaaggggtttaccggaacccgggttacccggtaacgggttcccgaaccgggtaacccgaaacgggtccgtacccggcccccggtttaccgggtccctaacccgttccgttcccggtttacccccgtccccccg

SEQ ID NO: 89185 - DNA, 789 bp, Homo sapiens
  misc_feature: GYAE6OF01CJT5E.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagttctctgacggcctcctatgagctgacacagcccacccgtggtgtcacgtcgtccccaaggaccaaaccggccaggactccacctgccttcgtaggagtattaccagttacgaaccaaaaagtattacgttacgtttgttcggtaccagacgaagaacgtcgacggccaccggtccccttgtaccgtgtactactacgagtcggacggtccgtacgtaccggaaccgaccgtacccggttacccgggtactcccgtaggaacgtagttaccttccgtactaccgtccctacgaccggtcgtacggaacggaccgtcggtaccgaccccttacgttaacgtacgttaacgtccggtaaccggggtccggggtaccccggtaggggtacccggtaacgtacggttaacggaacgtccgttaacggtaacctttaacgttaacggtttaccggtaacccgaaccgaaccggtaacgtaacgttaacggttacggttacgtaccggtaggttaccgggtaacgggggtttactccgggggaacggtacgggtaaccgttacgggttccgtaccggttacgttacggacggtacccggtacccgtacgggtccctccccggaccccgttccgacccgttccgttccccgtccccccgg

SEQ ID NO: 89186 - DNA, 779 bp, Homo sapiens
  misc_feature: GYAE6OF01DBP03.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctcgccctcccccctcctctactttctgcacagtctctgacggcctcctatgacgctgacacacgcccacccgtcggtgtcaggtcgtaccccgaggaaccgaacggccaggactaccacctcggactcgtaggatacttactattacgaaacctaaaagtaacttatttaaccgttggttacggtaccaaggtacgaagtaacgtcgacggccgaccggtccctggtacgtcggtacactaccgagtacggacggtaccgacggtaccggactaaccgtacccggtccgggtacctcccgtaggaacgtacgttacgttcctccgtccgaccctcgagtccgaacgggtaacgggtaccgtacgggttcccgtaacccgtacgtttaacgaccgttaggccggttacgggggtccccggggtaaccgggttagggaccgggaacggtagtaacggaacgtcggtaacgttaaccttaacgtttagttaccggtaccgacctaacggtacggtaacggtaggttacgggtacgtacggtagggttacggggtagggttaccggtacggggacgggtaaacccggtaagtacggttccggtaccgttcggtaggtaccggaccggaccgtacgtcccgtacccgtccgtacgtacctccgttcccgtaccccg

SEQ ID NO: 89187 - DNA, 650 bp, Homo sapiens
  misc_feature: GYAE6OF01AFFMN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctgctcgtggagtattcattgaccaaaagtatatacttgttcggttccagcagagtcaggccacggcccctgtacgtgtcatccatgacgccagtcgacgacgaccgtccgggatcccgtgagagtacttcctctcgccctccgaggcctcggaagggactacggtcggacccctacgttgaaccttagtcgagggtccggggacccgtagggtcggacgagtcggaacgtcgtacgtaacttacgttagttacgttaccgacgtaaccacgtaactaggttacgttcggtacgtagtaccgggtaagggggtacgttacgggacgggtacgggaccttagggtacgtacccggttccgttagggtacctaccgggacccgaacgggttcccgtacccggtcccccgtaccgggttaccctcccggttccgttcccccgg

SEQ ID NO: 89188 - DNA, 837 bp, Homo sapiens
  misc_feature: GYAE6OF01B5470.21.8.A08.1.454.CMB.1.raw
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgccacagtctctgaggcctcctatgagctgacacagcccaccctggtgtcagtcgcccgaggacaaacggccaggctcacgtnctgtggatnttacattacgaacctaaaaagtattacttacgttcggtttaggtttacccaaggaccgtaaggaacgttaccggaacgggtacccaccggggtacccccttacggttaccgttacgggtacctacttcccgagttacggacggtcccgaaggttaccgaaccgtacctacccgtacccggggtaacttccccgtaggaacggtacgtacgttttaccgtcgtaccggtaccccttccgtaacgggtacctaaccgggtaacggggtaccgtaccgggtaccgtacccccgtttaacccggttagttaaccgtacgttaccggtaccgggttacgggggtaccccgggtacggggtttacgggaacggtaacggttacggtaaggtacccgtttacggtaaccgtttacggtttagtttaacccggttaccggacccgtaaccgtaacgtacgtaacgggtgttacggtaacgtaggttacgggtacgggggttagtaccggggaggtaaccgggtacgtaacggttccggtacgttccggttaggaccggtccgtaaccggacgggtacccgtcccggtacccccgttaggtcccttccgttcccgttccccccgg

SEQ ID NO: 89189 - DNA, 791 bp, Homo sapiens
  misc_feature: GYAE6OF01BMGD0.21.8.A08.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacngtctctgaggcctcctatgagctgacacacgcccacccgtcggtgtcgagtccgtaccccgaaggaaccgaaaccggccgaaggtactccaccgttcgccttcgtagggacgtacttactagttacggaaacctaaaaagtaattaagttacgtttaggttcggttaccgagtacgaaggtaacgtcgacggaccgaccggtcccctaggtaacgttcggtacctacgttaccgtaaggtcggacggacccgtaacggtaccggaaccgaccgtaccggtccgggtacctcccgtaggacgtacgtacttcgtccgtcgccctacgacgtcgtacggacgggtaccgtacggtccggtaccctaccgttacgtacctacgtcggtacggggtccgggaccgtaggggtacgaacgtagtacggaacgtcgtacgtaaccttacgttacgtttcgaaccgacgtaaccgtaggtaacgtaggtcggtacggtaccgtacgggttaggggtacgggggttacgtccggggaacgggtacgggtaaccgttaacgggtcccgggttacccgttcgggttacggaccggaacccggaccgtaccggggtccctccccgggtaccccggttccggtacctacccggttcccgttacccccg

SEQ ID NO: 89190 - DNA, 696 bp, Homo sapiens
  misc_feature: GYAE6OF01BUKDA.21.8.A08.1.454.CMB.1.raw
  modified_base (129)..(129): a, c, t, g, unknown or other
  misc_feature (129)..(129): n is a, c, g, or t
  modified_base (136)..(136): a, c, t, g, unknown or other
  misc_feature (136)..(136): n is a, c, g, or t
  modified_base (157)..(157): a, c, t, g, unknown or other
  misc_feature (157)..(157): n is a, c, g, or t
  modified_base (174)..(174): a, c, t, g, unknown or other
  misc_feature (174)..(174): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (643)..(643): a, c, t, g, unknown or other
  misc_feature (643)..(643): n is a, c, g, or t
  modified_base (665)..(665): a, c, t, g, unknown or other
  misc_feature (665)..(665): n is a, c, g, or t
tcagtcgtcgctcgcacgaccggtgctcgatttagcatactctacgagggggtgggctcgaggaggcagagctctgggaatctcaccatcggcctcggaccctctcctcgcctcccctctctactttcncgacagngtctcgtgacggccttctagngagcacacacgcgtccnccgtggtatcgacgtccgacccgaggaacgaaccggcgagtcacgcctgctagnganttcatacgaactaaatattacgtagttggtcgtacgagacgtaagtacgcgacggaccgaccggtccgttagcgttacggactacgtacctaggtacggaccgacgttaccgtacgtaaaccggaccgtaaccggttccggggtaacaacccggtgtaaacgtacggttacctttacgaccgtccgtaccggtacacgacgtacgacgggtaactgaccggtacctgtagtaacgcttacggacggcggtacgagaccggagagtacgaatacgacgtagtaccgtagtacgttacccgagtaccgaaggtagtacggtaacgtacggtaaccgtaggtaccggggtaaggttccggacggtaacgggtaacgtaccgagtaccggcgtttaccggcgtacacgggtaaccnccggtaccgtccgttaccccgnggtcctaacgtccgtcccggttacccctccg

SEQ ID NO: 89191 - DNA, 740 bp, Homo sapiens
  misc_feature: GYAE6OF01C6XW4.21.8.A08.1.454.CMB.1.raw
  modified_base (124)..(124): a, c, t, g, unknown or other
  misc_feature (124)..(124): n is a, c, g, or t
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctcggacccctctcctcgcctccccctctcnctttcngcacagtctctgacggtcctctagtgagctagacacacgccctaccgtggtcgtcgacgttccgaccccgaaggaaccaaaccggcaaggactccaccgtgtctcgtagacgtacttcatacgaaacaaaagtacttagttacgttggttacgtaccagtacgaagtaacgtcgaccggaccgacggtccctagtcgtggtaccagtccagtacggacgacgtacgaccgaccgaacctaccggtaccggtacctccggtagaacgttacgtacttcccgtacgcctcccacgtaccgcttacggggaggtaaccgtggttaccccggaccttaacgtacgtaacgtcgtaccggtgggtacgggccggtagggtacggacggtagtaacggacgtacgtacgtaccgttacgttacgttacgtaaccacgtaagtaacgtaagtagggtacgttcggtaccgtaggttacgggtagggtaccggttacggggacggtaacgggtaacgtaccgttacgggtacccggttaggtcccgacggtccggaacccgtgttacccccggtaccggtaccccgttattccccggtacctttcccggttccccccg

SEQ ID NO: 89192 - DNA, 666 bp, Homo sapiens
  misc_feature: GYAE6OF01B9D54.21.8.A08.1.454.CMB.1.raw
  modified_base (490)..(490): a, c, t, g, unknown or other
  misc_feature (490)..(490): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtcccgaggacaaacggccaggatcacctgctcgtggagattcattgaccaaaagatatacttgttggtcagcagaagtcacggccacggcccctgtacctggtccatccgatgacggccaggtccgaacgaccaccgtccgggacttcccgtagagacgtactttctcgtcgtccctccgacgtccctagaacgggactacgggtccggacctaccgttacgacttactcggtacgggtccggggacccgtaagggtcggaacagtaggaacgcgttacgtaccttacttagtttaccgttaacnccgaaccgtacgaacgtaggttagtcggtactaggtacgggtaggggttacgtcggggacgggaacgggtaccgtaaggttaccggtacccggttccgttcgggaccgtaccggacccggtaacggcccgttcccggacccccgttcgggaccctcccggttcccgttacccccgg

SEQ ID NO: 89193 - DNA, 805 bp, Homo sapiens
  misc_feature: GYAE6OF01CCVI7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccgaggacaaacggccaggactccgacctggcctctggagtattccattcgaccaaaagtaatatacttgttcgtccagcagagtcgaggccacgtcccctgtactggtcatccatgagccagtcgacgaccacgtccgggactcccgtgaagagtacttctcgtcgaccctccgacgccgtaccggaggaccgtagtaccggtccctaaccgttgaaccgttagtccggacgggttccgggaccccgtaggggtcggaaccgtaaggttacggaacgtccgttaaggaacccttttaacgttacggttttaccgggtaacccgtacccgtaacccggtaaacggtacccggttaaaggtttacgggttacgggtacgtaaccggggtttaacggggtaacggggggtttaccggttacccgggggaacgggggtaaacccgggtacccggttaaaccggggtttaccgggtaacccccgggtttttccgggttaccggggtaacccgtaaccggggtaccccccggttaaacgggtcccccgggttaccccccggttacccccgggtttaacccgggttcccctaaccccggttttcccgtttaaccccccccgg

SEQ ID NO: 89194 - DNA, 672 bp, Homo sapiens
  misc_feature: GYAE6OF01AL07X.21.8.A08.1.454.CMB.1.raw
  modified_base (337)..(337): a, c, t, g, unknown or other
  misc_feature (337)..(337): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactccacctgctcgtggactattcattcgaccaaaagtattacttacgtttgttggttccagcagaacgtcaggccacggcccctgtactgtcatccatgacgcagtcgacgacgaccgtccggatccccgnggacgagtacttccgcgtacgcccctcgacgtcgttaccggagggtactacgggcggtacccctaccgtttcgaacgttacgtaccgtacggggtccggggtacccgagggtacggacgtacgtaggaacgtcgtacgtaacttacgttaagtttcgtaccgacctacgaagtacgtaggtacggtacggtactaggtacgggtaggggttacgttacgggcggtaacgggacctagggttaccggacccgtttcgttaccggacgtaccggacccgtacgggtacccctcccgggttacccccctaggtccctaccgttcccgtttccccccgg

SEQ ID NO: 89195 - DNA, 621 bp, Homo sapiens
  misc_feature: GYAE6OF01BQ0DL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggacaaacggccaggatcactgctcgtggagtattcattgaccaaaagatatacttgttggttccagcaagaagtcaggccacggcccctgtactggtcactccagtcggacgccagtcgaacgacaccgtccgggactcccgtagagtacgtactttctctcgccctacgagccgtacggacgggactacggtcggacccctacgttcgacttagtccggagggtccgggaccgtagggtcggaacgtagtacggaacgtcgtacgtacgttaacgttagtttacgtaaccgctaaccgaagtacgtaagttacggtcggtactacggtacgggtaggggtacgtcgggacggtacggaaccgtaggttcgtaccgttcgttcgacgacgacccgtagccgtccggccccgtagcctcgtccgtccccg

SEQ ID NO: 89196 - DNA, 720 bp, Homo sapiens
  misc_feature: GYAE6OF01A0AD2.21.8.A08.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctagaccacacgcccacccgtcggtgtccacgtcgtccccgaggaaccaaaccgggccaaggactccacctgctcgtggatacttcattacgaaccaaaagtaattactacgtttgttcggttaccagacgaagaagtcgacggccgacggcccctgtacgtggtcactcagngacggcagtcacgaccgacgtccggctccgagagacgtacttctcgtactccgtccacgtcgtacggaggacaggtccggtacctaccgttaggtactacgtcgtacgggtcgggaccgtaggggtacggaacgtagtacggagtacgtactaaccgtttacgttacggtttactaaccggacctaacgtaaccggtacggtaacggttaggttacccggtagtaccggtttaacggggtacggggtttacgggtacccgggagggtaaaccgggtaccgttaagggttccccgggtaacggtttccggttaggacccggtaaccggtacccgacggttcccgttaccccggaccccggttccggtaaccttacccgttccggttacccccg

SEQ ID NO: 89197 - DNA, 838 bp, Homo sapiens
  misc_feature: GYAE6OF01C1N1L.21.8.A08.1.454.CMB.1.raw
tcagtcgtcgctcgcacgaccggtgctcgatttagcatactctacgaggggggagaggagcccagcactagaagtcggcggtgtttccattcggtgatcagcactgaacacagaggactcaccagtggtagtttgggctgagtcttcgggttttcctccttgtcttacgttttaaggaggttcgtccagtgtacgaggcgacaacgtggtggacggtcggtgggggacgcgtagtcggtccgagccgtgggtacgtccctgacgtcctcgtccgtgtcgcgagtcgtcgtggtacttcgaagtcgtccggtctttccgtttgacctagtcgtaccgtaccggttccggggtccccgaccgtacggtccctaccggaacgggtaccggaaaggggtccgtagggtagggttcggggtacggtaccggtaatttacgttacggttaggttaagtaggtaaggttaacggaaaggtggtaaacggtaagtaatttaacgtttaactacggaacggtaacccgttcgggaacgggtaaccgggtaccttaacgtaccgtaaccctagtttcccgaaacgaacgtaacgaacccgtaaagtcccgaaaaccaaaaccgtaaccctaccttaaacgtttcgttaaccttaaccgttaaacgaaaacgtcccggtaacccggtacgttacgggaaacggtacccgaaccggggacgtaaccggacgttacgtaaacgtttaacgttaaaccgttttaggaaccgttacgtaacgttttccgtttacgggtacgtaaccgggttacggggaacccgtaacccggggttaaaccgtcggtaaccccg

SEQ ID NO: 89198 - DNA, 901 bp, Homo sapiens
  misc_feature: GYAE6OF01DYFAW.21.8.A08.1.454.CMB.1.raw
tcagtcgtcgctcgcacgaccggtgctcgatttagcatactctacagggggctgtgggctcaggaggcagagctcgtgggaatctcaccagtcggcctcggaccccttctcctcgcctccccctcctctactttctgcacacgttctctggacggtccttacctagtgacgtctacgaacaccgacgtaccctaccgtcggtcgtacgtacggttacccgtacccggaaggaaaccgaaaccggtccgaacggtacctccgtaaccgttcgtacgtacggtaggtaacgttacttacgtaacgttaacgaaaaccgtaaaaagttaacgttacgtttaacggttttcggtttacggttaccgtaacgtaacggtaacggtaacggtaccggtaccgggaccggtacccggtacccgttaccggttacgttacggtaccgtacgtacgtacggtacggaccggtaccgtaccggtaccgaaccgtaccgtaccggtaccggtaccgtaccgtacggtacgtacgttaccgttccgttaaaaaccgtccgtacccgtaccgtacgtaccggtaacggacggtaaccgtacggtacccgtaccgtaccgttacgtaacgttacgtacgggtaccgggtacgggtaccggtacgggtaacggtacggtacggtaacgtacgtacggttacgttaacgttaacgttacgttacgtaccgtacgtaacgacgtacgttagtacggtacgtacggtacggtacgggtacgggttacggtacgggtacgggtacggtaacggttaccggttaccggttaccggttacggttaccggtacggtaccggtaccggtacccggtcccggtcccgtcccggttaccgttcccgttcccgttcccgttaccccg

SEQ ID NO: 89199 - DNA, 719 bp, Homo sapiens
  misc_feature: GYAE6OF01DVNML.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgttcggtcgtccgagtcgtcccccaagggaaccaaaaccggccaggactccacctgctctggagtattcattacgaccaaaagatattacgttgtttggttaccagacagtaacgtcgacggccacggtccccctagttaccgtggtccaacgtccagtcggacggaccagtccgaccgactaccggtacccgggagtcccctaggacgtagtactttccgtactcgtccctccgacgcgtaccgacgggactcggtcgacctaccttgaccttgtcgacgggtccgggtaccgagggtaccggtagtagacggtaaagtccgtagtaaccgtttacgttacgtttacggttaccgcccgtaaaccgaacggtactaacgggttcggttaggacctaggtacgggttaacgggggttacgtcggggaacgggtaccgggtactaagggtttccgtacccggtttcggttccggaccgaccggaccccggtaaggcccccgttcccggtacccccgttccggttacctcccgttcccggtttcccccgg

SEQ ID NO: 89200 - DNA, 685 bp, Homo sapiens
  misc_feature: GYAE6OF01ESEIJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggagtattcattcgaccaaaagtatatacttgttggttaccagcagaagtcaggccacggtcccctgtactggtcatccatggacgccagtcgacgactccgtaccgggactcccgtagagacgtacttcctcgtacgcccttaccgagccgttacgaacggggtactacgggtcggacccctaacgtttcggaaccttagtccggacgggttccggggaccccgtaaggggtcgggaacgtagtaggaacgtcctacgtaaccttacttagtttacgttaaccgctaaccgagtaacgtaggtacgtcggtactagttacgggtaaggggttacttaccggggacggacgggtaacctaagggtttccgtaacccggttccggttagggtaccgaccggtacccggtaaacgggtccccttcccggtaccccccgttagggacccttccgtcccgtttacccccgg

SEQ ID NO: 89201 - DNA, 735 bp, Homo sapiens
  misc_feature: GYAE6OF01CAA5U.21.8.A08.1.454.CMB.1.raw
  modified_base (535)..(535): a, c, t, g, unknown or other
  misc_feature (535)..(535): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatcgagctagacacacgcccacccgtcggtgtcaggtcgtccccgaggaacaaacggccaggactcgacctgctcgtggactatcagttacgaacctaaaagtaattacttacgtttaggtttcggttaccaagtacgtaagtaacggtccgaacggccgaacggtccccgtaggttacctggtacaccgtcctagtcgacggtccacggtcgaaccgaccgtaacgtcccgggactcccgtaggaacgtacgtacttcgtcctcgtcccgtccgacgtacgtacggtaacggacgtacggtaccggtaccctacgttacgtaacgtacgtacggacgggttacccggggaccgtaggggtacggtaaccgtagtaacggaacnccggtagtaaccttacttagttacgtacgacaaccgtagtacgtacggtagttacgtacgtagtaacgggttacgggttacgtacgggacgggaacggttaaccgtagggttaccgtaccgtttcggtcggtacgtacccggaccggtaaccggtccgtccccggtaccccgtacgttacccgttcctcccggttccccg

SEQ ID NO: 89202 - DNA, 715 bp, Homo sapiens
  misc_feature: GYAE6OF01AQRLV.21.8.A08.1.454.CMB.1.raw
  modified_base (669)..(669): a, c, t, g, unknown or other
  misc_feature (669)..(669): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgagcctcctatgagctgacacacgcccacccgtcggtgtcagttcgtccccgaaggaaccaaaaccggcccgaaggactccaacctcgcctcgtggagtacttcattgaaccaaaaagtaattattacgtttgttacgttaccagcaagaagtcgacggccgacgccctagtactcggtactactccgagtagacggtccagtccgaacgtaccgtaccgtccgggtaactccccgtaggaacgtacgtacttcgtcctcgtccctaccgacgtccgtacgaacgggtacgtacggtaccgggtacccctaacccggtttacggaacccgttaagttaccggtaacgggggtacccggggtaccccgtaaggggttacggaacgtagtacggaaacgtcgtaacgtacttacttaagttcgtacgaccacaacgactagtagtcggtaactacggtacggtaggggtagttaccgggagggtaacggaccgtaaggttcgaccgttcggttagccgacgtaccgacggtccncccggtaccccgtcggtacctaccgtccgtccgtccccgtaccccg

SEQ ID NO: 89203 - DNA, 670 bp, Homo sapiens
  misc_feature: GYAE6OF01BL017.21.8.A08.1.454.CMB.1.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctggaggcctcctatgagctgacacagcccacccgtcggtgtcagttcgtccccgaggaaccaaacggccaggactcacctgctcgnggagtattcagttgaacaaaagatatactttgttcgtcagnagagtcgacggccacgcctggtactcggtcactccagtgacggccagtccgacgactaccgtccgggactcccgtagacgtagtacttcgtactcgccctaccacgctacgacgggacgacggtcgacccgtacgttacgacttagtcgacggggtccggggaccgtacgggttcgggaacgtacggtaagacgtacgtaggtaacctttagttacgttacgtacgaccgtacgaacgtacgtaagtaggtacggtactaggtacgggtaggggtacgtacggggtacgggtaaccgggaccgttacggttaccggtaccggttcgttcgggtaccgtcggaccgaaaccggtcccgtacccggttcccccgttaggtacccgtccgttcccgttacccccgg

SEQ ID NO: 89204 - DNA, 659 bp, Homo sapiens
  misc_feature: GYAE6OF01A4GCY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccgaggacaaacggccaggactcacctgctcgtggagtattcattcgaccaaaagacttatacttgttggttccagcaagagtcaggccacggcccctgtactggtcatccagtggacgccagtacgacgacaccgtccggactcccgtagagacgtacttctcgtcgcctcacgctacgacggactacggtcgcctactgactactcgtacggtcgggacctagggtcggaacgtagtacgaacgtcgtacgtaccgttaactacgtttacgtaccgacaacccgtagtacgtaggttacgtacggtacgtacggttacgggtaacgggggttacgttacggggacgggtaacgggtaccgtaacgggttccggtaacccggtttcgggttcggtaccgaccggtacccgtaacggtccggttacccggtcccccggttacggttcccgtaccgttcccggttaccccgg

SEQ ID NO: 89205 - DNA, 669 bp, Homo sapiens
  misc_feature: GYAE6OF01DTTZT.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccagatcactgctctgganatcattgaacaaaagatatacttgttgtccagcaagaagtcagccaggcccctgtactggtcatccagtgaggccagtcgacgacacgtccgggatcccgtagagagtacttcctctcgaccctcgacgtctacgagggtaccaggtcgaccctaacgttgaacttactacgtaggtcggggaccccgtagggtacggacgtagtaggaaacgtcgtacgtaacttacttagttacgttaccgacaacctagtaacgtaaggtaggtacggtacgtacgttacgggtaggggttaacgttccggggaacggggtaacgggtaaccgttaaacggttccgggtaacccggtttccggtttaacgggtaccgtaaaccggaccccggtaaacgggtcccgtacccggtacccccccggtacgggtttaacccgcccgttccggtttacccccgg

SEQ ID NO: 89206 - DNA, 640 bp, Homo sapiens
  misc_feature: GYAE6OF01EM6SY.21.8.A08.1.454.CMB.1.raw
  modified_base (371)..(371): a, c, t, g, unknown or other
  misc_feature (371)..(371): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtggtgtcagtcgtccccaggacaaacggcaggatcacctgctcgtggatattcaattcgaaccaaaaagtaattacttaacgtttggtttaggttccaaggtcaaggtaacgtcgacggaccacggccccttgtactggtcactccagtgacggccaggtaccgacgaccacgtccggacttccctagacgtacgtntttctctcgccctccagtcctcggaaggtacaggtcgaccctaccgttgtaccttagtaccgtagggtccgggtcccgtagggtacggagaacgtagaacgtcgtacgtacttaaccttagttcgttaacgcctaccaagtacaggttaggtacgtacgtacgtaggtaggggtacgtcgggagggtacggacgtacgtggacccgttcgtaggcgccgtaccgaggtcccgtccgtacccccgttacgcctaccgtccgttaccccgg

SEQ ID NO: 89207 - DNA, 696 bp, Homo sapiens
  misc_feature: GYAE6OF01CKIQL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggactcacctgcctcgtggagtacttcattacgaaccaaaaagattattacgttgttcggttaccagacaagtaagtcgacggccacggtcccctagtactcggtctactccgaagtcggacggccaggtccgaacgacctacgtccgggactcccgtgacgtatacttcgtctcgccctccagtcgtcggaacggtacacggtccggtaccctaccgttaggaaccttacgtaccgtagggtccggggaccccgtaagggtacggtaaccggtagtacggtaacgtcgtagtaacccgttacttaagtttacggtaaccaccaaccgtagtaacgtaggtaggttacggtacgtagttaccgggtagggttacgtcgggaacgggtaacggtacggtaaagttccgggtaccgttcgttacggtacgccggtacccgtaaggcccttaccccgggccccgttacggttcccgccgtttccgttacccccgg

SEQ ID NO: 89208 - DNA, 725 bp, Homo sapiens
  misc_feature: GYAE6OF01EYCSX.21.8.A08.1.454.CMB.1.raw
  modified_base (134)..(134): a, c, t, g, unknown or other
  misc_feature (134)..(134): n is a, c, g, or t
  modified_base (178)..(178): a, c, t, g, unknown or other
  misc_feature (178)..(178): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagtcgtcgctcgcacgaccggtgctcgatttagcatactctacagggggctgtgggctcaggaggcagagctctgggaatctcaccatcggcctcggacccctctcctcgccctcccctcctctacttttcngcactacgtctctggacgtcctcctagtcgacgtctacgaaacncgccctaccgttcggtcgtcacggttccgacccgaaggaaccgaaacggccgaaggtctaccgaccgtcgtaccttcggaggtaactacttacgtacgttaacgaaaccaaaagttacttaactttaccgttggtttaccggtccaaggtacgaacggaacgttcgacggacctaccggtcccttagtactcggtactacgtacgagtcggacggtacctaggtaccgacgtaccacggtccggactcagatctacttcncncgcncgngcgtacgaggctcgtcgaccttacgtcgtactaacgtcggaggtccgggacgtaaggtacggacgtacgtacgacgtgtacgttactacggttacttacggtacgacctacgaacggtagtacgtacggtctacggtacgtacgggtagggttacgaccgggtacgggacgtaccggttacgttaccgtacggttacgttaccgacgtaccggtaccgtacgggtccccgtacccggtccccgttcgtacccgtcccgttttcgccccggttaccccg

SEQ ID NO: 89209 - DNA, 685 bp, Homo sapiens
  misc_feature: GYAE6OF01AU5WO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccaaggaccaaacggccaggactccacctgctcgtggatatcattgaaccaaaaagatacttacgttgttcggttaccagcagaagtcgacggccacggtcccctagtacgtggtcactccagtcggacggccagtccgaacgaccaccgtccgggactcccgtagagtacgtattcctcgtcgccctaccgacgacgttaccggaagggtacctagggtaccgtacccctaccgtttacgtaacctacgtccggtacgggtccggggacccgtaggggtcggaacgagtacggaacgtcgtacgtactacgttagtttacgtaccgcaacgtaggacgtagtacggtcgactacggtcgggtagggtacgtcggggacggtaacgggtacgttaacggtaccggtaccggttccggttcggaccggtacccggaccgtaaccgggtcccgtacccggcccccggttacggttaccctccgttcccgttacccccg

SEQ ID NO: 89210 - DNA, 845 bp, Homo sapiens
  misc_feature: GYAE6OF01BZ5O9.21.8.A08.1.454.CMB.1.raw
  modified_base (170)..(170): a, c, t, g, unknown or other
  misc_feature (170)..(170): n is a, c, g, or t
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctcgtggacgtccctactatggacgctgaaccacncgcccncccgttggtacgtcacgttccgtccccgaaggaaccaaacggccaagggactccgaccgtgtccttcgtaggtacgttacttctaattacgaaaccgtaaaaaagtacttacgttacgttttggttcggttacacgacgaaggtaacgtcgacggtccgaccggtccccgtagtaccgtcggtactacgttaccgaagtcggaccggaccggtacggtaccggaaccgaaccgtacccgggttaccgggaaccttcccggaggtaacgtacgttactttccgtcttccggaccctaccgacgtccgtacggacggtacgtacgggtccgtaaccttaccgttacgaacttacgtacggtaccgggtacccgggtaccggtagggttaacgggaacgtagtacggaaacgtccggttaacgtaaccgtttaacgttacgttaccggttaacccgaccgtaaccgtaacgtaacggttacggttaaccgttacggtacgttaacgggtaccggggttaaggggtttacccggacggggtaacgggtaaaccgggtaacccgttaagggttaccccggtttaccgggttccggttaccggaacggtacccggaccgtacccggttacccggtcccggttaccccgtggtacccttccgtcccgttcccccgg

SEQ ID NO: 89211 - DNA, 758 bp, Homo sapiens
  misc_feature: GYAE6OF01AOYPW.21.8.A08.1.454.CMB.1.raw
  modified_base (178)..(178): a, c, t, g, unknown or other
  misc_feature (178)..(178): n is a, c, g, or t
  modified_base (614)..(614): a, c, t, g, unknown or other
  misc_feature (614)..(614): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctggaggccctcctatgagctagacacagcccaccgtggtntcagtcgtcccaggacaacggccagctcactgctcgtggagtacttcattcggaacctaaaagtacttagttaccgtttggttcggttaccgagtaccgaggtaacgtccgaacggtccgaccgggtcccccttagggttaaccgtcgggttacctacgtacccgtaggttacggaccggtaccgtacggtaccggaaccgtaccgtaccgggttcccgggtacttccccgtaggtaacggtacgtacgtttacctcgttcccggtaccctacccggtacgtacccgtagggaaccgggtacccgtagggtccccgtaacccgttaccggtttacgtaaccgttacgttaccggaccgggtccggggtacccgtagggtaccgggactaggtacggtaacgtcgttaacgtacgttacgttacgttacgttacccncgtaacgacggtagttcggtacgttaggtaccgtagtacgggaggttaccggacgggtaggaccggtacgtacgtcggtaccgttggtacgacgtccgaccgacggtccgtcccgtacccgtgtaccgtccgtccgttccccgg

SEQ ID NO: 89212 - DNA, 673 bp, Homo sapiens
  misc_feature: GYAE6OF01E3FZJ.21.8.A08.1.454.CMB.1.raw
  modified_base (175)..(175): a, c, t, g, unknown or other
  misc_feature (175)..(175): n is a, c, g, or t
  modified_base (248)..(248): a, c, t, g, unknown or other
  misc_feature (248)..(248): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacgcctcctatgagctgacacagcccacctggtntcagtcgcccaggacaaacggcagatcactgctctggatattcatcgaacaaagtatatacgttgttcgtcancagagtcgaggccacggcccctagtactggtacactaccgagtggaacggtcccaaggtaccggaaccgaaccgaccggtaccgggtacttccccgtagaacggtatactttcctacgtacgcccgtaccgacgtacgtaccggaagggactacggtcggacctacctttaggaccttacgttacggacgggtacggggtcccggtaagggtcggaacggagtagaacgtcgtacggtaacctacgttagttacgttacaccgaccacggataggttagtcggtacgtacgtacgggtaggggttacgtacggggacgggtagggaacccgtaagggttcgtaacccggttcggttaggacccgtacggaacccgtaaggcccgttacccggccccgttaggtaccttccctacggttacccccg

SEQ ID NO: 89213 - DNA, 665 bp, Homo sapiens
  misc_feature: GYAE6OF01B6EJF.21.8.A08.1.454.CMB.1.raw
  modified_base (457)..(457): a, c, t, g, unknown or other
  misc_feature (457)..(457): n is a, c, g, or t
tcagtcgtcgctcgcacgaccggtgctcgatttagcatactctacagggggctgtgggctcaggaggcagagctctgggaatctcaccatggcctcggacccctctcctgcctcccccctctcactttctgcacagtctctgacggcctcctatgagctgacacacgcccacccgtggtcgtcagtccgtccccgaggaccgaaaccggccgaggactccaccgtgctcgtaggagtacttacagttacgaaccaaaaagtattacttacgtttcggttcggttaccagactaaggtacgtaccgacggtccgaccggtcccctagtaccgtggtacactccgagtcgacggtcccgagtaccgaccgaccgtaccgtccgggactcccaggacgtactcttccgtctcgccctcgacgcgtacgaggtctacggtcgaccctacgtgactagtcgngggtccggcgtagggtagacgtagagactcgtagtacttactcgttacggaccacacgaagtacgtagtacggtcgtactaggtacgggtacgggttcgaccggggaggtaccggtactacggttaccggcgttccggtggtacccgaccgtaccggtaccggtcccgttcccgtaccccggtgtaccccttcgtcccggttaccccc

SEQ ID NO: 89214 - DNA, 712 bp, Homo sapiens
  misc_feature: GYAE6OF01ELLXU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacggcctcctatgagctgacacacgcccacccgtcggtgtcagtcgtcccaggacaacgcagactcacctgctgtggatatacattgaccaaaagatacttacgttgttggttccagcaagaacgtcgaggccacggcccctgtactggtacatccatggacggaccagtccgacgaccaccgtaccgggactcccgtggagacgtattcctacgtccgccctaccacgtcctacggaacggtaccgagtccgggtaccctaccgttacgacttaacgtcgtacgggtccggggacccggagggtacggacccggtaagtacggacgaccgttagtaacttacgttagtttacgtaaccgtaccaaccgtacgaacgtaagtacggttaggtacgttaaggtacgggttaacgggggttacggtaccggggtaacgggtaacggggtaaccgttaacgggttaccgggtacccggtttcggtttacgggaccggtaacccggacccggtaggtacccgttcccggtaccccccgttaccggtcctaacccgttcccggtttacccccggg

SEQ ID NO: 89215 - DNA, 752 bp, Homo sapiens
  misc_feature: GYAE6OF01CVBOJ.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgacggcctcctatgagctgacacacgcccacccgtcggtgtccagtccgtaccccgaaggaaccaaaccggccaaggactccacctcgccttcgtggagtactttcagttacggaaacctaaaaagtaattacttaaccgtttggtttcgggtttacccaagtaccgaaggtaaacggtccgaacgggacccgacggtcccccgttaggttaccgttcgggtccacgtccagttcggacggtacccgaggtccggaacgacctaccgtccggggactcccgtagacgtagtacttctcgtcgtcctccgacgcgttcggacgggactggtaccgaccctacgttacgaacgttagtaccggtacgggtccggggaccgtagggtacgggaacgtaacgtacgaacggtcgtacgtaaccttaacgtttacgttacgtttaaccgtacacccgtaagtacgtaaggtacggtggtacgtagttacgggtaggggttaacggttcgggacgggaacgggtaccgtaaggttaccggtacccggttcgttcgggtacaccggtacccggaacgtccgtacccgtccccggtaccgttctaccctcgtttacccccg

SEQ ID NO: 89216 - DNA, 706 bp, Homo sapiens
  misc_feature: GYAE6OF01BQCIX.21.8.A08.1.454.CMB.1.raw
  modified_base (174)..(174): a, c, t, g, unknown or other
  misc_feature (174)..(174): n is a, c, g, or t
  modified_base (386)..(386): a, c, t, g, unknown or other
  misc_feature (386)..(386): n is a, c, g, or t
  modified_base (505)..(505): a, c, t, g, unknown or other
  misc_feature (505)..(505): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccagtggaggtttggctgagtcgttgggttttcctccttgtcttcttttaagnggtgtccagtgtcgaggcgacaacgtggtggagtcggtgggggacggcagtcggtccaggcccgtaggggtcgtcccgtggacgccctctccgtggtgcgaggtcgtcgtagggtacttacgtacggtcgtccgggtcttcctttacggacctagtcgacgtcggttcgggtccccgcgacgtccgtaccgaggacggaacgggcgtagggnggtgggtaggcgttagttagtcgtaggtatgagtaggagagagaatattaattactacgtacgtaccgtacgggtacgacgggtacgtacttaccgaactacgtacgtaccaacggaanaaccgtagtaccgaaccgaaacctaacgtaacctacgttacgttaacttaccttaaccgaacgttaccggacccgtacggtacggaacggaccggacggaccggaacgtcggacttagttagtaacgtttacggagtacggttcgttcgtttcggacgttacgggcggtaaacccggtaccgggtacccgttggtaccccg

SEQ ID NO: 89217 - DNA, 611 bp, Homo sapiens
  misc_feature: GYAE6OF01A2GK4.21.8.A08.1.454.CMB.1.raw
  modified_base (422)..(422): a, c, t, g, unknown or other
  misc_feature (422)..(422): n is a, c, g, or t
tcagtcgtcgctcgcacgaccggtgctcgatttagcatactctacagggggctgtgggctcaggaggcaggagcgtctgggaatctcaccgatggcctggacccctctcctcgctccccctccgtcactttctgcacagtctctgaggcctcctagtgagctgacacagccacccgtcgggtgtccagtcgtccccaggacgaaacggccgaggatccaccgtgctctggagatcattgaccaaaagatatacgttcgtggttccagcagtaacgtcaggccacggccccctggtacctggtaccatccgatgacggcagtcggaccacaccgttccgggactcccgtgacgtgactttcctcgtcgtaccctcgacgaccgtcgacgggacctaggtcggaccctacgtcgacttactcgnggtcggggccgaggtcgaacgtgtagaacgtgacgtactacgttattcggtacgcctacgaagacgtacgttaggtgtactaggtcggtaaggggttgtcggacgggaggaccgtaaggtccgacccggttcgtaggccacgggccccgagggcctccggtcccccgtggtccctaccgtccgttcccg

SEQ ID NO: 89218 - DNA, 806 bp, Homo sapiens
  misc_feature: GYAE6OF01CFA6I.21.8.A08.1.454.CMB.1.raw
  modified_base (104)..(104): a, c, t, g, unknown or other
  misc_feature (104)..(104): n is a, c, g, or t
  modified_base (129)..(129): a, c, t, g, unknown or other
  misc_feature (129)..(129): n is a, c, g, or t
tcagtcgtcgctcgcacgaccggtgctcgatttagcatactctacagggggctgtgggctcaggaggcagagctctgggaatctcaccatggcctggacccctntcctgcctccccctctctactttcngcacagtctcgtgacggtcctcctatgacgctcgacacacgcccacccgtggtgtcacggttccgtaccccgaaggaaccaaccgggtccaaggtactccacctgcctgtaggagtagtacggacctagtaacaaaagtaaacttgtcgtacgtttaacgttacggaaaccaaacgtaacggaaccgtacccggaacgggacccgtaaccgggtccccgttagggttaacggtttacggtagtaaacttaattaaaacggtaaacgtaccgtaaccggttaggaaccgggtacccgtaccccgttaagaacgggtaaacgttaccccgttaccccggtaaggtaccggttaccggtttaacgttttcccggtaccggttcccgggtaaccctaccggtaacggtcccgtaacgggaacggtacgtacgtacgtaccgtacgtaacgttacgtaaacctgtaacgtaggttacgaacgtccgtaaggacgaaggacggacgtagtaccttaatacgtactacaacaaacgtggaacacgtaaggtagtacgtactgttaggttgggtaccggtagggacggtacggtaacgacggttcctacgggtaacccgttcgggtaacgtacccggacggtaaccccgtaggtcccccgtaacccgtccggtaccgttaccccg

SEQ ID NO: 89219 - DNA, 698 bp, Homo sapiens
  misc_feature: GYAE6OF01CASAQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctcgtggatattcattcgaccaaaagattatacgttgttcggttaccagacaagaacgtcgacggccacggcccctggtacctggtacacttccagtggtacggccacggtaccgaacgaccgacggtcccgggtactcccgtaggaacgtagtactttccgtcgtcgccctaccgagtcccgtacggacgggtaacgtacggtccggtacccgtaacccgttgaaccttaacgtcgtacgggtcggggacccgtaggggtacggacggtagtacggaacgtcgtacgtaacttaccgttagttacgttaccgaccaccgacgtaacgtaggtacgtacggtacgtagtacgggtaggggttacggtacgggacgggtacgggtaccgtacggttaccggtaccggttccggttacggtaccgacggacccgtaacggccgtacccggtcccccgttacggtcccttaccgttccgttccccgg

SEQ ID NO: 89220 - DNA, 767 bp, Homo sapiens
  misc_feature: GYAE6OF01DH1IM.21.8.A08.1.454.CMB.1.raw
  modified_base (133)..(133): a, c, t, g, unknown or other
  misc_feature (133)..(133): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactctctgcacnggctctgacggcctcctagtgagctgacacacgccaccctcggtgtcacgtcgtccccgaaggacaggaccggccagggtactccaccgtgccgtctacgacagagtcgggtactacggaacctaaaagtaaattagttacggttactttacgttaacgggtaaaccaacgaacggaaacgccgaacggtaccgacggtccccgttggttacggtttagtagtaacttaaataagtaaaacgacctacgtaggaacgtaccggtaccctacgaacggtacgtaaccttcccgaggtacggtacgttacttcccgttacggtcggtaccgtacccgtaacggccgttaaccggaacggggaacctacggtaccggtaacggttaccgtaacgttaccgtaacgttacgttacggtaagtacgggtaacgtccggagggaccgaaaggggaccggtaacgggaccggtacgtttacggtaacgtttaacgtttacgtaacgtaaccgtaaacgagtaacgaacgtagggtaacgtacggttactaggttagggttcgggttgggaccgggtagggacgggtaacgacgtccggtaacgcccgttacgggtacgtacgaccggtacgtcggtccccg

SEQ ID NO: 89221 - DNA, 972 bp, Homo sapiens
  misc_feature: GYAE6OF01AL4GU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccctacccgtggtcgtcgaggttccgtaccccgaaggaacccgaaaccgggccgtaagggtacttacccgacccgttcggtcccttacggtagggtaacttactttaccgtaagtttaccggaaaacccgtaaaaaaaggttaactttaacgttttaaccggtttttacgggttttaccggtttaaccccgaaggtaaccgtaaacgggtaaaccggttccggaaaccggggtccccgtaacccggggttccccccccgttaaggtttaacccggttaccgggttaccctaaccgtttcccgtaacgtacggggtaaccggacccgtaacgggttacccggaaccggtaaacccgttacccgggttaccccggggtaaccttccccggtaagggtaacggtaacggttacctttcccgttaccgttacccggtaccccctaccggtacgtcccgtaaccgggacggggtaaccctacgggtcccggtaaccccgttaccgtttacgtaacccgttaacgtccgggtaacggggttccggggacccggtaacggggtcgggaacgtacgtacggtaacgtcgttaacgtaacccgtttaacgttacgttttaccggtaacccgaccgtaaccgtaacggtaacgttaccgggttaaggttacggttaccgtacggttacgggtaacggggttacgttccggggaacgggtacggtacggtacggttaccggaccgttccggttaggaccgtccgacccggagtccccgtacccgggtcccctacggtcctacccgttcccgtaccccg

SEQ ID NO: 89222 - DNA, 662 bp, Homo sapiens
  misc_feature: GYAE6OF01BGDIZ.21.8.A08.1.454.CMB.1.raw
  modified_base (180)..(180): a, c, t, g, unknown or other
  misc_feature (180)..(180): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccctacccgtggtntcagtcgtacccgaggaccaaacggccaggactccactgctcgtggagtattcattacgaacctaaaagtatattacgttggttcgttacagacaagacgtcgacggccacggtccctagtacgtggtacactccagtcggacgccagtcgacgactaccgtcggactccgagacgactcttcncgtcncctcgacgtctacggacggtcacggtccgtacctacttcggaacttcgacggtacgggtccgggaccgtagggttacggaacgtagtacggaacgtcgtaacgtaacctttagtacgtttaccgacgaccgtaacgacgtacgtaggtacgtcgacgtacgtacggggtagggttaccgtcgggaaccgggacggtaaccgtaggttaccggtaccggttcggttaaggaccgtaccgacccggtacgtcccgtaccccggccccgttaggaccttccgttcccgtacccccg

SEQ ID NO: 89223 - DNA, 708 bp, Homo sapiens
  misc_feature: GYAE6OF01AJJ1Y.21.8.A08.1.454.CMB.1.raw
  modified_base (104)..(104): a, c, t, g, unknown or other
  misc_feature (104)..(104): n is a, c, g, or t
  modified_base (136)..(136): a, c, t, g, unknown or other
  misc_feature (136)..(136): n is a, c, g, or t
  modified_base (174)..(174): a, c, t, g, unknown or other
  misc_feature (174)..(174): n is a, c, g, or t
  modified_base (370)..(370): a, c, t, g, unknown or other
  misc_feature (370)..(370): n is a, c, g, or t
tcagtcgtcgctcgcacgaccggtgctcgatttagcatactctacagggggctgtgggctcaggaggcagagctctgggaatctcaccatggcctggacccctntcctgctccccctctcactttctgcacagtcnctgaggcctcctatgagcctgacacagccacctcggtntcagtcgtcccaggacaacggcaggatcacctgctctggagtacttcattcgacctaaaaagtatactactttaggttggttcccagccaagaacgtcaacgggccagggtcccctggtaacctggtacaagttccaatcgacggccctaagtcgacgaccaccgtccgggaactcccgtagacgacgtactttcncgttcgtccctccgagccttaccgaaggggaccctagggttaccggcccctaacccgtttgggaaccttaagtcggacggttcggggacccctaagggtcgggtaacgacgtacgaaacgtccgtagtaaccgttacgttaattacggttaccgacctaaccgacgacgtaacgttaggtcggtacgtacgtaacggtaacgggggttaccgttacggggacggtacggtaaccgtaaggtttaccggtacccggttccttacggggttaccaaccgggtacccgtaagggcccttaccgggcccccgttaggttaccctaccgtttcgtacccccgg

SEQ ID NO: 89224 - DNA, 733 bp, Homo sapiens
  misc_feature: GYAE6OF01AN48H.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggaccaaacggccaggatccacctgctcgtggagtattcattgaccaaaagaatatacgttgttgtaccagcagagtcaggccacggcccctagtacgtggtacacgtccagtcgacggaccagtaccgacgacgaccgtcccgggactcccgtgaacggacgtacttcctccgtacgtccctaccgacgtacctacggacgggacgtacgggtccgacccttaccgttacgtaccttaacgtcgtacgggtccggggccgtagggttacggacggtagtacggtaacgtcgtacgtaaccgtttacgttaagtttacggtaaccaccgtaaccgaaggtaaccgtaaggttaagggttcggtaacgtacggtaacgggttaggggggttaccgttaccggggaacgggtaccgggacgttaaacgggttcccggtaaccggtttcccggttacgggtacccaccggtacccccgggttaaggtccccgttaccccgggtcccccggttaacgggccccgttacccgttcccgtttaccccccgg

SEQ ID NO: 89225 - DNA, 802 bp, Homo sapiens
  misc_feature: GYAE6OF01B8VC6.21.8.A08.1.454.CMB.1.raw
  modified_base (294)..(294): a, c, t, g, unknown or other
  misc_feature (294)..(294): n is a, c, g, or t
  modified_base (440)..(440): a, c, t, g, unknown or other
  misc_feature (440)..(440): n is a, c, g, or t
tcagtcgtcgctcgcacgaccggtgctcgatttagcatactctacagggggctgtgggctcaggaggcagagctctgggaatctcaccatggcctcggacccctctcctcgcctcccctcctcactttctgcacagtctctgacgcctctatgagctgaacacagcccaccgtcggtgtcagtccgacccgaggaacaaacggccaggactcactgactcgtaggatacttcattacgaacaaaaagattattacttggttacgtaccaggtacaaggaacgtcacgggtaccncgggtacccttgtaccgtggtaccaactccagtagaccggacctaggaccgaacgaaccctcgtaccgggtactcccagggaacagttactttcgcctcggaccctcccaagtcgccggaagggactaggtcccgaacctacgttnaacgtctcggaggtccgggaccgagggtcgggaacgtaagtacggaaacgtgtaacgtaacttaacgttaacgtttacgggtaaccgtacccgaaccgtaacggaacgtttaacgggtaacggtttacggttaaccgaacgtttaccgggggtaaagggggtttaccgggttacggggaacccgggggttaaaggggtaaacccggtttaaacggggtttcccggtaaccccgggtttacccgggttacgggggttaacccacccgggggtaaacccccgttaacggtccccgggttaaccccgggttacccccccgttacgggttaaccctaccccggtttcccgtttaccccccccgggg

SEQ ID NO: 89226 - DNA, 743 bp, Homo sapiens
  misc_feature: GYAE6OF01AVUZ2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtcccaggacaacggccaggactcacctgctctggatattcattgaccaaaagatatacgttggttgttccagcagagtcgagccaggccctgtactggtcactccagtggacggaccaggtcgaaccgacaccgtccgggatcccgtgaagtatacttccgtctcgccctccagtcctacgaacgggctacgggtccgtacccgtaaccgtttgaaccctttacgtaccgtaacggggttaccggggtacccgggtaacgggtaacggggtaaccggtaagttaacggtaacggttacgtaacggttaacgtttaaccgtttaacgtttaccgggtttaacccgaccgtaacccgtaacggtaccgtaagggttaacggttacggtaccgtaacggttacggggtaacgggggttaccggtacggggtaccgggtaaacgggtaccgtaccggttaacggttaaccccggttccggttacgggtaccgacccggacccgtaacggtcccgtaccccggttcccccggttacggtacccgtccgtttcccgttacccccgg

SEQ ID NO: 89227 - DNA, 848 bp, Homo sapiens
  misc_feature: GYAE6OF01BGXP3.21.8.A08.1.454.CMB.1.raw
  modified_base (829)..(829): a, c, t, g, unknown or other
  misc_feature (829)..(829): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgccccaggaccaaacggccaggactcacctgcctcgtggagtacttacatttacggaacctaaaaaggtaattaacgttaacttttggtttacgggtttacccaaggtacctaaagggaaaccgttccgaaacggggccccgtaaccggggtcccccctttaggttaacccgttcgggtaccctaactacccgtagttacggaccggtaccctaacgggtaccggaaccggaacctacccggtaccccggggtaaactccccgttagggaacgtacggtacgtttccaccgttcgacccttaccacgtcgtacggaacgggtactagggtccggtacccttaccgtcgtacttacgtcgtacggtccggggaccgtaacggggtacggaccggtaagtacggtaaacgtaccgtacgtaaccgttaacgttaacggtttcggttaacccggtacgtaacccgtaacgtaaccgtaacggttacggtacgggttacgtacggttacgggtaacgggggttacggtacggggtacgggtaacgggaaccggttaacggttaccggtaccgggtttaccgttacgggtaccggaaccggtacccggtaaccggtcccggttcccggtccccggaccggttttttacccnccgtttcccgttcccccgg

SEQ ID NO: 89228 - DNA, 745 bp, Homo sapiens
  misc_feature: GYAE6OF01B9X25.21.8.A08.1.454.CMB.1.raw
  modified_base (142)..(142): a, c, t, g, unknown or other
  misc_feature (142)..(142): n is a, c, g, or t
tcagtcgtcgctcgcacgaccggtgctcgatttagcatactctacagggggctgtgggctcaggaggcagagctctgggaatctcaccatggcctcggacccctctctcgcctcccctcctctactttctcgacactatctntagacggcctcctatgagctagacacacgacccacccgtcggtctacgacgttccgaccccgaggaaccgaaaccggccaaggactaccaccgtgactcgtaggagtacttcattacgaaaccaaaagtactacttacgttcgttacggttacacgtacgaagtacgtacgaacggaccacggtaccccctaggttaacgtcggtacgtactacgtacgtacggaccggtaccacggtaccggaacgaaccgaccggttaccggacctccgtaggaacgtagtaccttcgacgttcacccgtacgtacgacgtacggaacggaccgttaacgccggtaaccgtacgttacgtaacctttagaccggtagggtaccggccgtagggtacgaacgtagtacgaactggtacgacgtttaaacgtcgtacgtaaccgacctaagacgtaacgtagtacgttaggaacttcgaacgggtagggtaccgggcggtaacgggaacgggtactaccgggttcaccggtttaccggtgaaccgtttacccgggacgtaccggtcctaccccggtacccgaccgtttacggttaccctcccggtacccccgg

SEQ ID NO: 89229 - DNA, 665 bp, Homo sapiens
  misc_feature: GYAE6OF01CGNME.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcgttgggttttcctccttgcttcttttaaagaggtgtccagtgtcgaggcgctaacgtggtggagtcgtgggggagcagtcggtccaggccgtggggacggtccctgacgtcctctccgtgtcgcaggtcgtcgtgggtattcaagttacgttccggtccttcccgtttgccctagtcggcctaccggtcggggtaccccgcccgaggtccctccggagggccggaaagggggctggggaggtcgggggtggaccgtaagtttacgtcgtagggttatggaggtagggtaagtgaagtagtaatttaagtttctacgagtccgtacggaggtaacgggacgtacgttaccacctacgtaccgtaccgaacgaacaacgaactacgaaccaaaccaacactactagttactactacgaagtaccggaccgcgtagacgacggaccgacgacgagactagtagttacttacgtagtacgtgtacgtttggcgtacgtcgggaccgacgggtaacccgtcggtacccg

SEQ ID NO: 89230 - DNA, 652 bp, Homo sapiens
  misc_feature: GYAE6OF01EIM8H.21.8.A08.1.454.CMB.1.raw
  modified_base (178)..(178): a, c, t, g, unknown or other
  misc_feature (178)..(178): n is a, c, g, or t
  modified_base (260)..(260): a, c, t, g, unknown or other
  misc_feature (260)..(260): n is a, c, g, or t
  modified_base (340)..(340): a, c, t, g, unknown or other
  misc_feature (340)..(340): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacggcctcctatgagctgacacagcccacctcggtntcagtcgcccaggacaaacggcaggactcactgctcgtggatatcattacgaactaaaagattatacgttggttgtaccagngaagtaagcgacggccacggtcccctagtacgtgtcactccagtcggacgccgagtccgacacctacgtacggactccgngaagtgtacttctccgtcgtaccctacgacgtctacggaacggactaggtccgaccgtaacctttggaaccttacgtacgtacggggtaccgggtaccggtacggggtacgggacgtagtaacggaacgtacgtacgtaacttacttacgttacgtaccgtacaaccgagtacgtaagtagtcgtactacgtacggtaggggtacgtacgggacgggaacggtacgtacggttaccggtaccgttcggttagaccgtacgtacccgtaacgtccgtcccgtaccccgtacgtaccctacgtcccgttacccg

SEQ ID NO: 89231 - DNA, 809 bp, Homo sapiens
  misc_feature: GYAE6OF01CVI0C.21.8.A08.1.454.CMB.1.raw
  modified_base (127)..(127): a, c, t, g, unknown or other
  misc_feature (127)..(127): n is a, c, g, or t
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttcngcacagtctctgacgcctctatgagctgacacagccaccgtggtntcagtcnccgagacaacgcagactcactgctcgagagtactactagtacgaacctaaaaagtacttacgttacgttcggttacggtacccaagtcgtaacggaacgtcgaacggccgtacggtcccctaggtactggacactccgagtcggaccgccgaaggtccgaaccgtacaccgggtaccggaccttacccggaggaacgtacgtttaccgttcctcgttcccgacccttacgaacgttcgtaccggaagggtaacctacgggtccggtaacccttacggttaacggaaccttacgttaccgggaacgggggttacccgggaacccggtaaggggtttaaccggaacggtttaaacgttacggggaaaacgttccgttaacggttaaaccgtttacgtttaaccggtttaacgacccggaaccgtaacggaacggttaacggttagtacggggtttacaaccgtcggggtaacgggtacggggttccggacggggacgggttaaacggcccgttttaaacgggccggtaccccgttttcgggttaccggaaaccgtccccggggaaacgttcccgggcccgttaacccgggcccggtttaccgacccgtttaccgtccccgttttacccccgg

SEQ ID NO: 89232 - DNA, 1078 bp, Homo sapiens
  misc_feature: GYAE6OF01AKLWB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgttcggtgtccagtccgtccccgaggaacgaaaccggccaggactccacctgctcgtaggagtattcattcgacaaaagactattacgttgttcgtaccagcgaagagtccgacggccgacggtcccctgtacgtcggtacactccgagtcggacggacctaggtaccgaccgaacgtacccggtacccgggtacctccccggtaggacgacggttactttaccgtccgtaccggtcccctacccggtacgtacccgttaccgggacggggtaaccctacggggttcccggtaacccccgtttaaccggtttaaccgtaaacccgtttaacgttacccggggtaacggggttacccccggggggtacccggtaacggggggttacccggggtaaaccggtaacgggtaacgggtaaaaccgggtttacccggttaacgggtaaaccccgtttttaaacggtttaacggtttttaaccccgggttaacccggtaacccccgtaaaccggtaaacccggttaaaccgggttaaacgggtttaacgggggttaccccggggtttaaaccggtacgggtttaaaccccgggggggttaaacgggggggttttacccggtttaccggggggggtaaaccccgggggttaaaacccgggggggttaaccccgggtttaaaacccggggtttaaccccgggggtttaaaccccccgggtttttacccgggtttaaccgggggtttaacccccccgggttaaaaccggggtaacccccccgggttaaacccggggttaccccccccgggtttacccccggggtttaacccccccccccgggttttaccgggttaacccccccggtttttaccccccggtttacccccccgggttttttacccccccccccggggg

SEQ ID NO: 89233 - DNA, 847 bp, Homo sapiens
  misc_feature: GYAE6OF01AJ7N6.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctctcactttctgcacagtctctgacggtcctcctatgacgcctagaccacgacgccctaccttggtctctagtccgtccccgaggaaccgaaaccggccaggactccaccgtgctcgtaggactacttccagttacgaaacctaaaataacgttacttacgtttacggtttaccgttaccgaacgtacgaacgttaaaccggtcgtaccgggacccgaccggttcccccgttagtaaccggtcggttccaaccgttccgtaaagttcgggaccggtaccggtaccggttaccggaaccgtaccgtaacccggttcccgggtaaccttaccccgggtagaacgggtaaccttacgtttccctacgtcccgtaccgtcccgtaagtcccggtacgacggtactacgggtacccaccgtttacgtcgaaactcgtaccggtcggtaccgggaccggtacggacggtaccgtagtacgacggtacgtacgtaacgttcttacggttacgtaccgttacgaacgaccggtaagtacgttacggtacgtacgtaggtacggttacggggttaccgttaacgggaccggggttaaacggtaacggttaccggttaaccggtacccgggtttacggttaccggtaccgggtaccgtaacccgggtacggtaccccggttaccccggtaccccgtttaccccgggtaccgttaaccgttcccccggtttaaccccggg

SEQ ID NO: 89234 - DNA, 732 bp, Homo sapiens
  misc_feature: GYAE6OF01CDA2R.21.8.A08.1.454.CMB.1.raw
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctctatgagctgacacagcccacccgtcggtgtcagtcgtaccccgaggaccaaacggccaggatccactgctcgtggatattcattcgaaccaaaagattatacgttgttggttacaagtccaagaaggtccaggccaacggccccctgtactggtcatccatcggacgccagtcgacgacacgtccgggaactcccgngaacgngtacttcgtctcgccctaccgagtccgttcgaagggtaactcgggtcggacccttaccgtttagaaccttacgtacgtacgggttcggggcccgtaggggtacggacggtaagtacgggaacgaccgttacgtaccgttaacgttagttttacggttaacccgaccgtaaccgaacggtaacgaacggtttagttacgggtactaacggttacggtaacggggggttacttccggggaccgggtaaacggggtaaccgttaaggttaccgggtaccccggtttacggtttccgggtacgtacccggtaccccgtaaacgggtcccgttacccgggtaccccccgttaggtttcccctaaccggttcccgttaaccccccggg

SEQ ID NO: 89235 - DNA, 737 bp, Homo sapiens
  misc_feature: GYAE6OF01AFKXY.21.8.A08.1.454.CMB.1.raw
  modified_base (104)..(104): a, c, t, g, unknown or other
  misc_feature (104)..(104): n is a, c, g, or t
  modified_base (138)..(138): a, c, t, g, unknown or other
  misc_feature (138)..(138): n is a, c, g, or t
  modified_base (373)..(373): a, c, t, g, unknown or other
  misc_feature (373)..(373): n is a, c, g, or t
tcagtcgtcgctcgcacgaccggtgctcgatttagcatactctacagggggctgtgggctcaggaggcagagctctgggaatctcaccatggcctggacccctntcctgcctccccctctcactttctgcacagtctntgagcctctatgagctgacacacgcccaccgtcggtctacagttcgtccccaaggaaccaaacggcctaggactccacctgctctaggatactttcattcgaacctaaaagacttatacttggttcgttaccagacgagaacgtcacggccacggccctagtacgtcggtactatccgaatcggacgcgacgtacgacgacaccgtcggactccctgacgactacgttcctacgngtacactaccgagtccgtcggaacggactacggtccgtacctacgttacgacttacgtacggacgggttccggggacccggagggtttacggaacgtacggtaacgacggtaccggttaacgtaaccgtttacgttaacgtttacgtttaccggaacctacccgggtaaagtacgtaaccggttacggtcgttaacgagttaccgggttaagggggttacgtcggggtaaaccgggtacggggaaaccgttaaagggttcgggtaccccgttttacggttacccgggtacgtaaccccgggtaccgtaaccggttccggttaccccggaacccccgtttcgggacccgtttaccgttccccggg

SEQ ID NO: 89236 - DNA, 727 bp, Homo sapiens
  misc_feature: GYAE6OF01E1FSY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatcacctgctcgtggatattcattgaccaaaagatatacttgttggtccagcagagtcaggccaggcccctgtactggtcatccagtcgacggccaggtcgacgacaccgtccgggactcccgtgagtacgtacttcctcgtcgccctccgagtccgtacgacgggactacgggtccggtaccctaccgtttacggaccttacgtaccggtacgggtccgggggtaccccgtaggggtacgggaacgtagtacggaacgtcgtacgtaaccttaacgttagtttaccggttaaccgcctaaccgaaggtaaccgtagggtttaacggtcggttacgaacggttaccggggtaacggggggtttacgttaccgggggaacgggtaccggggtaaccgttaaacggggttaccggtaccccgggttttccggttacgggaccgtaccggaccccggtaaagggtcccgttaccccggtacccccggttaccggttaccctacccgtttcccgtttacccccgg

SEQ ID NO: 89237 - DNA, 730 bp, Homo sapiens
  misc_feature: GYAE6OF01DN0UW.21.8.A08.1.454.CMB.1.raw
  modified_base (224)..(224): a, c, t, g, unknown or other
  misc_feature (224)..(224): n is a, c, g, or t
  modified_base (376)..(376): a, c, t, g, unknown or other
  misc_feature (376)..(376): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccttcctatgagctgacacagcccaccctggtgtcagttcgtccccgaggacaaacggccaggactcacctgctctgganattcattgaccaaaagattattacttgttgttccagcagaagtcaggccacggtcccctgtactggtcacgtccagtcggacggccagtccgacgacaccgtccgggactcccgtagagacgtattctcgtcgccctccgagctcgaggacnggtcgcctaccttgactagtcgtacggccggggtaccgagggtacggacgtagtaggaacgtcgtacgtacttaacgtttagttcggttaacccgacgtaacccaacggtaacgtaaggtttacggttacgggttacgtaacggttacggggtaacgggggtttaccggtttacgggggaaccgggggtaaccgggttaaccgggttaaacgggtttacccggaaccccgggttttacccgggtttagggtaccggtaacccggtaaccccggtaacgggttcccgttacccccgggttaccccccgtttacccgggtttacccttcccgggtttccccgttttaccccccggg

SEQ ID NO: 89238 - DNA, 783 bp, Homo sapiens
  misc_feature: GYAE6OF01CA9JI.21.8.A08.1.454.CMB.1.raw
  modified_base (140)..(140): a, c, t, g, unknown or other
  misc_feature (140)..(140): n is a, c, g, or t
  modified_base (150)..(150): a, c, t, g, unknown or other
  misc_feature (150)..(150): n is a, c, g, or t
  modified_base (178)..(178): a, c, t, g, unknown or other
  misc_feature (178)..(178): n is a, c, g, or t
  modified_base (240)..(240): a, c, t, g, unknown or other
  misc_feature (240)..(240): n is a, c, g, or t
  modified_base (503)..(503): a, c, t, g, unknown or other
  misc_feature (503)..(503): n is a, c, g, or t
tcagtcgtcgctcgcacgaccggtgctcgatttagcatactctacagggggctgtgggctcaggaggcagagctctgggaatctcaccatggcctggacccctctcctgcctcccccctctcactctctgcacaggctcngagcctctangagctagacacacgccctacccgtggtntccaggtccgtacccccgaaggaccaacggaccggaccaaggtactccaccgttggctccgngacaaggtacgtacgggactacggaaaccaaaaagtaactagtacgttacttaacgttacggaaccaaagaacgacgaccgacggtaccgaaccggtcccttaggttaagtttaggtagtaataaacgttaaacgaaaacgtaccaacggtacgaacgtaaccggtcccctaagaacgtaacggtaccgtccgtaaggaccggtacttaacgttcctggtccggtaccttaccggacgttaccgtaacgggaaaggtaacccncgggtaaccgttaacggaccggtttaacttacggaaacctttacgtaccgggtaaagttaacggaaaccgtccggaaggtacggaagggttaacggacgtaggtaccttaacgtactttaaacgttccgagaaacctaaacgaggtaccaaagttacgtaggtacgtaacttcgttaagggtcgggtacgtaacggggtaccgggaaaagttccggataccccggttaccgaaccgttttacgggaacggtacccgaaaccggcccgttagggtaccccc

SEQ ID NO: 89239 - DNA, 761 bp, Homo sapiens
  misc_feature: GYAE6OF01CARYR.21.8.A08.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctctactttctgcacagtctctgacggccctcctatgagctgacacacgcccaccctcggtgtcacgtcgtccccgaggacaaaccggccaggactcacctgctcgtggagtattacagttacgaaccaaaagtatattacttgttcggtcagcagagtcgacgcacggccctgtacgtgcatccagtgacgcacggtcgaacgacgaccgtccggactcccgnggaacgagtactttcgtactcgccctacgacgtcgtaccggaacggaccgtacggtccggtaccccgtaaccgttcggaacttacggtaccggtacggggtacccgggggtacccgaggggttacggaaccggttaaaggttcggaaaggttccgtacgttaaccctttaacggtttaacgttaccgggtttaccgaaccgaaacccgtaaccggtacgtaacgggtacggttacggacgtacgggttaccgggttaagggggttacggtcgggggacgggaacccggggtaaccgttaaacgggtccggttacccggtttacccggtttagggacccggtacccgggaccccgtacggggtcccccgttacccgggtccccctacgggttcccctaccctttcccggttacccccg

SEQ ID NO: 89240 - DNA, 902 bp, Homo sapiens
  misc_feature: GYAE6OF01C9DYL.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgagcctcctatgagctgacacgacgccacccgtggtntcagtcgtcccaggaccaacggccaggactcaccgtgctctacggatacttacattacgaaacctaaaaaattttcgttttaggttttttacggaacctagacgaaggtaacgtcgaacggacccgtaccggtcccgttaggttcggtttcggtactaaccttcccgtaagttacgggaaacgggaaccggaacggggtaaccggaacccggtacccccgggtaccggggtaaccttccccggtaaggtaaacggtacgttaaccgttttccgttaccggtaccgggtcccttaacccgtaaaccgggttacgggaaccgggggggttaaaccgggttcccgggtacccggtttaaccggtttacggttaacccgtttaccgggttaccgggtaacggggggttacccggggggaaccccgggttaaggggggtacggggtaaacgggttacgttaacgggaacgtttaccggtaaccgttaaccgtttaaccgttacgttacggttaacctacggtacgtacgaacgtacgagtacgtggtacggtacgtacggtcgggacggggttcgacgggttaccgggagggtaccgggtaaccggttacgttccgggttaacccgttcggttacggtacggtacccgaacccggtcggtaccccgttcccggtaccccggttccggtaccgttcccggttcccgttaccccgggttccccgtacccccgg

SEQ ID NO: 89241 - DNA, 701 bp, Homo sapiens
  misc_feature: GYAE6OF01AKDKB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgaccacagcccacccgtcggtgtcagtcgtccccgaggaccaaacggccaggactcacctgctcgtggatattcattacgaaccaaaagtatattaccgtttggttacgttaccagtacgaagtaacgtcgacggacccgacggtccccctagtaccgttggtaccacgtccgtagcggtaaccggaccgacggtaccgaaccggtacccgtaaccggtcccgggaaccttcccgtagaggacgttactttcgtctcgccctcgacgtcctacggaggtactcggtaccgaccgtacctagtacgtacgtcggtacggggtcgggacccgtagggtacggacgtagtacggaatcgttagtacctttacgtagttacggtaaccacgtaacacggtaacgtagttacggtcgtacgtagtaccgggtaggggttacggtacgggacgggtaggtaccgtaggtccgtacccggtcggttacgggccgacggtaccggacgtcccgtacccggtcccccgtacggtacctcgtccgttaccccg

SEQ ID NO: 89242 - DNA, 777 bp, Homo sapiens
  misc_feature: GYAE6OF01A8SGT.21.8.A08.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagcatactctacaggggctgtgggctcaggaggcagagctctgggaatctcaccatggcctggacccctctcctcgctccccctcctcactttctgcacagtctctgacgcctcctatgagctgacacacgcccacccgtcggtgtcagtcgtccccaggacaaacggtccaggatcacctgctcgtgganattcagttcgaaccaaaagtaatattacgttgttggttacaagctaagaatcgacggaccgacggcccctgtaacgtcggtactactaccgagtcggaacggccgaaggttccgaacgtaccgtaaccggttccgggacctacccgttaggaacgtacggttaacttccgtacgtccgacccttcgaacgtcccgttacgggaaaggacccgtaggtaccggtcccctaacgttgtaaacccttgtaccggtacgggtacccggggtaccgtaacggggtcgggtaaacggtaacgtacgggaacgtacggtaacgtaaccgttaacgttagtttacggttaaccgaccgtaaccgtaacgggtaccgttaagggttaacgttaccgggaattacccggttaaggggttaacggggtacgttaccggggacggtaacggggtacccgtaaagggttaccgtcccggttacgtttaccgggacgtaccggtaaccggaccggttaccgtacccggtacccccgtaggtcccttaaccgtccggtttacccccgg

SEQ ID NO: 89243 - DNA, 687 bp, Homo sapiens
  misc_feature: GYAE6OF01BG9I8.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtgganacttcattgaccaaaagatatacttgttgttccagcagaagtcaggccaggcccctgtactggtcatccatggaggccagtcgacgacacgtccgggactcccgtgagagacttctctgccctccgagcctacgacgggacagtcggaccctaccgttagaaccttacgtcgtagggtccggggcccgtaaggggttcggaaccggtagtacgggaacgtccgtagtaaccttacgttagtttacggttaccgactaacccgaagacgtaaggttacgttacgggtacgtaagttccgggtaagggggttacgtttaccggggacgggtaacggggaaccgtttaacgggttaccgggttacccggttccggtttacgggtacccggaaccggtacccccgtaagggtccccgtcccgggtccccccggttaccggtaccctacccgttccggtttccccccggg

SEQ ID NO: 89244 - DNA, 817 bp, Homo sapiens
  misc_feature: GYAE6OF01DF7HD.21.8.A08.1.454.CMB.1.raw
  modified_base (131)..(131): a, c, t, g, unknown or other
  misc_feature (131)..(131): n is a, c, g, or t
  modified_base (141)..(141): a, c, t, g, unknown or other
  misc_feature (141)..(141): n is a, c, g, or t
  modified_base (166)..(166): a, c, t, g, unknown or other
  misc_feature (166)..(166): n is a, c, g, or t
  modified_base (526)..(526): a, c, t, g, unknown or other
  misc_feature (526)..(526): n is a, c, g, or t
tcagtcgtcgctcgcacgaccggtgctcgatttagcatactctacagggggctgtgggctcaggaggcagagctctgggaatctcaccatggcctcggacccctctcctcgccttccccctctcactttcngcactagtcnctgacgccttcctatgagctagacncacgcccacctggtgtcagtcgtccccgaaggaacaaacggccaaggactccaccgtcgccttgtagggaacttacttacgaacgtttacgaaaaccgtaaaaaaggtaacttacgtttaccggttttgggtttaccggtttacccaaaggtacgaaacggttaaacggttaccgaaacgggtccccgtaaaccgggtccccccttaggtaccgttcgggtaacctaccgttaccgtaagtacggaccggtacccgacggtaccggacggtaccctaacggttccggaacgttccccagggagtacgtaactttccgtcgtacgccccgttagaccgtacgtaaccgggaggttaaccgngggttaccgaaccttaccgttacgtaacgtacgtcgaacgggtccgggaaccggtagggacgacgtagtacgaagcgtaagtactacgttagtactacgtccaacgtagtacgtaggtacgtagtcgtacggtaggtacggggttataccggggtaggaaccgggtaaacgtaccgggtttacggacccgggtttaaccgttccgggtacctacgggggtaacccctaaacggttcccgtccccggttacccccggttccgtaacccgtccctttccccggttaacccccg

SEQ ID NO: 89245 - DNA, 924 bp, Homo sapiens
  misc_feature: GYAE6OF01D89OW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtcgggtctcgacggttcgtacccccgaggaaccgaaaaccgggccaaggactccaccttcggccttcgtagggatactttccgtaagttacggaaccaaaaaagtaattactttaaccgtttggttttacggtttcccaacggacctaaaggaaacggttccggaaccgggccccgtaacggggtcccccccttaggttaacccgttcgggttacctaacgttaccccgtagttagggaaccgggacccgtaagggtaccggtaaccggaacccgtaccggtacccggggtaaccttcccgtaaggacggtacgtacctttcgtccgtcgtccctaccgacggtaccgtacggaacgggtaccgtagggttccggacccttaaccgttcgtaaccgttaacgtaccgggtacgggtaccgggggacccggtaggggtacgggaaaccgtagtaacggtaaggtccgtaacggttacttaacgtttaacgtttacggtaaccgtaccaaccggaacgtacgtaacggttacggttaacggtacgttaacgggttacggggtaagggggtttaccggttaccgggggaagggtaaacccggggtaccggttaaaacgggtttacccggggtacccggtttccgggttttaacccgggaccggtaaccgggtaccccgttaaccggggccccgttacccggtacccccccggttacgggttcccctacccggttcccggttttaccccccggg

SEQ ID NO: 89246 - DNA, 710 bp, Homo sapiens
  misc_feature: GYAE6OF01DWDKG.21.8.A08.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagcatactctacagggggtgggctcaggaggcagagctctgggaatctcaccatggcctggacccctctcctgcctccccctcctcacttttctgcacagtcctctgacggcctcctatgagctgacacagcccaccctggtgtcagtcgtcccaggacaaacggcaggatcactgctcgnggatattcattgaaccaaagatatacttgtgtaccagcaagaagtacacggaccacgccctagtaccgtgtacactcagtgacggtccgaggtcggacgacgtaccgtccgggactcccgtagacggatacttcctctcgtcccgtaccgacggtcctacggaaggaacgtacggtaccggcccttaccgttaggaacttacgtaccggtaggggtaccggggtacccgtaagggtaacgggacgtaagtaggtaacgtacgtacgtaaccgttaattacgtttaacggttaccgacgtaaccgaagaacgttagtacggtgttacgaggttacgggtaaggggttcggttaggggacgggtacgggaccgtaaaggtttccggtaccgttccgttcgggtaaccgtaaccggaccggtaaacgggtcccttccgggacccccccgttacgggttaccctacccgtttacccgttcccggttcccccgtacccccg

SEQ ID NO: 89247 - DNA, 758 bp, Homo sapiens
  misc_feature: GYAE6OF01BUFRS.21.8.A08.1.454.CMB.1.raw
  modified_base (420)..(420): a, c, t, g, unknown or other
  misc_feature (420)..(420): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacggcctcctatgacgctgacacacgcccacccgtcggtgtcacggtcgtaccccgaggaaccgaaacggccgaggactaccaccgtgctcgtggatagttcagttacgaaccaaaaagtaatacttacgtttggttcgttaccgagacaagaagtccgaacggtccgaccggtccccctaggtaccgtcggtacctactaccagtcggaccggtcacggtaccgaccgacaccgtcccgggacttccgagaacgagtacttctcgtcgtccctaccncgtcacggacggtacgaggtccgacccgtaccgttagacgttacgtaccgggagggtcccgggtaccgtaggggtacggacggtaacgtaggaaccgtacgtcggtaacttacgttagtttaccgtaccgaccgtaccgaagtacgtaacgggttggttacggtactacgggttacggggtacggggtttaaccgtcgggggaaccggtaacgggtaaccggttacgttacccgggttaccggtaccgtttagggcccggtaccggtacccgtaacgggtccccttcccgggtacccccgttaccggttacccgtccccggtttacccgttcccccgg

SEQ ID NO: 89248 - DNA, 973 bp, Homo sapiens
  misc_feature: GYAE6OF01B8TZQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctagacacacgcccaccctggtcgtcagtcgtcccgaggaacaacggcagactcacctgctcgtaggatacttcaacttacggaacctaaaaaggtactacgtttacgttcggtttcggtaccaagtaccggtaagtaacggttaccgaacggacccgtaacgggtacccccgtttaggttacccggttacggttaccgaaccgtttacccgtaaggttacgggaaaccggggttacccgtaacgggttaaccggaaacccggtaaacccgggttaacccccggtttaccccggggggtaaaccccgtttacccccggtaagggtaaaccgggtaccggtttaaccttttacccggttacccggttacccggtacccccgtttaacccggaaccggttacccggttaacccggggtaccgggggtaacccgttaccgggttacccggggtaccccctttaacccgggtttacgggtaacccctttaacggggtaccggtaacggggtttacccggggggaaccccgggttaagggggttaaccggggaacgggttaacggtaaacgggtaaccgggttcgttaacgtaacccgttttacgttaccggtttaacggtacccgtaacccgtaacccgtaggtaacgttaaggtaccgggtttacgtaacggtaccggttacgggtacggggggttaccgtacggggaaccggggttaacggtaaccggttaccggttcggtaccggttccgtagggacccgtaccggtaccgtacggcccgtaccggtccccctacggtacctccggtcccttaccccg

SEQ ID NO: 89249 - DNA, 852 bp, Homo sapiens
  misc_feature: GYAE6OF01CQPN7.21.8.A08.1.454.CMB.1.raw
tcagtcgtcgctcgcacgaccggtgctcgatttagcatactctacagggggtgggctcaggaggcagagctctgggaatctcaccatggcctcggaccctctcctgcctcccctcctctactttctcgcacagtctctgacggtcctcctatgagtctcgacacacgccaccgtcggtcgtcacgtcgtacccgaaggacgaaacggcaggactccacctgctcgtggatacttcacgttacgaaaccaaaaagtacttaacgttacgtttaggttcggttaacacgtacgaaacggtaacggtacgaaccgggtaccgtaaccgggtcccgttaggttaccgttcggtacctaacgttacccgaagtccgggtaccggacccgtaacgggtaccgaaccgtaaccgtaccggtacccggggtaaacctttcccggtaggacgtacggttaccttcgtcctcggtacccctcggaacgttacgcggaaacggtcgtacggtccgaaccttacgtacgtaacgttcgacggtacggggtccggaccggtagggtacggaacgtagtacggtaacgtcggtaacgtacttaagtttaccgttagtaaccgaccgttaacgaacgggttacgtaacggttagtcggtaaccgttaacgggtacggggttaacggggttacggtacggggtaacgggggacggttaaacccggttaaacgggttccggtaccccggtttaggttaccgggtaaccggtaacccgggacccggttacgggtccccttaccccggttcccccgggtaacgtttaccccttccggttcccggttaccccccggttacccttcccccggg

SEQ ID NO: 89250 - DNA, 756 bp, Homo sapiens
  misc_feature: GYAE6OF01AH6FJ.21.8.A08.1.454.CMB.1.raw
tcagtcgtcgctcgcacgaccggtgctcgatttagcatactctacagggggtgggctcaggaggcagagctctgggaatctcgaccatggcctggacccctctcctgctcccctcctcactttctgccacacgtctctgaggcctcctatcgagctgacacacgccacctcggtgtcagtcgtccccaggaccaaacggccaggactcacctgctcgtaggagtattcatttcgaccaaaagtattatactttggttcggttccagcagaacgtcgacggccacggccctgtactggtctatccatcgagcctagtcgactacgtaccgtccgggtactccccgtaggaacgtcgtaactttcccgttcacggtccccttccgagtccgtaccgacggggtacctacggtccgacccttacccgtttagaccttacgtcgtacggttccggggacctagggtacggaacgtacgtacgaaacgtccgtaacgtaaccgttacgttaacgtttaccggtaacccgacctaaccggaacgtaaccgtacggttaacggttacggtaccgtaacgtacgggttacggggttaaccgtttcgggaaccggggtacggaacccgttaacggttaccggtaccgtttacccggttacgggtaccaaccggtaccccggtaaacggtccccggttcccgtaccccccggttaccgggttacccttacccgttcccgtttcccgttaccccccgttaacccccg

SEQ ID NO: 89251 - DNA, 763 bp, Homo sapiens
  misc_feature: GYAE6OF01BSKH3.21.8.A08.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaacggccaggactcacctgctcgngganattcattcgaaccaaaagatacttacttggttcggttaccagacaagaagtcaaggccacggcccctagtactggtcagtccagtcgacggccagtcgaacgacacgtccgggactcccgtagaacgagtacttctcgtacgtccctaccgagtcctacggaagggtacaacggtccggacctaaccgttcgaacttacgtacggacgggtccggggacccgtagggtacgggaacgtaagtacgggaaacgtcgttaacgtaaacgtttaacgttaacgtttacggttaacccgaacgtaaccgtaaacgtaacgtaacgggtttaacgggttacggttaaccgttaaggttaccgggttaagggggggtttaaccgttacggggggaaccggggaaaccggggttaaacccgttaaagggtttaccgggtaccccggtttaccgtttaggggtaacctaccgggaaccccggtaaaggtccccggttacccggtaccccccggttacggtacccttaccgttcccggtttacccccg

SEQ ID NO: 89252 - DNA, 764 bp, Homo sapiens
  misc_feature: GYAE6OF01AZU1O.21.8.A08.1.454.CMB.1.raw
  modified_base (157)..(157): a, c, t, g, unknown or other
  misc_feature (157)..(157): n is a, c, g, or t
  modified_base (384)..(384): a, c, t, g, unknown or other
  misc_feature (384)..(384): n is a, c, g, or t
  modified_base (695)..(695): a, c, t, g, unknown or other
  misc_feature (695)..(695): n is a, c, g, or t
tcagtcgtcgctcgcacgaccggtgctcgatttagcatactctacagggggtggctcaggaggcagagctctgggaatctcaccatggcctggacccctctcctgccttcccccctcctactacctttctgacacagtctctagcggtcctctatgnctagacacacgccctacccgtggtgttaccgagttccgtaccccgaaggaaaccaaccgggtccagggacttaccgaaccctttgccgttcgtaggaacgtatttaccctagttaccggaaccttaaaaaagtaattagttaccgtttggtttacgggttaccagacgaagtaacgtacgacggaccgtaccggacccgttagtacgtacggtaccactcgaacggnggtaccgaaccgtagtaccggaccaacggtaccctacgggtactaccccggtagacgaactacttcgtaccgttcgcccgtacacggtacacgggacgggactacggacgtccctaacgttagtactaacgtagggtacggtaccgggcgtaggtacggacgtagtacgaagtcgaccgtaaccttaagtacgtttacaacggtactacgtacgaagtgtaagttcggtaaccgtaggtacgggtacgggttacgtaccggggacgtaaggggaccttaaagggtccggtacccgttcggtaggtaacccngggtacccggaacgtccgtcccgtaccccgtttacgcccgttatacccgttcccgggttccctcccccg

SEQ ID NO: 89253 - DNA, 752 bp, Homo sapiens
  misc_feature: GYAE6OF01B0VN3.21.8.A08.1.454.CMB.1.raw
  modified_base (160)..(160): a, c, t, g, unknown or other
  misc_feature (160)..(160): n is a, c, g, or t
  modified_base (273)..(273): a, c, t, g, unknown or other
  misc_feature (273)..(273): n is a, c, g, or t
  modified_base (567)..(567): a, c, t, g, unknown or other
  misc_feature (567)..(567): n is a, c, g, or t
  modified_base (626)..(626): a, c, t, g, unknown or other
  misc_feature (626)..(626): n is a, c, g, or t
tcagtcgtcgctcgcacgaccggtgctcgatttagcatactctacagggggggagagggagcccagcactagaagtcggcggtgtttccattcggtgatcagcactgaacacagaggactcaccatggagtttgggctgagcttggtttcctccttgctntttaaggaggtgtcagtgtcaggcgcaagtggtggagtccgtagggggagcagtggtccaggccgtgggacggtccctgacgtccctcgtcctagtcgacgagtcgtctaggntttaccgagttacgtccggtctttaccgttcgacctagttcgcctaccggtcgggtccgaccgagtcctcgagggacgaaggggtcgtagggacgtcgggtaggactacgtttagcgttaggtactggtacggtaggaacgtagacggtaacgttattaacgttacgtaacggaacgttaacccggtccggggtaagggtaaacccggggtcccttaacttaaccccgacgtaactttcccggaaccccggttaaagaaccgaaacgtttaaccgaccgtaaaccccgttaaanaaacccgtacgttaacccgttgttaacttaccgttaagaaaccgttcgggaaccccgtntaacggggacgtccggaccggaagccgtaccgtagtttactgggttaactccggtaagaacccggttgttccggtttcgacccggttagggtccggggaacccttacggggtactcggttaacccg

SEQ ID NO: 89254 - DNA, 1051 bp, Homo sapiens
  misc_feature: GYAE6OF01AMM6M.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccacccgtggtgtcaggtcgtaccccgaggaaccgaaacggccgaggtactaccaccgtcgtccgttcgtaggggtactactttacctagtttacgaaacccgtaaaaaaggtattaaacgtttaaccggttttgggttttaccggttttacccgaacggtacgtaacgggtaaacgttaccgaaccggggtacccgtacccggggtaccccccgttaggttaaccgttacgggttaccaacgtttcccgaaggttcgggaaccgggtccccgtaacgggtacccggaacccggtacccgtaacccgggttcccgggggtacccttccccgtagggtaacgtaacggtttccttccgttaccgtccgtaccccgttaccgtaacggtacccgtaccgggtaacggggaacccgtacggggtttaccgggacccccctttaaccgtttcggaacccgtttacgttaacccgggggttaacgggggttccccggggggtacccggttaagggggttacgggaaccggtaacgggtacggggtaaaccggttcccgttaaccgggttaactttaaccgggttaaacggttttccggtaacccggtacgtaaccggtaaggtaaccggggtttaaggtttaacggggtttacccgggtaaccgtttaaccgggggttacggggtttaaggggggggtttaccccggttacggggggaaacccgggggttaaaccggggttaacgttaacccgggggttttacccggaccccggggttttccggtttacggggaacccgtccccggttaaaccccggggtacgtccccgggttaccccccgggtcccccgtttaacgggttcccctcccggttttaccccgtttacccccgg

SEQ ID NO: 89255 - DNA, 608 bp, Homo sapiens
  misc_feature: GYAE6OF01A1YFG.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctctgganattcattgaccaaaagaatatacttgttcgttccagcagagtcacggccacggcccctgtactggtcatccatgacgccagtccgacgacctacgtccgggactccccgtaggacgacgactttctcgtcggtccctcccgagtcctacggaaggacaggtcgaccctaccgttgaccttactcgtaggtcgggccgtacgggtacggacgtagtagaacgcgtacgtaaccgttacgtagttacgttacgtacaccgaagtactagtacgtggtacgtagtacgtacggggtagttacgggacgggtagggacctaggttacggtacccggtcgttaggacgacgcccgaaggtccgtcgcccccgttaggcctcgttccgtacccg

SEQ ID NO: 89256 - DNA, 795 bp, Homo sapiens
  misc_feature: GYAE6OF01DG57L.21.8.A08.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagcatactctacagggggtgggctcaggaggcagagctctgggaatctcaccatggcctggacccctctcctgcctccccctcctctactttcngcacagtctctgagcctctatgagctagacacacgcccacccgtggtgtcagtccgtaccccgaaggaccaaacggccaggactccactgctcgtggatattcattacgaaccaaaaagtattattacgtttggttacgtaccagacaacggtagtacgacggaccgacggcccttgtaccgtggtactacgtccagtcggacggccgtacggtaccggaaccgacctaccggtcccgggtaacttccccgtaggacgtacggtacttcgtacgtccgtccctccgaacgtccggtacgaagggaccgtacggtccggacccttaccgttacgtaacgtttacgtaccgggtcggggttaccggggtaccccgtaggggttaacgggaacgtaggtaacggacggtaccgtacgtaaccgttactttaacgtttaccggttaccgaccgtaaccgagtacgtaaggttacggttacggtacgtacggtaggggtacggggttacggtaccggggtacgggtaccgggtaacgttacgggttaaccggtacccggtttaccggtcggttacgaccgggtaccccgtaacggggtccccgttacccggtccccccggttacggttacccgtccccgtttacccgttccccgttacccccgttaccccccg

SEQ ID NO: 89257 - DNA, 649 bp, Homo sapiens
  misc_feature: GYAE6OF01CBTPT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctctggagatcattgaccaaaagatatacttgtgttcagcagaagtcaggccaggcccctgtactgtcatcatgacgcagtcgacgacactccgggatccctgagatacgttctactgtccctcacgctacgaggacagtcggaccctacgttgactattcgacgggtccggggacccgtaagggtgggaacgtagtacggaaacgtcgtacgtaccttaagtaacgtttacgtaccggaccaaccgaagaactaggttacggtaggtacgtagtaacgggtaacgggggttaacgtaccggggacgggtaaacggggtaaccctaagggtttacccgggaaccgtttccgggttagtccccggtaaagacccccggtaaaggtcccgtccggtaccccccgttacggtccctaacccgtttccggttaccccccgg

SEQ ID NO: 89258 - DNA, 764 bp, Homo sapiens
  misc_feature: GYAE6OF01ATO5D.21.8.A08.1.454.CMB.1.raw
  modified_base (441)..(441): a, c, t, g, unknown or other
  misc_feature (441)..(441): n is a, c, g, or t
tcagtcgtcgctcgcacgaccggtgctcgatttagcatactctacagggggtgggctcaggaggcagagctctgggaatctcaccatggcctggaccctctcctgcctcccctctctactttctgcacagtctcgtaggacggcctactagtggacgctagaccacacgcctacccgtggtagtcacggtccgtacccgaggaaccgaaaccggccgaaggtactccgaaccgttgaccgttcgtaggagtacttccgtaagttaccggaaaccaaaagtacttaagtttcgtttaggttccgtaccaggtaccgtaaggtacgtcgaccggacccgtaccggtccctagtaacgtggtaccacgtccaggtcgacgacgacgtacgacgacgtaccggtccggtactaccgtagacgtcttactcctacgccgacgtacncgtacgtacggaacggaccgtcggtccaacccgtttacgtacggtaactaccgggttcggaccgggtccgggtaccggtaaggacgggacgttagacggtaccggtacgtaacgtacttacgttacgttaccggtaaccaccgtacggaacgtaggtaccggttacgtcggtaacgtcgggtaacgggttacgggttacgggtaccgggtagggtaacccggtagtacggtaccgttaccggtcggttaccgccggtacgacccgtcgtaccccgtcccgtccgtacccgtccttacccgtaccgttcccgtaccccgtcccg

SEQ ID NO: 89259 - DNA, 749 bp, Homo sapiens
  misc_feature: GYAE6OF01ETCKG.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacgcctcctatgagctgacacacgcccacccgtcggtgtcagtccgtccccgaaggaaccaaaccggccaggactccacctgctcgtaggatacttctagttacgaaccaaaaagtattattacgttggtttcgttaccagacaagtaacgtcgacggccgaccggtccccgttagtacgtcggtacacgtccgtagtacggaccgaccgtacggtaccgaaccgtaccgtaccggtcccgggtactacccggtaggaacgtacgttacttccgtccgtaccgacccgtaccgacggtccgtaaccggggaacggtaacgtcgggtacccgtacccgtaccgttacgtaccgttacggtacggaccggggttcccgggaccggtagggtacgggaacgtaggtacgtaacgtacgttacggtaacttacgttacgttacgaccgacgaaccgagtaacgtggttacgtacgtacgtaggtacggggtaagggttcgggtacgggacgggtaacgtaacggttacggtaccgttaccggttcgtaggaccgccgggaccgtacgtcccgtaccccggttccgtacgtccctccgttcccgttcccccgg

SEQ ID NO: 89260 - DNA, 884 bp, Homo sapiens
  misc_feature: GYAE6OF01CKZN6.21.8.A08.1.454.CMB.1.raw
  modified_base (131)..(131): a, c, t, g, unknown or other
  misc_feature (131)..(131): n is a, c, g, or t
tcagtcgtcgctcgcacgaccggtgctcgatttagcatactctacagggggtgggctcaggaggcagagctctgggaatctcaccagtggcctcggacccctcctcctcgcctccccctcctctactttcngccagagttctctgacggcctacctagtagagtctagaaccacgaccgcccctacccggtggttacgtcgtacgttcccgtaccccgaaggaacccgtaaaccggaccgaggtactaccaaccgttgtccgtgtacgggaattacttactaagtacgaaacgaaaagtattacttacgttggtcgtacagacgtaagagtacgacggaccgacgtcccgtagtacgtggtactacgtacctaggtacgacgtaccgtacgtacgaacccggtacctaccgggtaccggtactcccggttagaacgtacgttaccttacgtcccgttaccgccgtaccgaacggtcgtaccggtaacgggaccgtaggtaccccggtaacgtacccggtttaacgtacgtaaccgggtcggtaccgggggtaccgggtaaccgggtacgggtacgggaacggtaaggtaaccgggtaacgtagtaaccggttaaccgttaacgttaacgtttaccgtaacccggtaacaccggtaacgttaacgggtaacgttaaccgggtaggttaaccgtacggggttaaccgggggtagggttaaccgggtacggggtaaccggggaaccgggttaaccggtaacggttacccgggtttaccggttaccggttaaccgggacccgtacccggtacccgaccgggttaccccgtacccggtccccgttaccgacccgttacccgttccgtcccccgttccccgttacccccg

SEQ ID NO: 89261 - DNA, 975 bp, Homo sapiens
  misc_feature: GYAE6OF01AGL18.21.8.A08.1.454.CMB.1.raw
  modified_base (178)..(178): a, c, t, g, unknown or other
  misc_feature (178)..(178): n is a, c, g, or t
  modified_base (206)..(206): a, c, t, g, unknown or other
  misc_feature (206)..(206): n is a, c, g, or t
tcagtcgtcgctcgcacgaccggtgctcgatttagcatactctacaggggggaggagggaggccagcactagaagtcggcggtgttcctattcggtgatcagcactgaacacagaggactcaccatggaggtttgggctgagcttgggttttcctccgttgtcttcttttaagaggtntccgtagtgtcaggcgcaactggtaggngtcgtggggagcagtggtccaggccgtggggtacggtcccgtgacgtccgtccttccgtaggtcgacgacggtcgttacgtcggtacttcgtaacggttcgtaccgggtcctttacccgttggtaccctagttacgtccgtaccggttcgggtcccggtcccgtacggtccgtttacccggacgggtaacccgggttaacgggggccgttcgggggtaacggggttcgggggtcggggtaacgtaccgttttaacggtccgttcgggggtttaaagtgggttaaacggttgggggaaaacggttggtaaaggtaagggttaatttaaccgtttagtttaaccggaaaggtttacccgtacccgggttaagggtaacccgggtaccggtaacgttacccggtaacccgtaacgttcccgttaacccggtacgggtaaaccaaacggttaacccgtaacggtaaacccctaaaccgtaaaccgtaaaccccggttaaaccttacggtttaaaccgtttaaacgtttaaccccgtaaacggtttaaccccgggtaaccgggtaacccccggttaagggttaaacccggggtaaccgtaaccccggggaacggtaacccgggtaacccggtaacggtttaacgtaacggttttaaccgttacggtttaacgggtaacggttaacccgggttacgtttacccgggttaggttaaccgggtttaccggggaaccgggttaacccgggtaacccgggttccgggttaaaccccggg

SEQ ID NO: 89262 - DNA, 606 bp, Homo sapiens
  misc_feature: GYAE6OF01D1R4F.21.8.A08.1.454.CMB.1.raw
  modified_base (339)..(339): a, c, t, g, unknown or other
  misc_feature (339)..(339): n is a, c, g, or t
  modified_base (386)..(386): a, c, t, g, unknown or other
  misc_feature (386)..(386): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtcgtccccaggacaaacggccaggatcactgctctggagtattcattgaccaaaagatatacgttgttggttccagcagagtcaggccagccctgtactggtcatccatgagccagcgacgacacgtccgggatccccgtagacgagtacttctcgtcnccctccgaagcctacgaggaacagtcggaccctacgttagacttaancgtacggtcggggacccctagggtcggaacgtagtacgaagtctacgaacgttaactagttacgttacgacctaacgaagacgtagtaggtcgtacagttacggtaggggttatccgggaggaggtacccgtaggtcgtaacccggttcgttacggtacggacgtaccccgtaaggcccgtacccggtcccccgttaggtcccctcgttccgttaccccg

SEQ ID NO: 89263 - DNA, 876 bp, Homo sapiens
  misc_feature: GYAE6OF01A6W0F.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtacagtcgtccccagggaacaaacggccaagggactccacctgctcgtggagacttccgattacgaacctaaaagaacttattacgttgttaggttcctaagcagaagtcgacggccgacggtcccctagtacgtggtcactccgatggacgccagtccgaccgacgaccgtaccgggactacccgtgaacgtagtaacttccgtccgttcgaccccgttcgaacggtacccgttacgggaacggggtacccgtaaacggtccggttacccccgtaacccgggtttactaaaccgttacgttaaccgggtacgggggtacccgggggtaacccccgtaagggggttacggggtaaaccggtaacgttaacgggaaacgttaccgggttacggaacccctttttaacggttaaccgtttttaaccgggttaacccggaacccgttaaacccgaacgggtttaaaaccggtaaccggtttaaaggggtttacccgggttaaccgttaaacgggtacccgggggtttaaacggggggtttaccggttacggggggtaaccgggtaacgggggtaaaccgttaagggttacccgtacccgggtttaccgttaggggtacccgtacccggtacccgaaacggttcccggtacccgttaccccccgggttcgtaaccccgttaccgttccccgttacccccggg

SEQ ID NO: 89264 - DNA, 711 bp, Homo sapiens
  misc_feature: GYAE6OF01ELKGY.21.8.A08.1.454.CMB.1.raw
  modified_base (232)..(232): a, c, t, g, unknown or other
  misc_feature (232)..(232): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcgggtgtcagtccgtaccccgaggaaccaaacggccaggactccacctgctcgtgganattcattcgaaccaaaagaattatacttggttcggttccagcaagaagtcgaggccacggcccctagtactggtcactccatcggacggccgaggtccgacgaccacgtcccgggactcccgtagacgagtacttctcgtcgccctacacgtctacggaggactaggtccggacctaccgttgtaaccgttactacggacgggtccggggaccgtagggtacgggaacgtacgtaagggacgtcgtacggtaacttaacgtttactttacggttaccgcccaacgacgtacgtaagttacgggtcggtaacgtacggttacgggtagggggttaccggtacggggaaccggggtaaacgggtaccggttaaacggttaccgggaacccggtttccgggtagcccggtaaccgacccggtaaacggtccgtccccggcccccgttaccgggttaccctccgtttccccctttaccccccg

SEQ ID NO: 89265 - DNA, 879 bp, Homo sapiens
  misc_feature: GYAE6OF01B0JBR.21.8.A08.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagcatactctacagggggtgggctcaggaggcagagctctgggaatctcaccatggcctcggacccctctcctcgcctcccctctctactttcngacacagtctctgacggtcctcctatgagctagacacgacgcccacccgtcggtgtccgagtccgtaccccgaaggaaccgaaaccggccgaaggactccaccgtcgctcgtaggatacttacgtagttacgaaccgtaaaaagtattacgttacgtttggttacgttaccgaagaccgtaaggtaacggttacgaaccgggtaccgaccggtccccgttacggtaacgttcggacctacgaccgtagtcggacggccacgtaccgacgaacgtccggtaccggtctccggtagaagtacgtcttcctcgtcgacctacgacggacgtaggacgaacgtggtccgtacctacgtacgtaactcggtacggacgggtaccggaccgtaggggtacgacggtagtacggaagtcgaacggtaactaggtttaccgttacgtaaccgtaccgaacgtaacggtaacgtacgggttacggtacggtaaccgttacgggtaacggggtacgggggttaaccgttaccgggggacgggttaaacccggggtaaacccgtttaagggttaccccggttacccggggtttacccgggtaaccgggtacccgggtaaaaccccgggttacccgaaacccggggggttttcccccgtacccccgggggtttaaccccccgtttacccgggggtacccttttaaacccccgggggtttcccccgtttacccccggttttaacccccccggtaacccccccggg

SEQ ID NO: 89266 - DNA, 835 bp, Homo sapiens
  misc_feature: GYAE6OF01B8M9N.21.8.A08.1.454.CMB.1.raw
  modified_base (796)..(796): a, c, t, g, unknown or other
  misc_feature (796)..(796): n is a, c, g, or t
  modified_base (821)..(821): a, c, t, g, unknown or other
  misc_feature (821)..(821): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatcgagctagacacacgcccacccgttggtcgtcgacgtcgtccccgaaggaacaaaccggtccaaggactccacctgaccttcgtaggagtacttctagttacgaacctaaaagtaattacgttacgtttggtttacggttaccaacgacgtaaggtaacgtccgaacgggacccgtaccggtaccccgttaggtaccgttacggtacctacgttaccgaacgtacggaaccgggtacctaaccgggttaccggaaaccggtaaccccgtaacccggttacccgggggtaaccttaccccggtaacgggaaacggtaacggttaccgtttccgttaccgtacccggtaccccgtaacccgacggttaaccgttaaccgggaacggggtaaccgtaacggggtcccgtaaaccccgttacgttaccgtaacgttaaccgttacggtacggggttcccgggaccggtaacggggttacggaacggtaacgtacggtaacgtcgttacgtaacgttaactttacggttacgtttaccgaccgtacgtaaccgaggtacgtaacgtcggtactaggtacgggtacgggttagtacgggtacgggaacggtacgttacggtcgtaccgtcggttacgcgacggacccgngtcccgtacccgtcccgtaggtccncccgttcgtccccg

SEQ ID NO: 89267 - DNA, 651 bp, Homo sapiens
  misc_feature: GYAE6OF01ERWFO.21.8.A08.1.454.CMB.1.raw
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (416)..(416): a, c, t, g, unknown or other
  misc_feature (416)..(416): n is a, c, g, or t
  modified_base (457)..(457): a, c, t, g, unknown or other
  misc_feature (457)..(457): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgacacagcccacccgtcggtgtcagtcgtccccaggaccaaacggccaggactcacctgctcgtggagtattcattgaaccaaaagaattataactttgttggtccagcaagtaagtcaggccacggcccctgtacgtggtcatccatgngcngtcgacgacaccgtccgggntccctggagagtactttccgtaccgcgtccccgtaccgacgcctacggaacggggactacgggtccggacccttacgttagtaccnttaacggcgtaggggtccgggaccgaggggtcggaacgtanaggaacgtcgtacgtaacttacgtacgtttacgtacgaccgaacgtaagacgtaaggtaggtcgtacgtacgtacgggtaggggttacgtccggggagggtaccgggtaaccgtaaggttcggtacccggttcggttacggcgacccgtaccggaccggtccgttccccgaccccgttcgtaccgttcccgtcg

SEQ ID NO: 89268 - DNA, 823 bp, Homo sapiens
  misc_feature: GYAE6OF01CCB5Y.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgacggcctcctatgagctgacacagcccacccgtcggtgtcagtcgtacccgaggaaccaaaccggccaaggactaccaccgtcgtctcgtaggaagtacttacgtagttacgaaacctaaaaagtattacttacgtttggtttaccggttaccaggacgtaaggtaacgtaccggacggcccgtaccggtacccctagttaccggttacggtcaacgttccgtaacggtcgggaaccggaccgtaacggtccgaaccggaaccgtaccggtcccgggaacttcccgaagaacggtacgtactttccgcgtcgtacccctacgtacgtccgtacgggacggactacgggtaccgacctacgtttacgacttacgtacggacgggtccgggaccggtagggtacggacgtagacggtaaacgtcgtaacgtaaccttagttaacgtttacgtaaccgacgtaacgaacgtacgttaaggtacgttacggacgtaacgggttacgggttagggggttacgtaccggggtaacgggtaaccgggtaaaccgttacgggttaccggttacccgggtttcggttaaccccgggtacgtaaaccccgggtacccgtaaccgggttcccgtaccccgggttaccccccggtttacggaacccttacccggttcccccgtttacccccgg

SEQ ID NO: 89269 - DNA, 843 bp, Homo sapiens
  misc_feature: GYAE6OF01DNNMO.21.8.A08.1.454.CMB.1.raw
  modified_base (817)..(817): a, c, t, g, unknown or other
  misc_feature (817)..(817): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctacgacacacgcccacccgtcggtgtccgagttccgtaccccgaaggaaccaaacggccaaggactccacctcgccttcgtggagtacttctaacttacgaaacctaaaaagtaaacttattaccgtttaggtttcggttaccgaaggtaccgaaggtaaacgtaccggaacggacccgtaaccgggtccccccgttaggttaccggtacggtacctaccgtaacccgtaggtaccgggaacgggtaccccgtaaacggttacccgggtaaaccggaacccgttaaccccgggtaccccggggtaaccgttacccccgtaagggaacggtaacgttaccgtttccgtacgtccgtcccctaccggacgtaccggtaaccgtacggggaactcggtaccggaccccgttactttacggaactttacggtccgtaacggggtccggggtaaccgtagggtacgggaaacgtagtacggtaagccgttagtaaccttacgtttagttaccgtaacgaccaacgtagtaacgtaggtacggttgtacggtagtacggggtacgggttacgtcggggacgggtaaccgtacggttacggttaccgtaccggtaccgttaggtacgacccggtaacccggtacgtacccgtccccggttaccccgnggttaccctccgtttccgtacccccg

SEQ ID NO: 89270 - DNA, 809 bp, Homo sapiens
  misc_feature: GYAE6OF01CUP5G.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggccttctatgagctagacacagcccaccgtggtgtcagtccgtaccccaggaaccaaaccggccagggactccacctgaccttgtcgggaatcttacagttacgaaccaaaaaagtattacttacgtttggtttcggtaccagtccgtaagtaacgtacgacgggcctaccgggtccccttagtaccgtcggttacacctccgtagttcggaacggcccgtacggtccggaaccgtaacccgaacccggttccggggtaacctacccgtagggaacgtagtactttcctaccgtcggccccttacccgaggtcccgtacgggtaacggtaccgtacgggttcccggacccttaaccgttacggtaaccttacggtccgggtaaccggggtcccggggtaccggtaaggggttccggaacggtacgtaacggaacgtaccgtacgtaactttaaccgtacgttttacggtaacccgtacgtaccgaagtaaaccgtggtaacggtcggtaacgtacggttccggggtaacggggttacggtacggggaacgggttacgggaaccggtaggttaccggacccgggtttctacgggtacgtacccggtacccgtaacggtccggtccccgttaccccgggtcgttaaccctccggttcccttaccccgg

SEQ ID NO: 89271 - DNA, 677 bp, Homo sapiens
  misc_feature: GYAE6OF01BBV0R.21.8.A08.1.454.CMB.1.raw
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctgcacagtctctgacggcctcctatgagctgacacacgccaccgtggtncagtcgtcccgagacaacggcaggatcactnctcgnggatatcagtcgaacaaagatatacttgttcgtacagactaagacgtcgacggaccgacgtcccttaggtacgtcggtactactaccgtagtacgggacgccgtacggtccgaacggaccgtaccggtcgggtacctcccggaggacgtacgttctttaccgtcaccgtcctccgacgtcgtacggaacggtcgacggtaccgcctacggttctactcggtacgcgggtccgggccgaggtacggacgacgtaggaactcgtactaacttacgttagttccgaccaccgtagagacgttacggtacgggttacgagtaccggtacgggttacggggttaccgtaggggaaccggtaacggggtaccttacgggtacccggttaccggtcggtttacgggcctaaaccgggcccgtacccgggccgtcccggtcccgaccggttccctccggtttcccgttcccccg

SEQ ID NO: 89272 - DNA, 808 bp, Homo sapiens
  misc_feature: GYAE6OF01CKMLJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctctactttctgcacagtctctgacggcctcctatgagcgtgacacacgccctacccgtcgggtcgtcgtacggtcgtacccccgaggaaccgaaaccgggccaagggtactaccaccgtggacctcgtggtaagtacttcgattacgaaacctaaaagaattacttacgtttggttacggtaccagaccgaagtaacggtcgaccgggacccgaccggtccccgttacggttacgtcggtacctacgtaccgtagacggtacggacccgtacggtaccggaaccgaccggtaacccggttaccccggggaccttccccgggtaggtaaacggtaacgttaccgttcctaccggtccggtaccctaccggaacgtccgtaacgggaacgggtacgtacgggtcccgaccgttaccgtacgtacctacgtacgggtacgggtccggggaacccgtagggtaccgggaacgtaggtacggaacgttcggtaacgtaccgttaacgtacggttacgtccgaaccgtaacgtaggacgttagtacgggttcgtaacggtacgggtgggtaggggttacgtcggggaacgggtaccggtacggtaggttccgtaccggttccggtagaccgtaccggtaccgaccggtccgtaccccggttcccggttcgacccgttctcccggttacccccg

SEQ ID NO: 89273 - DNA, 720 bp, Homo sapiens
  misc_feature: GYAE6OF01C9TC2.21.8.A08.1.454.CMB.1.raw
  modified_base (127)..(127): a, c, t, g, unknown or other
  misc_feature (127)..(127): n is a, c, g, or t
  modified_base (175)..(175): a, c, t, g, unknown or other
  misc_feature (175)..(175): n is a, c, g, or t
tcagtcgtcgctcgcacgaccggtgctcgatttagcatactctacagggggctgtgggctcaggaggcagagctctgggaatctcaccatggcctggaccctctcctgcctccccctctcactttcngcacagtctctgacggcctctatgagctgacacagcccacccgtggtntcagtcgtcccgaggaacaaacggccaggactcacctgcctcgtaggactattcgagttcgaacctaaaaagattattacgttgttcggttaccgagtacgaagaacgtcgacggccacggtcccctgtaaccgtggtacagtacctagcggacggtccaggtaccgaacgtccaaccggtccggaactcccggagacgtacgtacttccgtcgtcgtaccctaccgtacgtacccgtacggaacgggtacgtacgggtaccggtacccttaccttacggtaaccgttacgtaccggtaacggggtcccggggtaccggtaaggggttaccgggaaccgtaggtaagggtaaaccgtcgttacggaaacctttaggtacgtttaccggtaaccgtaccgtaaccgtaaacggtacggttaacggtaacgttcggtaacgttcggtacggggtacgggtttcgggtacgggacgggacgtaaacgcggtcgtacgtaccggtgaacggtcgaccgacgacgtccgtcccgccgtctctcgttcccg

SEQ ID NO: 89274 - DNA, 920 bp, Homo sapiens
  misc_feature: GYAE6OF01CC69C.21.8.A08.1.454.CMB.1.raw
  modified_base (132)..(132): a, c, t, g, unknown or other
  misc_feature (132)..(132): n is a, c, g, or t
  modified_base (271)..(271): a, c, t, g, unknown or other
  misc_feature (271)..(271): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctctactttcngcacagttctcgtggacggtccctcctagtcgacgtctacgaccacgacgacccgtacccgttcggtcgtccgacggtccgtaccccggaagggaaaccgaaccgggaccgtaaggtactccaccgtcgtccttacggnggtaagtacttacgtacgttaacgaaaaccgtaaaaagtaacttacgtttaacgttggtttacggtaccgtacgacggtaacggtaacgtaccgtaaccgggaccgtaccggtcccgttacggtaacgtcggtactacgtcgtacgtcggaccggacgtacggtaccgacgaccgtaccggtacccggtacgtaccgtagtaacccccgtagtaccttccgtcgtccgtaccgtaccgtacgtccgtacggacggtacgtaccgtaccggtaccgtaaccgtacgtacgtacgtaccggtcgggtaccgggtaccggtaacgggtacgggtaacggtaacgtaacggtaacgtaccgtaacgttaacgtttaacgtttaccgttaccggttaacccgtaacgaaccgtaacggtaacgttaagggttaaccggttacggtaacgggttaacggtaaccggggttaacgggggttacggggttaccggggtaacggggttaaaccgggttaaccgggttaaaccgggttaccgggttaacccggttacgggtttaccgggaccggtaacccggtacccgggtaaccggttacccggtcccggttaccccgggttacccgtaacccgttccggttccccggtttacccccg

SEQ ID NO: 89275 - DNA, 721 bp, Homo sapiens
  misc_feature: GYAE6OF01DPK0U.21.8.A08.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctggagtattcattgaacctaaaaaatttcgttaggttttttacggaacctagaccgaagtaacgtacacggaccacggcccctgtcggttggtctatcccatacggaggaacgaggaacgaccgacccgtcgggactcccgtagacggtagacgttcncgtcggctccaactcgagggacgtggccgtacgtgacttcgtagacggtcggggccgtagggtggaggtagacggtaagcgttacggaacgttaaccgttacgtacggtttaccgacgtaacccaaggactaaggtacgtagggtactagtacgggtaacggggttaggttaccggggtcggtaacgggaccgtaagggttacggtaacccggttaccgttggtacccgtacggaccccggtaagggtacccgtcccgggttaccccccgttccgggttacccgtaacccgttcccgttacccggtttacccccttacccccgttcccccgttcccgtttacccccgg

SEQ ID NO: 89276 - DNA, 727 bp, Homo sapiens
  misc_feature: GYAE6OF01BKR2A.21.8.A08.1.454.CMB.1.raw
tcagtcgtcgctcgcacgaccggtgctcgatttagcatactctacagggggctgtgggctcaggaggcgagagctctgggaatcctcaccatggcctcggacccctctcctgcctccccctctcactttctgcactgtctcgtgaggtcctctagtgagctgacacagccctacccgtggtgtcgacgttccgtaccccaaggaaccaaacggtccgaaggtactccgacctgcctcgtggatacttcagttacgaaccaaaagtacttagtacgttggttacgttacaagtcgtaaggagtaccgacgggacctaccgggtcccctagttacgtcgtctactccgaaggtcggacggaccgtaggtaccgaacgaccgtaacggtccggtaactcccgtaggacgtagtacttcgtccgtacgccctacgacgtaccgtacggaacggtacgtacggtccgtccctaaaccgtttcgaactaccgtcggacggggtacccgggtaccggagggtacggacgtaagtacgacgtacctagttaacctagtttacgttcgaccgctaacggatacggtattacgggcgtacgtagggtaccgggttagggaccgtacggggacgggtaaaccgtcgtttaacggtccggtaccggttccgttaggaccgtaccggacccgacggttcctccccgggtacccttaggtccctacgttcccgtacccccg

SEQ ID NO: 89277 - DNA, 777 bp, Homo sapiens
  misc_feature: GYAE6OF01BYMYT.21.8.A08.1.454.CMB.1.raw
  modified_base (180)..(180): a, c, t, g, unknown or other
  misc_feature (180)..(180): n is a, c, g, or t
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacacgtctctgacggcctctatgacgctcgacacacgccaccgtcggtntcagtcgtcccgagacaacggcgagatcactgctctgatntacatacgaaccaaagtatatacgttcgttcgtacagacgaagtacgtacgacggccacggtacctgtactcggtacacgttccgaacgttcggaccggtccgacggttaccgacgaaccgtacgtaccgggttactccccggtagaacggtacttaccggtttcctacgttcaccccgttaccgacgttaccgtaaccgggaggaaccttacgggtaccgacccgttaaccgttagaacccgtttaacgtcggtaaccgggggtaccgggtacccggttaaggggttaaccgggaacgttaaggtaacggttaacgaccgtttaaccgggtaacctttaacgttacggtttacccgggtaacctacccggttaacggaaacgttaccgtaacgggttacgttacgggtacgtagggttaccggtaaggggggtttaccgttacgggccggggttaaacgtaccggttaaggtaccggttacccggtagtacggtccgacggtaccccgtagggcccgtcccgtacccgttacgggtacctcgttcccgttccccgg

SEQ ID NO: 89278 - DNA, 845 bp, Homo sapiens
  misc_feature: GYAE6OF01BFWKQ.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctggacggcctctatggagctagacacacgacccacccgtcgggtcaccgacggtccgtaccccgaaggacgaacgggaccggaccgtaaggacctccaccgttcgcctcgtacgacgagacgtcggtacctacggaaaccgaaaaagtaaatacgtagttaccttttaaggttaccggaaaccctaacgaaggaaaccgccggaaccggacccgaaccgggttcccgttaggtttagttacgggtataaagttaagttaaaacgtaaacgactaaccggtaggaaccggtaccggaaccctacggaaacggtacggtacccttacccggaggtaaccgttaccgttactttaccgtacggttaccggaccctaccggacggtcccgtaaggacggaacgtacgtacggtacgtacgtacgttacgaacgttacgaacgtacgggtaacgtaacgtacgggacgtaaccgggaagggtacggaacgggtacgtacgttaacgtaacgtttacgtaacgttaacggaaactaacggtaaggtacgtaacggtaaggtaacgggttaacgtacgttacgttaggggtttaccggggttacggggtaacccggggtaagggaccggggtaacgtaacggtccgggttaacggtccggtaacggtaccggacggtaacccggacgttacccggggtccttacccccggg

SEQ ID NO: 89279 - DNA, 991 bp, Homo sapiens
  misc_feature: GYAE6OF01A5KNF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggcctcctatgagctgacacacgcccacccgtggtgtcgagtcgtacccgaggaaccaacggccaggactccactcgctcgtaggagtacttcagttacgaaacctaaaaagtaattacttaacgttggtttcggttacccagtacgaaggtaacgtccgacggccgacggtccccttggttaacgtcgggtacctaacgttccgaacgttcgggaaccggaccgtaacgggtcccgtaaaccggtaacccgtaccccgggtacccggggttaaactccccggttaagggtaacgtacggtttaaccttcccgttccggttccgtaccccttacccgacggttacccggtaaccggaacggggtaacctacggggtacccgggtaccccttaacccgtttaggtaaacccttacggtaaccgggtaccggggggtacccgggggtacccgggtaacggggttacggggaaacggttaaacgtaacggggtaaacgttacccgttaacggtttaaccgtttaaccgtttaacgtttaccggttaacccgaaccgtaaccggtaaagtaacggttaacggttaaggtttaccggaacgtttacgggttaaacgggggttaccggggtttaacgggtacccggggggtaaaccggggtaaaccgggttaaaccggggtttaaccgggtttaacccgggttaccccggggttttaccgggttaccccggggtaaaccggtaaaccccggttaccccggggtaaaccgggttccccggttaaccccccgggttacccccccggttgggtttaaccccgtttcccccggttaaccccggttttaccccccccgg

SEQ ID NO: 89280 - DNA, 717 bp, Homo sapiens
  misc_feature: GYAE6OF01ANI5W.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctcgcacagtcctctgacggcctctatgagctgacacagaccctaccgtcggtgtcaggtcgtccccgaggaaccgaacggccgaaggactcacctgacctcgtaggagtacttcattacgaaccaaaaagtattattaccgtttggttacggttaccagacagtaagtcaggccacggtccctaggtacctggtacactccgagtcggacgcgtacggtaccgaccgactaccggtccgggacctccgtaaggacgtagtctttcgtacgccgccgtaccaggtccgtaccgaggtactacgggtcgaccctacgttacgtacgtaacgtacggtacgggtaccggggaccgtagggtacggaaccgtaggtaacggtacgtacgtagtaacgtacttaacttcggttaacaccgacaacggtacgtacgggtacgttagtcccgtagtacgggacgggtttaccggtagggacggggtacggtaacgttacggtaccggtaccggtccgtttaggcccgtaacgtacccggtacccggtacgtccccgggttcccccttaccggcctttacctccgggtttacccccg

SEQ ID NO: 89281 - DNA, 851 bp, Homo sapiens
  misc_feature: GYAE6OF01EQYLY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtcttctgacggtcctcctatgagctagacacacgacccacccgtcggtctcagtccgtaccccgaaggaaccaaaccggccgaggactaccaccgtgctcgtaggagtacttacgacgttcgaaacctaaaaagtacttaacttaacggttttggtttcggttacccgaaggtaccgtaaaggtaaaacggttcccgaacggggtacccgtaccggttacccccgttaacggttaacccggttaccgttaccgtaaacgtttcccgaaggtttacgggtaaacccgggaccgtaaacccggtaccggtaacccggaaccggttaccggtacccggggtaacctttacccggtacggaacgtaacggtaacctttccgtaccgttccgtaccccgtacccgacgtaccccggttaacgtacgggggtactaaccggtccgggtaaccctacggtttacgtaaccgtagtacggtacgggtccggggaccgtagggtaacgaggtagacggtaacgtcgtaacgtacgtaacttacgttaccgtaccgtacgaacccgtagaacgtaacggttacgtacggtaacgtaggtacgggttagggtacggtaccggtaacgggtacgtaaccggtcggttaccggttaccggttcggttacggaccgtcggtaaccgtacgaccggtaccggtccccgaggttccctacgttcccgtacccg

SEQ ID NO: 89282 - DNA, 612 bp, Homo sapiens
  misc_feature: GYAE6OF01AH9CG.21.8.A08.1.454.CMB.1.raw
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (351)..(351): a, c, t, g, unknown or other
  misc_feature (351)..(351): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaccacacgcccaccctcggtgtcagtcgtccccaggacaaacggccaggatccacctgctctgganattcattgacctaaagatatacttgttggttccagcagaagtcacggccacggcccctgtacgtggtcatccangagccgagtacgacgacaccgtccggatccctgacgagtacttctctcgcccncacgctacgaggactaggtcggctaccttgacttactcaggtcggggccgagggtcgacgtagtaggaacgtctaggtacgtactttagtacgttaccgcgtacgacgacgtagtacgtggtacttagtacggtaggggtttacggttacggggacgggaacgggtaccgttaggttacggacccggtttccggttgtacggtaccgacccgtaagggcccgttccgcccccgtacggttcccgtccgttcttacccccgg

SEQ ID NO: 89283 - DNA, 695 bp, Homo sapiens
  misc_feature: GYAE6OF01E16VG.21.8.A08.1.454.CMB.1.raw
tcagtcgtcgctcgcacgaccggtgctcgatttagcatactctacaggggggtgggctcaggaggcagagctctgggaatctcaccatggcctggaccctctcctgctcccctctcactttctgcacagtctctgaggcctctatgagctgacacagccacctggtgtcagtcgtcccgaggacaaacggcaggactccacctgctcgtggatattcattagaccaaaaagatatacgttgttacggtccagcagaagtcgagccacggccctgtactggcatcctagtggacgccagtcggacgacacgtccgggtactccctaggagagtacttctactgaccctcgacgtcgcgaagggactacggtcgaccctacgttcggaatacgttcgaagggtccgggaccgtacgggtacggaacgtagaggtaacgtcgtacgtaacgtaactttagttaacgttaccgaacctaaccggaacgtaacggaacggttacggtacggttaaccgtaacgttaccgggtaaagggggtttaaggttaccggggacgggtaaccggggtaacccgtaaacgggttacggtacccgggttacggttacgggtaccgtacggtaacccggaaacggcccgttccggtaccccccgttacgggtccctaaccggttcccttccgggtcccccttaccccgg

SEQ ID NO: 89284 - DNA, 729 bp, Homo sapiens
  misc_feature: GYAE6OF01BKWG2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctggacggccctcctatgagctgaccacacgcccacccgtcggtgtcacgtcgtaccccgaaggaccaaacggccaaggactccaccgtgaccttcgaggtacgtattcattacgaaccaaaaaggtattaacttaccgtttggttcggttacccgagcgaaggtaacgtcgacgggccctaccggtcccctagttacgtggtaccacttccgaagtacgaccggacctacggttaccggaacgtaccgaccggttacccgggactccccggtgaacgtacgtacgttccctcgtccgccctaccacggccgttaccggacgggtactacggtcgtaccctaccgttataccgttaagtccggtacgggttacccgggaccgggtaagggtcggacgtaagtacggacgtcgtataacgtttaattcgttccggaactaccacggaactcgtaggtagtcgtactaggttacgggtagggttactaccggggaggaacgggtaccttaaaggtcccgtacggtttccgtcgggtacgcccgaccgtaacggccctcccgtaccccggtgtccaccgttcccgtaccccgg

SEQ ID NO: 89285 - DNA, 904 bp, Homo sapiens
  misc_feature: GYAE6OF01BVEGH.21.8.A08.1.454.CMB.1.raw
  modified_base (104)..(104): a, c, t, g, unknown or other
  misc_feature (104)..(104): n is a, c, g, or t
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccatggcctggacccctntcctgcctccccctctcactttctgacacngtctctgaggcctcctagtgagctgacacacgcccacctcggtgtcgagtccgtaccccaggaaccaaaccggcaggactcacctgctcgtggaatcttacgaagttcgaaccgtaaaaagtaattacgtacgttttaggtttcggttacccaaggtctaaggtaaacggttccgaacggacccgtaaccgggtacccccgttaggttaaccgtcgggttactacgtaccctaaggttacggacggtacccgtaagggttaccgaaccggtacctaaccggtacccggggtaacttccccgtagggaacggtaacgtactttcctacgttccgtccctcccgaacgtccgtacggaacggtacctacgggtaccgacccttaccggttacgtacgtttaacgtaccggtaccggggtaccgggggtacccgtaacggggtacggggtaaacccgtaaggtacgggtaaaaccgttccgttaaccggttaaaccttaacggttttaacgtttacccggttaaccacccgtaaccgtaacgggtaaacgtaacggtttaacggttccggtacgttaacgtacggggtttaacgggggttacttaaccggggacggggttaaccggttaaacccggttaacggttccgggttaaaacccccggtttcggttacgggttaccccggaccggttaaacccgggtaacccggttcccgtaccccgggttacccccggtacggttaccccgtaacccgttcccggttaaccccccgg

SEQ ID NO: 89286 - DNA, 836 bp, Homo sapiens
  misc_feature: GYAE6OF01ESQFG.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgccctccccctcctcactttctgcacagtctctgacggtccctcctagtgacgctagacacacgccctaccgttcggtgtctacggtccgtacccgaaggaaccgaaaccggccgtaaggactacctaccgtcgtccgttcggtaggacttacttactagttacgaaacctaaaaagtaattacgttacgtttggttcgtaccagactaaggaacgtcgacggaccgaccggtcccttggtacgttcggtctacgtacctaggtacggaccggccgtaacggtaccggaccaccgtaccggtccgggactccgtagactacgttcttctcgtcgccgtaccgacggtcctaacgggacggtacgtccgggttaccgacccgttaacgtactaacgttaccggtcgggtacgggggtacccgggacgggtaacgggtacggtaaacgtacggtaaggtacggtaccgttaacggttaacctttaggtttacgtttaaccgacccgtaacggtaaccgtaagtaacggttaggttacggttacggaccgttaaggggtacggggttaacggggttaccggtacgggggaaccgggtaacggttaaacccgggttacgttccgggttaccccggttgggttaccggacccggtacccgaaccccgggttcggccccgtttcccccgggacccgtttacccgggtcccttcccggttccccggttcccccg

SEQ ID NO: 89287 - DNA, 665 bp, Homo sapiens
  misc_feature: GYAE6OF01B2PC5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctcgtggagattcattcgaccaaaagaatatacttgttggttccagcagaagtcaggccaggcccctgtactggtcatccagtgaggccagtcgacgacacgtccgggactcccgtgagagtacttctctcgccctccgagtcctacgacgggactaggtcggccctaccgttagacttacgtcgacgggtcggggacccgtaggggtacggtaacgaagtacggaaacggtcttacggtaacttacgttagttttacggttaccgccaaccgtacgaacgtaacggttaggtcggtactacggttacgggtagggggttacgttcggggacgggtaacggggtaccggtaggttaccgggtcccgttcggttacgggtccgacggaccccggtaacgggtcccgtcccgggtacccccgttacggtacccgtaccgttccggttaccccg

SEQ ID NO: 89288 - DNA, 795 bp, Homo sapiens
  misc_feature: GYAE6OF01AQHVQ.21.8.A08.1.454.CMB.1.raw
  modified_base (128)..(128): a, c, t, g, unknown or other
  misc_feature (128)..(128): n is a, c, g, or t
  modified_base (222)..(222): a, c, t, g, unknown or other
  misc_feature (222)..(222): n is a, c, g, or t
tcagtcgtcgctcgcacgaccggtgctcgatttagcatactctacagggggtgggctcaggaggcagagctctgggaatctcaccatggcctggacccctctcctgctcccctcctcactttctgcanagtctctgacgcctcctatgagctgacacagcccacccgtcggtgtcagtcgtccccaggacaaaccggccaggatccacctgctcgtggagtnttcattcgaaccaaaaagtattagtacgttgttcggttccagacagaagtcaggccacggcccctgtacctggtacatccagtggacggaccagtaccggaaccgacgtaccgtacccgggactccccgtaggacgtagtactttccgtccgtcgtcccgtaccgacgtccgtacggaacgggaccgtacggtaccgggtacccctaacccgttacctaacgttaactaccggtacgggggttacccggggaccccggtaaggggttacgggaaccggtagttaaggaaacggtcgtacggtaaccgttacgtttaacgttacgggttaacccgtacaacccggtaagtaacggtacgttaagggttccggtaacgtacggttaccgggacgggggtcgttaaccgggtacgggggtacgggaaccggggtaaccgttacggggtttaccgggaaacccggtttaccggtaccgggttacccggtaaacccggcccggtaaccgtcccggtaccccgtaccccccgggtttaccggtacccgtcccgtttcccgtcccggtttaccccccccg

SEQ ID NO: 89289 - DNA, 821 bp, Homo sapiens
  misc_feature: GYAE6OF01AMKVY.21.8.A08.1.454.CMB.1.raw
tcagtcgtcgctcgcacgaccggtgctcgatttagcatactctacagggggctggtgggctcaggaggcagagctctgggaatctcaccatggcctcggacccctctcctcgcctccccctcctacctactttctgcacagtcctctgacgtcctctatgagctgacacacgcccacccgttcggtcgtcgtacgtccgtaccccgaacggaaccgaaaccggccgtaggacctcctaccgtgccttcgtggaacgtatttccgattacgaaccgtaaaagaattacgttacggttttcggtttcgtaccgagaccgtaaggtaacgttcgaccggtacccgtaccggtccccttacggttacccgtggtacctactccgaagtcggtacggccttacggtacgaacccggtacaccgtcccgggtaactcccggtagtacgaacttacgtttccctccgttaaccggaccccgttacgaccgttaccggtacgggaacgtaaccggtttcgtacccgggccctttaacccggttagtaaaccccgtttgaccgggttcgggggtaacccgggtacccgggtaacggttcgggaaaccgttacgggtaacgtccggttaacgttacgtaccgtttaacgttaccttacggttacccgtacctaacgtacgtaacgtaacggtaccgttacggtcgttaccggtacggtaacggggttacggtacccgggagggtacccgtagtaccggtcggttaccgtacgttgaccggacgcctaaggtccgttacccggtcccgtacggtaccttcggtcccgtcccg

SEQ ID NO: 89290 - DNA, 922 bp, Homo sapiens
  misc_feature: GYAE6OF01EUU5Q.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtcggtgtcagtcgtccccgaaggaaccaaacggccgaggactccgacctgcctcgtggagtacttctagttacgaaccaaaaagtaattaacgttacgttttacggtttacggttacccaaggtaccgtaaaggtaacggttacccgaacggggtacccgtaaacccggggtcccccccgttaggttaacccggttcgggttaaccctaaccgtttacccgtaagttacggggaaccggtaccccgtaacggttacccggaaccggtaaccccgtaccggttacccggggaaccttccccggtaaggaaggtaacgtcgttttactccgtacgtccctaccgacgtccgtaccggagggtaacgtacggtccggtaccctaccgtttacggaactttagtaccggtaacggggttcccggggaccccggtaaggggtacgggtaaaacccggtagggtaacgggaaacgggtttcccgtaacgggttaaaccgtttaaccgtttaacggtttttaaccggttacccgaacccgtaaccgaacggtaacgttaaggggttaacggttcggtaacgtacggtttacggggtaacgggggttaaccggttccggggaccgggtaaacggggaaccgtttaacgggttaccggttacccgttacgggttcgggaccgtacccggacccggaaggttccccgtacccgggtcccccttacccgggtacccttacccggttcccgttcccccgg

SEQ ID NO: 89291 - DNA, 702 bp, Homo sapiens
  misc_feature: GYAE6OF01A6HVA.21.8.A08.1.454.CMB.1.raw
tcagtcgtcgctcgcacgaccggtgctcgatttagcatactctacagggggctgtgggctcaggaggcagagctctgggaatctcaccagtggcctggacccctctcctgcctccccctcctcacttttctgcacagtctctgacggcctcctatgacgctgacacacgcccacccgtggtgtcagttccgtccccaaggaaccgaaaccggccaagggactccacctgctcgtaggaatattcgattcgaaccaaaagtatattacgtttgttggttccagtcgaagaacgtcacggccacggtcccctagtaccgtgtcaatccagtcgacggccgaggttaccgaaccggtaaccacccgtcccggggaccttcccgtaggacgtaacgtactttcctacgtaccggtcccctaccgaacgttcctaacggaacggggtaacgtaccgggtcgaccccgtaacgtttacgaacttacgtcgtacgggtccggggacccaggggtacggaaacgtagtagggacgtcgtacgtaaccgttacgtttacgttacgtaccgctaacccgagtacgtagtacggtcgtccaggttacgggagggttcgtacgggacgggtaagaccgttacgtacgtacccggttcgtacggacaccggacccaggtccctaccgtccccggtaagtcctcgtccggttcccg

SEQ ID NO: 89292 - DNA, 865 bp, Homo sapiens
  misc_feature: GYAE6OF01CE4NB.21.8.A08.1.454.CMB.1.raw
  modified_base (177)..(177): a, c, t, g, unknown or other
  misc_feature (177)..(177): n is a, c, g, or t
  modified_base (216)..(216): a, c, t, g, unknown or other
  misc_feature (216)..(216): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctctatgagctgaacacagcccaccgttcggtntcagtcgtacccgaggaacaaaccggtcaggatccactnctcgtggatacttcgattcgaaaccgtaaaagtaatacgttacgttggttacggttaccgaagtcaaggtaaacgtccgaacgggcccgtaaccgggtcccttacggtaaccgttgggtactaactccgtaagtacggtacggtacccgtacggttaccggaaacgacccgtaaccgttacccggggtacctcccggtaaggaacgtaacgttccgtttaccgtacgtcccgaccctccggtacgtccttacgggaacggtacgtacgggtaccgtaccttaacgttacgtaacgtttactaccgggacgggttacggggaaccccgtaggggtaaacgggaacgtaacgggtaacgtaaaccgttcggtaccgttaaaccgttacgttaacgttttaccggttaccccgtaacgaaccgttaaagtacggtttaacggttaaggttaccggttaacgtacgggttaaaccggggtacggggtttaacggttccggggaaacgggaaccggttaacccggttaaaggttcccgggtaaccccggtttacgggtttacggtaacccggaacccggtttacccggaaaccggttccggtacccccgggtacccccgttacggtttacccctcccttccgggttaccccccg

SEQ ID NO: 89293 - DNA, 1196 bp, Homo sapiens
  misc_feature: GYAE6OF01APTKV.21.8.A08.1.454.CMB.1.raw
tcagtcgtcgctcgcacgaccggtgctcgatttagcatactctacgagggggctggtgggctacgagggaggcagacgtctcgtagggaactcctacacctagtccggccgtccggtacccctctcctcctccctccccctctacttactttcgacgcactacgtcctcgtacggtacccgtcccctagtagacgacgtaccgaaccacccgaccgtaccccgtacccgtcggttcgaccggtaccgtacccggtaaccccgaaccgggaaacccggaaccggaccgtacgtacctaccgtcccgtcgttaccgttcggtaaggtaaccttaacgtttaccgtaaacgtaaaaccgttaaaaccgtaaaaacgttttaaccgttttacggtttttacggggttttaaccgggttttaccggttaacccggtaacggtaaacggtaaaccgggttaacccgggtacccgggaaccccgggttaccccgggtacccggggttttacccccggttaacgggttacccggtttaaccggacccgtttaacccaccgggggtttaacggaacccgggacccgggtaaaccccggtaaccgggttaaccccggaaacccggtacccggtttaacccccgggttaccccgggaaacccggttacccgtttaaccggtacgggtttaccccttacccgtttaccggtaccccgttacccccgggaccttaacccggtaacccggggtttacggaaaccgggggtttaaccgggtaacccgtaacccgggggtttcccccgtaaacccgtttaacccggttagggttaaccccgttaccggggggtttaacggggggttaccccggggggttaccgggggttaacccggggtaaccggggttaacgggtacggggttaagtaaccgggtaaccggtttaacgtaaaacccgtttaccggtttaacccgttacgggttaaacccgtaacccggtaacggtaaccggttaacggtaacgggtttaacggggttacgggttaacggttacgggggttaaaccggggggttaacgggggtttaacccggggtttacggggtaaacgggggtacccgggttaaacccggggttaccccggtacgggtttaacccggtaaccccgggttacgggttaccccggtaccccggggttacccctaaccggggta

SEQ ID NO: 89294 - DNA, 677 bp, Homo sapiens
  misc_feature: GYAE6OF01E5QCG.21.8.A08.1.454.CMB.1.raw
  modified_base (128)..(128): a, c, t, g, unknown or other
  misc_feature (128)..(128): n is a, c, g, or t
  modified_base (235)..(235): a, c, t, g, unknown or other
  misc_feature (235)..(235): n is a, c, g, or t
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctggacgcctctatgagctgacacacgccacccgttcggtcgtcgagtccgtaccccgaaggaaccaaacggccaggactccgacctgctcgtggatnttcattacgaaccaaaagtatattacttgttcgtacagacgaagagtcgacggccacgtccctagtactgtacntccagtgacgccagtccgaacgacacgtccggactccgagacagtcttcgtacncgtcctacagtccgagaacggtacncggtacaccgtacttagtactacgtacgacgggtaccgggaccggagggtacggacgtaagtacggaagtacgtacgtaacttacgttaacgttccgttaaccgaccgtaaccgtagtaacgtaggttacggtacggtaacgtacggtacggggtaggggttaccggtacggggaaccgggtaacggtaaccggtacggttaccggtaccgttccgttaggaccgtaccgacccggtaaccggtcccgtacccgtccccggttaccgtccgtccgttcccgttaccccg

SEQ ID NO: 89295 - DNA, 704 bp, Homo sapiens
  misc_feature: GYAE6OF01CFONC.21.8.A08.1.454.CMB.1.raw
  modified_base (399)..(399): a, c, t, g, unknown or other
  misc_feature (399)..(399): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacacgccaccctcggtatcagtcgtcccaggacaacggccaggatccacctgctctggatattcgattgaaccaaaaagattatacgtttggttcgttaccagcaagaagtcacggccacggccctgtacgtggtcatccatgacggccaggtcgacgaccaccgtccggtatccccgtgagtactacttctcgtacgtccctacgacgctcggacgggacaggtccgacctaccgttanacttacgtcgtacgggtccggggacccgtaagggtacggtaacgacgttaggaacggtaccgttacgtaaccgtttacgtaacgttttaccggtaccgtaccaaccgtaacgtacggtaacggttacggtacggttacctaggttaacgggtaagggggtttacgttaccggggacgggtaacgggtacccgttaaacgggttcggtaccccggtttcggttaccggcggtaccccggacccggtaacggtcccgttacccggacccccgttccggtacccgtaccgttcccggtttacccccgg

SEQ ID NO: 89296 - DNA, 845 bp, Homo sapiens
  misc_feature: GYAE6OF01DCCCF.21.8.A08.1.454.CMB.1.raw
  modified_base (827)..(827): a, c, t, g, unknown or other
  misc_feature (827)..(827): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctctactttctgcacagtctctgacggcctcctatgagctgacacacgcccacccgtggtgtcaggtcgtaccccgaggaacaaacggccaggactccacctgcctgtaggatattcaagttacgaaaccaaaaagtaacttacgtttacgtttaggtttcggttaccagtacgaaggtaacgtcgaacggccgaccggtccccttaggtaccgtcggtactacgtaccgagtacggacgccgaacgtaccggaaccgaccgtacccggtccggtacctcccgtaggaacgtacgttacttccgtccgtccgtcccgtaccgacgtaccgtacgggaacgggtaccgtacgggttacccggaccccgtttaacgttacgtaaccgttacgtccgggtaaccggggtcccgggggtaccggtaggggtaacgggacgtaacgggtaacggaaacgttccgttaacgttaaccgtttaaccgtttacggtttaccggttaaccgaacccgtaaccggtaaggtaaacggttaagggttaacgggttaccggtaacggtaacgggttacgggggttaacggggtttaccgggtaccgggggaacggggtaaaccgggttaacgtacgggtttcccggtaccggtttccggttacgggtaccgaccggtaccggtaacggtccccgtcccggtaccccgttcggttacccnccgtttcccgttcccccg

SEQ ID NO: 89297 - DNA, 803 bp, Homo sapiens
  misc_feature: GYAE6OF01DIF8X.21.8.A08.1.454.CMB.1.raw
  modified_base (702)..(702): a, c, t, g, unknown or other
  misc_feature (702)..(702): n is a, c, g, or t
tcagtcgtcgctcgcacgaccggtgctcgatttagcatactctacgagggggggagaggagcccagcactagaagtcggcggtgtttccattcggtgatcagcactgaacacagaggactcaccatggagtttggctgagtcttgggttttcctccttgcttctttaagaggtgtccagtgtcgaggcgctaacgtggtggagtcggtgggggagcagtcggtccacggtccggtggggtacggtcccgtggacgtccctcgttccgtgtacgacgtaggtccgttcgtaggtacgttaccgtaggttcgttccggtcctttaccgttcgccctaagttcggacccgtacgggttcccggggtaccccgccgacgggtccctaaccgggacgggtacgggtaacgggggtccgtagggggtacgggttgggggtacggtacggttaactttacggttacggttagggtaacgtaggtaagggtagggtaacggtaggaacgtagtttaacgtaacgtttacgttacggaacgtaccgtcgggtaacgggtacgtacccgttacttaaccgaccgtaactttcccgaacgaaggaactaaccgaacgtaccgaacctaaaacgactacgttctagttaacctaccgtaagaccgaccgtccggtactaacgggcgacccggtaacgggagaaaccccggtttntaacgttaagttacgttaacggttcgtaggttaacgttcggttcgttaccgggtacgtaacgggtacccggtaaccggtacccgggttcccgcgtaacccg

SEQ ID NO: 89298 - DNA, 664 bp, Homo sapiens
  misc_feature: GYAE6OF01DQ466.21.8.A08.1.454.CMB.1.raw
  modified_base (177)..(177): a, c, t, g, unknown or other
  misc_feature (177)..(177): n is a, c, g, or t
  modified_base (364)..(364): a, c, t, g, unknown or other
  misc_feature (364)..(364): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagtcccacccgtggtntcagtcgtccccaggacaaacggccaggactcgacctgctctagggatatttacattacggaaccaaaaaaggtaattattaactttggttacggttccaagcaagagtcaggccaaggtcccctgtactggtcatccatgaggccagtcgacacgacgtccggatcccgtgaagagtacttctacncgccctcgagctcggaggacaggtcggaccctacgtttgaaccttagcgtacggtaggggaccccagggtagggaccgtaagtacgggaaacgccgtagtaaccttaagttaagtttacgttaaccgaccgtaaccaaacggactaacgggttaggacgttagtacgttaccggagggggttaacttaccgggacgggtacggtaaccgtaaggttaccgtaccgtccgttaggtacgaaccggtaccgaacggtccgtaccgtaccccccggttgtacccgtcgttcccgttaccccgg

SEQ ID NO: 89299 - DNA, 778 bp, Homo sapiens
  misc_feature: GYAE6OF01AGFVD.21.8.A08.1.454.CMB.1.raw
  modified_base (164)..(164): a, c, t, g, unknown or other
  misc_feature (164)..(164): n is a, c, g, or t
  modified_base (596)..(596): a, c, t, g, unknown or other
  misc_feature (596)..(596): n is a, c, g, or t
tcagtcgtcgctcgcacgaccggtgctcgatttagcatactctacagggggctgtgggctcaggaggcagagctctgggaatctcaccatggcctggacccctctcctgcctccccctctctactttctgcactgtctctgacgtcctcctatgagctgacacncgtcctacccgtggtcgtcacgtccgcccaaggacctaacggccaggtactccaccgttgacttcgtaggatacttcgacttcgaaccaaaagtcttacgttcgttaggttcgtaccagtactaacggtaacgtccgaacggccgtaccggtaccccttggtaacctcgggtctacgtccgaagtcggtaccggtcgaaccggtaccgacgtacccgaggttcccgggactacccggtggtaacgtacgttcgtccttcgtaacccggtcctaaccggtacgtaacccggtacggaacgggtacctacgggttacccggtaccctaccgttttaacggctttaaccgggtccgacgggggtacccgggtccggtaagggtcggaacgtacgtaagggtacctcgtaccgtactttaacgtcgtttaccgtanacccgtacgtaggtaacttgggtaacgttcggaacgttaggtacgggttaccgggtagttaccgggacggggtaaccgtacggttaccgtccggttaccggtcgtttaccgacgggtacccgaaccgggtccgtaccgttacccggcccgttaaccggtcctaccggtttcccgtacccccg

SEQ ID NO: 89300 - DNA, 734 bp, Homo sapiens
  misc_feature: GYAE6OF01BEX8X.21.8.A08.1.454.CMB.1.raw
  modified_base (105)..(105): a, c, t, g, unknown or other
  misc_feature (105)..(105): n is a, c, g, or t
  modified_base (538)..(538): a, c, t, g, unknown or other
  misc_feature (538)..(538): n is a, c, g, or t
tcagtcgtcgctcgcacgaccggtgctcgatttagcatactctacagggggctgtgggctcaggaggcagacgctctgggaatctcaccatggcctggacccctntcctgcctcccctctcactttcctgcacagtctctgaggcctcctatgagctgacacagccaccgtcgtgtccagtcgtccccgaggacaacggccaggactcaccgttggactcgtggacgtattccagttcgaacccaaaagtactagttaacgttcggttacgttacaacggtacgtagtaaacggttccgaacgggaccctaacgggtcccccttaggttaaccttcgggtactaaacgttcctaagttacggacggtaccctacggtaccgaccgtaccaccgttccggggtaactccccgtaggacgtaacgtcgtttctccgtacgttacccacgtaacgtaccgtacggaacgggtacgaacggttccgggacctacggttacgacttacgttaacgcggttacgggcccggtaggttggaaccncggtacgaagtaccggtcgtacttaacgtcgtttacggtaacgctaaccgagtacgaacgtacgtcggtcaacgtttcggaacggggttcttacgggcgggacggtacgtaccggtgtacccggttcgttacggcgtacgccccgtacggcccgtaccggtaccccgttacgggccctaacgttcgttcccccggg

SEQ ID NO: 89301 - DNA, 859 bp, Homo sapiens
  misc_feature: GYAE6OF01CBB5Z.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctctatgagctgacacacgcccacccgtcggtgtcaggtccgtcccgaaggaaccaacggccaggactccaccgtgctcgtggatatcatcgaacaaagtatattacgttggttcgtaccagacagagtcgacggccgaccggcccgtgtacgtggtactacgtcctagtacggacggccacggtaccggaaccgaccgtaccggtcccgggacctacccgtaggaacgtacgttacttccgtccgtccggtccctaccgtacggtccgtaacgggaacgggaaccgtacgggtacccgggtaaccccttaccggttacggtaaccgttacggtacccgggtacgggggtaccggggaccccggtaaggggtacgggaacccgggtaaaggtttacgggaaaccggtcgttaacgggtaaaccctttaacggttaccggttttaaccgtacccggaacccgtaacgtaaaccgggtaccggttaaacgggttaagggttccggtaaccggttaacgggtaaccggggggttaaacggggggttttacccggtaccgggggaaccgggggttaacgggtaaaccccgttaacgggggttaccccggtacccgggtttaccgggtttacccgggacggtaaccccgggtacccgggtaccgtccggttacccccgggtccccgttaggtccctacccgttcccggttaccccccg

SEQ ID NO: 89302 - DNA, 760 bp, Homo sapiens
  misc_feature: GYAE6OF01EGQ52.21.8.A08.1.454.CMB.1.raw
  modified_base (132)..(132): a, c, t, g, unknown or other
  misc_feature (132)..(132): n is a, c, g, or t
  modified_base (139)..(139): a, c, t, g, unknown or other
  misc_feature (139)..(139): n is a, c, g, or t
  modified_base (181)..(181): a, c, t, g, unknown or other
  misc_feature (181)..(181): n is a, c, g, or t
  modified_base (206)..(206): a, c, t, g, unknown or other
  misc_feature (206)..(206): n is a, c, g, or t
  modified_base (504)..(504): a, c, t, g, unknown or other
  misc_feature (504)..(504): n is a, c, g, or t
tcagtcgtcgctcgcacgaccggtgctcgatttagcatactctacagggggctgtgggctcaggaggcagagctctgggaatctcaccatcggctggacccctctcctgcctcccctctcactttctgcacngtcttcnggacgcctctatgagctgacacacgccacctcggctcacgtnacccgagacaacggcacgactccgncctcgtcgtcttacgtagtactcctaacgtaacgtaacgtaaacgttaacttacgtttaccgttacggttacggttacgtacgtaacgtaacggtaaccggtaccggtaccggtacccggtaccgttacccggttaccgtaaccgttaccgaaccgtacgtactacggtaacggtaccggtccggtaccggtaaccggtaacccggtaaccggtacccgggtaccgccgttacccggttacggtaaccggtaacgttaccgttaccgttaccgttaccggtacccgtacccggtaccntttaccgtaccgggtaaccggggtaaccgtacggtacggtaccgttacgttacggtaccgtacggtaccgtacgggtacgggtaccggtacggtacgaacgtcgtaacgtactacgtacgttactcctaacttacgtacgtacgacgtacgtacgtactacgtacgtacgtacgtacggtacgggtacgggtacggtacggtacggtacgtacgtacgtcgtacgtcgtcgtcgtaccgaccgcgtcgtccgtccg

SEQ ID NO: 89303 - DNA, 726 bp, Homo sapiens
  misc_feature: GYAE6OF01A9GVS.21.8.A08.1.454.CMB.1.raw
  modified_base (167)..(167): a, c, t, g, unknown or other
  misc_feature (167)..(167): n is a, c, g, or t
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttggctgagctggttttcctccttgcttcttttaagnggtgtccagtgtcaggcgcaacgtggtggngtcgtgggggagcagtcggtccaggccgtggggacgtcccgtgacgtcctctccgtgtcgcngtcgtcgtgtacttcgagtacgtcggtccttccttcgcctagtcgcgtacgtcgggtcccgcgcggtcctcggacggacggaggggtcgtagggtaggtcggggtcggtaccgtaagtttcgtcgttaggtacgtggacgtaggacgtaggaacgtagtaatttaagttactacgacggtaccgtcggtagggtaccgggacctaactacccactacgtcccgtacgaaggtactaacgataccgaaccgaaaccaaccgaccgtaccttagttaccttaacgttaacgaacgtacccggacccgtacgtacggaaacggacgtaacccgggacgtaaccgtaacggttaccgttaacgttagtttaaaccggttaccgtagggttaaccgttgggttaccgtttacggtcggttaacgggttaccccggggtaacggaacccggggttcccggttacggtccccgg

SEQ ID NO: 89304 - DNA, 841 bp, Homo sapiens
  misc_feature: GYAE6OF01CX8Z6.21.8.A08.1.454.CMB.1.raw
  modified_base (130)..(130): a, c, t, g, unknown or other
  misc_feature (130)..(130): n is a, c, g, or t
  modified_base (181)..(181): a, c, t, g, unknown or other
  misc_feature (181)..(181): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttcngcacagtctctgacggcctctatgacgctgacacacgcccacccgtcggtntcaggttcgaccccgaaggaaccaaaccgggccaagggactccaccgtgcctcgtaggagtacttacgtagttacgaaaccgtaaaaagtacttaagtttacgttttcggtttacggttacccaaggtccgtaaggtaacggtacggaccgggacccgtaccgggtccccttaggtaacgttcgggtactacgtccgtagtacggacggtacccgtaggtaccggaaccgtaaccgaccggttaccggggaccttacccggaggaacggtacgttaacttccgttcgtccgtaccctaccgtacggtcctaacgggaacgggtaaccctacgggtacccgggtaccccttaaccggtttacgaaccgttacggtacgggtacggggtaccggggtaccccgggtagggttacgggaaacgtacggttaagggaccggtagttaaccgtaacgtttaaccgttagtttacggtaaccgaccgtacgaacgtaacggtaggttacggtcggtacgacggttagggtacggggtttacgacggggacgggtaacggtaaccggtacggtaccgttaccggttccggttacgggtaccaccgggacccggtacggtcccgttcccggaccccgggttatccccgtagttcccggtttacccccg

SEQ ID NO: 89305 - DNA, 728 bp, Homo sapiens
  misc_feature: GYAE6OF01ATZ0V.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccaccgtcggtntcagtcgtccccgaggaccgaaacgccgaggctccaccgtgcctctgcagagtcggactcgaaccgaaaagtaatagtcgtactttaagtacggtaaccaacgaagaacgccgacggacccgaccggtccccgttggtacgtttaggtacgtaattaataaacgtaaacgacctacgtaggacggaccggtccctagaacggtaacacgtcccgtaggtacgacgtacttctcgtcggacctcgacggtcctacgggacgacgacgaccgtagtaccgtacggttacgacttacgacgtaaggtacgtacgtacgacggagaacgggacggacggtacggtacgttacgtaacttacgttaacgtacgtaactaaacgtaacgtaacgtaagtaaggttaccggaaggttaccgtaggttacggttaggggtaccggtacgggaacgggtaacggtaccgtaagggaccggttaccggacccgttccggttaacggtaccggtaacccgaacccgggttaccgtcccgggtaccccggttacccccggg

SEQ ID NO: 89306 - DNA, 652 bp, Homo sapiens
  misc_feature: GYAE6OF01BWDN3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccgaggacaaacggccaggactcacctgctcgtggatattcattgaccaaaagtaatatacgttgttggttccagcaagaagtcgacggccacggcccctgtactggtcactccagtgacggccaggtccgacgaccaccgtccgggacttcccgtaggagtagtactttctctcgccctccaggcctacgagggactagtccggacctaccgttgactagtcgacgggtccggggacccgtagggtacgggaacgtagtacggaacgtcgtacgtaaccttacttagtttacggttaccgacgtacccgaagaccgtaaggttacgtggtacgtagtacgggtagggggttacgtcggggacggacgggtaacgtaggttacggtacccggttcggttaggaccgcggacccggaacggtcccgtacccggcccccgttacggtccctccgtcccgttccccgg

SEQ ID NO: 89307 - DNA, 748 bp, Homo sapiens
  misc_feature: GYAE6OF01BE863.21.8.A08.1.454.CMB.1.raw
  modified_base (163)..(163): a, c, t, g, unknown or other
  misc_feature (163)..(163): n is a, c, g, or t
  modified_base (269)..(269): a, c, t, g, unknown or other
  misc_feature (269)..(269): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacngcccaccctcggtctcagtcgcccgggacaaacggccaggactcacctgctctggagatgactattacgaacctaaaaaatttgtttaggtttttacggaaccganacgaagtaacgtcgaacggacccgtacggtcccgtggttcggttcggtcatccagtggaacggacgaggacgaccgacccggtccggactccgtagacgagtacttcgtacgtcggtacctaccgaacgtcggacggggtaccggtcggtacccgttaaggtcgaacttacgtcggtaacgggtccggggtaacccgtaggggtacgggaacgtaaggttacggaacgtacgttacgtaacctttaacgtttacgttaccggtttaaccgccgtaaaccggtacggaacgttaggtacggttcggtacctaacgtgggttaacggggtacgtcggggtacggacgggtaacgtacggttacggtaccgttccggttaggcctaccggaccgtacggtccccgttacccggtccccgttcggaccccttacgttccccgttacccggttccccctcccgttccccgttcccgtttacccg

SEQ ID NO: 89308 - DNA, 696 bp, Homo sapiens
  misc_feature: GYAE6OF01ENA4V.21.8.A08.1.454.CMB.1.raw
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctggtgtcagtcgtccccaggacaaacggccaggactcactgctcngganatcatnacaaagatatacttgtgtccagcagagtcagccacggcccctgtactggtcatccagtggacgtccagtcgaccgacacgtccggatccgtagatacgtnttcctcgtcgcccttacccgagtcccgtcgaacggggtactacgggtaccgggtacccctaacggtttcgaaccgtttagtaccgtacgggtcccggggacccgtaagggtacgggaactaaggtacggaacgtcgttacgtacttacttacggtttacgttaccgaccgtaaacgtaacgggtaactacggttacgggtaccgttacgaacggttaccggggtaaggggttacggtcggggacgggtaaccggtaccggtaacgttacggtacccggttcggtttaccggaccgtaccgacccggtaaccggtccccggttcccgtacccccggttacggtccctaccccgtttccgttaccccccgg

SEQ ID NO: 89309 - DNA, 845 bp, Homo sapiens
  misc_feature: GYAE6OF01BQOLO.21.8.A08.1.454.CMB.1.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (804)..(804): a, c, t, g, unknown or other
  misc_feature (804)..(804): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggacggcctcctatgagctgacacacgcccacccgtggtgtcagttcgtccccgaggaccaacggccaggactacncctagctcgtggagtnttacattacgaactaaaagtaattacttacgtttggtttacggttaccagtacgaagtaacggttccgaaccggaccgtaccggcccccgttgtaccggtcggtcctacgtaccagttggaccggaccgacggtaccgaccgtaccgaccggtcccgggtaactcccgtaggtagtacgttacttccgtctacccggtcctacccgtaggcccgttacgggaaccgggtaaccgtacgggtacccgtaccccgttaacccgttttacggaacctttacgggtacccgttacgggggttaaccccgggggtacccggttaagggggtaccgggtaaggtaacggttaacggaaccgggtttacgtacgtaacccgttttaaacgtttacggttttacccgttacccgaccggttaaccgaacgttaaccgggttaggttacgttaccgggtaacgttacggtttaacggggttacggggttacggtacccggggagggtaacccggtaccgttaaaggttccccgggtacggtttcggttaccggaccggtaccggtacccgacgggttcccncccggttaccccgtcggtaccctcccgtttcgtccccccgg

SEQ ID NO: 89310 - DNA, 783 bp, Homo sapiens
  misc_feature: GYAE6OF01B1F4A.21.8.A08.1.454.CMB.1.raw
  modified_base (104)..(104): a, c, t, g, unknown or other
  misc_feature (104)..(104): n is a, c, g, or t
tcagtcgtcgctcgcacgaccggtgctcgatttagcatactctacagggggctgtgggctcaggaggcagagctctgggaatctcaccatggcctggacccctntcctgcctccccctctcactttctgcacagtctctgaggcctctatgagctgacacagcccaccgtcggtgtcaggtccgtaccccgaggaaccaaaccggccaaggatccaccgttgccttacgtgggaagtacttactaacgttcggaacctaaaaaaggtattacgttaacgtttggtttacggttacaaacggcaaggtaacgtccaagggccccaacggtcccccgttagtacggtacggtcaactcccgaagttcggaacgcccgaggtacgaaccgtaccgacgtcccggggacttcccgtagaacggtagtaccttctccgtcgtaccccgttaccgacgtcctaccggaagggaccgtacgggttcggacccctacgttacgtactacgttaccgagggtccggggtccacgggtagacgtagtacgaagtccgtacgtactacgttagttacgtaccgtaccgtaaccgagttaccgtaggttaggtaccggtacgtacggtacgggttagggggttaacgtttccggggaacggggtaaccgggtaaccggtaaaggtttcccggtacccggggtttacttaccggggtccgtaacggtacccggtaacgggtcccgtaccccgggttcccccgtacggtttcccgtacccgtttccggttcccccgg

SEQ ID NO: 89311 - DNA, 724 bp, Homo sapiens
  misc_feature: GYAE6OF01DO997.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatcggcctggacccctctcctgcctccccctcctcactttctgcacagtctctgacggcctctatgagctgacacacgcctacccgtggtntcgagttccgacccgaggaaccaaacggccaaggtactccaccgtgtcctcgtagggatactttaccattacgaaaccctaaaaagactttaacgtacgttttggttcggttaccaggaccgtaagtaacgtcgaacggtccctaacgggtcccccttaggtacgtacggtaacctacgttaccgagttcggaaaccggtcccgagtaaccgacccggaaccgtaccgtaccgggtactcccgtaggaacgtacgtaactttcaccgtcacccgttcgtaacgcgtacgaacggactagggtccgaccctactaggtaacctctacggacggttacggcccgtaggtacgacgtacgtagagtcagtactaacgttcgtactacgaccgaactaacgacgtaaggttacgacgagttacggacggtagggttaccggacgggtacggtaacgggtactacgggtacgtacccggttagtcggtacgacccgtaccgtaacgtcccgtacccgttccccgtacgggtctccgttccggttaccccg

SEQ ID NO: 89312 - DNA, 745 bp, Homo sapiens
  misc_feature: GYAE6OF01EELKN.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctgacggcctcctatgagctagacacacgccctacccgtcggtgtcacggtccgtaccccgaaggaaccgaaaccgggccaaggtactccaccgtgtcctacgtggtagtacttactagttacgaaccaaaagtattattacgtttggttacgtaccagacaaggtacgtcgacggaccgacggtcccctaggtactcggtacactccgtagtcggaccggacctacggtaccgaaccgaccgtaccggtaccgggacctcccgtaggacgtactttactccgtccgtcgtccctacggacgtccgtacgggaggtacgtacggtccgaccttacgtacgtactacggtcgtacggggtccggaccggtaggacggtacgagtaacgtacgtaccgtagtaactttacgtacgtttaccggtaaccaccgtaacgacggtacgtaaggttacgtacggtacgtacggttaggggtagggttacgtaccggggaacggaacggtaccgttacggtaccgttaccggttcgttacggaccggtaccgtacccgggacgttcccgtacccccggtccggtaccgtacttcccggtcccgtttcccccg

SEQ ID NO: 89313 - DNA, 722 bp, Homo sapiens
  misc_feature: GYAE6OF01BHPNQ.21.8.A08.1.454.CMB.1.raw
tcagtcgtcgctcgcacgaccggtgctcgatttagcatactctacagggggctggtgggctcaggaggcagagctctgggaatctcaccatggcctggacccctctcctgcctccccctctcactttctgcacagtctctggacggcctcctatgagctagacacacgccctacccgttcggtgtccgaggttccgtaccccgaaggaaccaaaaccgggcccaaggtactccaccttgccttcgtaggatattctagttacgaaccaaaagtattacttacgttggttcgttccagacaggtaagtcgacggccacggtcccctagtacgtggtactactcctatcggaacggccgtaaggtccgaaccgaaccgtccgtacccgggtacctcccgtaggacgtagttacctttccgtaccgtcgtcccctaccgacgtcctaacgggacgggtacgtacggtcggtacccctacgttagtaccttagtcggtacgggtcccgggaccggtagggtacggacgtacggtagaacgtacgttacgtactttaacgttagtttcgtaacccgacctacgtaaggactaggttacggtacgtgtaacgtgggtacgggtacgtcggggaacggtaccggaagttacgttacggtccgtacggtgacccgtcgaacccggtcgcccgtcccggtaccccgtgttccctccgttcccgttcccccg

SEQ ID NO: 89314 - DNA, 684 bp, Homo sapiens
  misc_feature: GYAE6OF01C4PHW.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccacccgtggtgtcagtcgtaccccaggaacaaacggccaggatcacctgctctgganttcattgacaaaagatatacttgttgttccagcagaatcgagcaggcccctgtactggtcagtccagtcgaggccaggtcgacgaccaccgtaccgggactccccgtagacgagtattcctcgtgccctccagctcgaagggacaggtcggccctactttacgacttagacgtacgggtcgggacccgtagggtagggaccgtaagtacggaaacggtccgttaagacgtttaaccttagtttacgttaaccgaccgtaaacccgtaagtaaccgtaagtacgggttaggtccgtaagttccggggtaaggggttaacggtttcggggaaccgggtaagggtaaacccgtaagggtttaccggaaccggttttccggttagggtttacccaccggggaccccgtaaggtccctaccccgggtcccccgttaccggtaccctccggttccgtttaaccccccg

SEQ ID NO: 89315 - DNA, 664 bp, Homo sapiens
  misc_feature: GYAE6OF01A7CS7.21.8.A08.1.454.CMB.1.raw
  modified_base (223)..(223): a, c, t, g, unknown or other
  misc_feature (223)..(223): n is a, c, g, or t
  modified_base (362)..(362): a, c, t, g, unknown or other
  misc_feature (362)..(362): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtggtgtcagtcgtccccagggaccaaacggccaggatcacctgctctgganattcattcgaccaaaagatatacttgttcggtccagctagaagtcacggccacggtccctgtactggtacagtccaagtcgacggcctaaggtccgacgtaccacgtaccgggacttcccgagagtaacgtactttccngtccgtcccgtcaggccgtcgaaggggtacctaggtccggtaccctaacgttcgaacttacgtcgtacgggtaccggggccgtaagggtacggacgtaaggttacggaaacgtcgttacggtaaccttagttaacgttacggttaacccgacgtaaccctaaggtaacgaaggtttaggtacgtaccgtagttaccggtaggggtacgttccgggtacggagggtacctaggttacggaccgttccgtaggtcgacgacccgaaggtcccgtcgccccgtaggtccctacgttcccgtaccg

SEQ ID NO: 89316 - DNA, 911 bp, Homo sapiens
  misc_feature: GYAE6OF01EXKLB.21.8.A08.1.454.CMB.1.raw
  modified_base (126)..(126): a, c, t, g, unknown or other
  misc_feature (126)..(126): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttcngcacagtctctggacggcccttctatgagctagacaccacgccctacccgtgggtcgtacgtacggtccgtacccgaaggaaccgaaaccggccgaaggactcctaccgtgaccttcgtggtaacgtactttactaacgttacgaaaacccgtaaaaaagtaatttacgtttaacgtttttcggttacggttacccgaacggtacgtaaaggtaaacggttaccgaacgggaccccgaaccgggtccccgtttaaggttaccgttcggttaccctaacttacccgtaaggtaccggggtaacggacccgtaacggttcccggaaacccgtacccgtaacccgggtttaccgggtacccttaccccgggtaagtaacgggtacggtttaaccttcccgtcgtttacccggtacccgtacccggtacggtacccggttaacgggaacgggggtacctaccgggttaccggtacccttaaccggtttacggacccgttttaaacggccgggttaacggggttaccggggaacccggtaggggtaacgggtaacgtaaggttaacggaacgttaccgtacgtaaccttacgttacgtttaacgttacccgacgaaccgtaacgtacgtagtacggtcgtacgaggtacggggtaacggttccgtacgggacggaacggtaccgttaaggtcgttaccggttcgtacggtaccgtaccgggaccgtaccggtccgtaccccgtcccggttacctaccggtacccttcccggttcccgttccccgtacccg

SEQ ID NO: 89317 - DNA, 944 bp, Homo sapiens
  misc_feature: GYAE6OF01D0NAY.21.8.A08.1.454.CMB.1.raw
  modified_base (154)..(154): a, c, t, g, unknown or other
  misc_feature (154)..(154): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacgcctctatganctgacacacgcccaccgtcggtgtctaggtccgtacccgaaggaaccaaacggccgaaggactaccacctgcctcgtaggagtacttcaattacgaacctaaaagtacttagttacgttttggtttacggtaccgaagacgaaagtaacggttacgaccggaccggtaccggtacccccgttacggttaccgttcgggtacctacctaccgtacgttacgggaccggaccctacgggttaccgaaccggtaaccgtacccggtcccggtaaccgtttaccccgaggtaacgtaacgtacctttccgtcgttaccgtccccgtaccgacgtccgaaccggtacgggtaacgtacggtttaccgggaacccttaaccggtttacgtaaacgttaccggttacggtaccggggtaccggggtaccgggttacggggttaaccggggtaaccgtaacggttaacgggtaacgtaccggttacgttaaaccggtttaacttttaaacgtttacccggtttaacccgtaacccgtaacggtaaaccgtaacggttaacgggttaacgggttacggtacggtttaacggtaacgggggttaaccggggtttaacgggttaccgggggtaaacgggtaaccgggtaaccgggttaaaccgggtttacccggggttaaacccgggtttacccggtttacgggttaccggtaaccccggtacccggtaaaccgggttccccgtacccgggttccccccggttacggttaccccgttacccgttacccggtttaccccccg

SEQ ID NO: 89318 - DNA, 667 bp, Homo sapiens
  misc_feature: GYAE6OF01AGEZ5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacgcctctatgagctgacacacgcccacccgtgtgtcagtcgtccccgaggacaaacggccaggactccacctgctcgtggatacttcattcgaacctaaaagtattattacgtttggttcggttaccagacgtagaaagtccgacggccgtacggtcccctaggtacgtcggcacgtccgagtcggacgaccgtacgtacgtaccgacgtaccgtccggacttacccgtaggaacgtacgtactttccgtctacggtccctaccgacgtaccgtacgaacgggtactacgggtaccgtacccttacgttacgacttacgtacggtacgggtccgggaccgtagggtacggacgtaagtacggtacgtcgtacgtacttacgttacgtagtaccacgactagtacgtagttacggtcgtacgtaggtacgggtagggtacgtcgggacgggacgtacgtcgttacgaccgttcgtacgacgacgaccgtacgtccgtcccgtacccgtctccgtcgtccgtaccccg

SEQ ID NO: 89319 - DNA, 862 bp, Homo sapiens
  misc_feature: GYAE6OF01CLHWE.21.8.A08.1.454.CMB.1.raw
  modified_base (104)..(104): a, c, t, g, unknown or other
  misc_feature (104)..(104): n is a, c, g, or t
  modified_base (128)..(128): a, c, t, g, unknown or other
  misc_feature (128)..(128): n is a, c, g, or t
  modified_base (153)..(153): a, c, t, g, unknown or other
  misc_feature (153)..(153): n is a, c, g, or t
tcagtcgtcgctcgcacgaccggtgctcgatttagcatactctacagggggctgtgggctcaggaggcagagctctgggaatctcaccatggcctggacccctntcctgcctccccctctcactttcngcacagtctctgaggcctctatganctgacacgagcccacccgtggtgtcacggtcgtacccgaggaaccaacggccaggactccacctgcctgtagggaatcttacagttacgaaaccaaaaggtacttcgttacgtttggttcggttacccaaggtaccgtaagtaacgtccgaacgggaccctaaccggttcccccgtaggttaccgtacggtacctaccgttaccgacggttaggaccggtacccgtacggtacccggaaccgtaaccccgtaccccggtacccggggtaacttccccggtaggtaaacgggcttttaacctttccgaccgttccgtacccccgtaacgtaccgtacggtaccggaacggggttaacgacgggttacccggacccttacgttaccggtaacttaccgtaccggtacggggtacccgggtccggtaacgggtacgggaaaccggtagtaacggaaccggtacgtaaccgttaaccgtttaacgttacgtttaccggtaacccgaaccgaactaccggttaacgtcggttaacggtaccggtaccgtagggttacgggggttaacgggttacgggtacggggtaaccgggacggtaaccgttaacggtcccgggtaaccgttcgggtttacgaccggtacccggtcccggaacgggttccccgttaacccggtcccccggtacgttccctacccgtttcccgttacccccgg

SEQ ID NO: 89320 - DNA, 754 bp, Homo sapiens
  misc_feature: GYAE6OF01CCAQS.21.8.A08.1.454.CMB.1.raw
  modified_base (177)..(177): a, c, t, g, unknown or other
  misc_feature (177)..(177): n is a, c, g, or t
  modified_base (406)..(406): a, c, t, g, unknown or other
  misc_feature (406)..(406): n is a, c, g, or t
tcagtcgtcgctcgcacgaccggtgctcgatttagcatactctacagggggtgggctcaggaggcagagctctgggaatctcaccatggcctcggacccctctcctgcctccccctctctactttctgcacagtctctgacggcctcctatgagctagacacacgccacccgtggtntcagtcgtacccgaggaacaaacggccaggactccaccgtgcctcgtaggatacttcattacgaacaaaagtattatacgttgttcggttaccaagcaagaacgtcgaacggccacggtccctgtacgtggctactccaagtcgacggcctagtaccgaacgacgtaaccggtcgggacctaccgtggaacgtagtacttcgtctcgcctacgagtcgtacgacggacngtccggacctacgttcgaactcgacggtacggggtccggggaaccgtagggtaaccgggagtagtaacggtaacgtacccgttaagggtaaccttaacgtttaggtttccgtaaaccgtacccgtaaccgtaaacggacgttaagggttaacggttccggtaacgtacggttacgggggaacgggggtttacgtacccgggggtaacgggaacggtaaccgttaagggtttcccgaacccggttttcgggtaccggtaccgaaccggtacccgggtccggtacccgttccccggtaccccggtccgtaaccttcccgtttaccctccccgggttaccccttacccccg

SEQ ID NO: 89321 - DNA, 943 bp, Homo sapiens
  misc_feature: GYAE6OF01AUT8K.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctgagcctcctatgagcctgacaccacgtcccacccgtcggtcgtccagtccgtaccccgacggaaccaaccggccaggtactccaccttcgcctcgtagggtatacgttcctagttacaaaccgtaaaaagtaacttatttaaccgttggtttacggtttacccgacggtacgaaggtaacgtacgaacggtacccggtaccggtccccgttacggtaccgtacgggttacctacctaccgtacgttcggaccggtacggaccgttaccgggaacccggaccgtacccggttacccggggtaccttccccggtagggtagaccgtttacgttacccgttactcccggtaccccgtaccggtaccgtacccgttaggggtaacccgggtacggtacggttaccccggttacccggttaacctttcggtaaaccgttaacgtaccgggtacggggttacccggggtaacccggtacggggtaaccggttaggtaaccggtaacgggaaccggttccgttaacgggttaaccgtttacgtttaacggtttacgtaccgtacccggtaacccgtaacggtaacgtaacggttacggtaccggtttaaccgtagggtttacccgggtagggggttaccgggtacccggggtaaaggtaccggggtaaccggttacggttaacccgggttccccgggtttacgtacccgggttaaccgggtacccgtacccggggttaaccgccccgggtttaccccggtaccccgggttaccggtttacccgttccccgttcggtttcccccccggg

SEQ ID NO: 89322 - DNA, 770 bp, Homo sapiens
  misc_feature: GYAE6OF01CS02A.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccctacccgtcggtcgtcagtccgtaccccgaggaaccaaaccggccaaggactccacctgctcgtggatattcattcgaacctaaaagattattacgttggtttcggttaccagacaagaacgtcaggaccacggcccctagtacgtcggactactaccgagtcgacggtccaaggtaccgaacgtaccgaccgtcccgggactcccgtaggagtacgtactttctccgtcgtccctaccacggtaccacggaacgggtaccgtacgggttaccgaccccgttaccgttacggacttacgtaccggtaacgggttccgggggaaccccgtaggggtacgggaacgtaacggtaggaacggtcgttacgtaacgttacgttaagtttaccggttaccgacgtaccgaacgtacgtaacggtacggttacggtaaccgtagggtacgggttacggggtacgtttcgggggaacgggtaacgggtaaccgttagggtttaccggtacccgggttacggttcggtaccggtacccggtacccgggaacggttcccgtcccgggtaccccccgttacggtcccgttacccgttcccgtttacccccgg

SEQ ID NO: 89323 - DNA, 866 bp, Homo sapiens
  misc_feature: GYAE6OF01BYSI3.21.8.A08.1.454.CMB.1.raw
  modified_base (342)..(342): a, c, t, g, unknown or other
  misc_feature (342)..(342): n is a, c, g, or t
tcagtcgtcgctcgcacgaccggtgctcgatttagcatactctacagggggtgggctcaggaggcagagctctgggaatctcaccatggcctggacccctctcctgcctccccctctctactttctgcactagtctctgacggcctctagtgagtctgacacacgccctaccgtggtctcagtccgtacccgaaggacgaaaccgtcaaggactaccgactgacctgtcggatacttcaagttacgaaacaaaaagtaattacgttacgttggttcggtaccagactaacggtacgtacgacggtaccgaacggtccctaggtacgttacgggtacctaacnccgtaagtcggtaaggacccaggttccgaaacgaccgtacggtaccgggacttacccgtaggaaggtaacggtctttacgtaccgtacggaccccgttacgcggtaccgttaacgggaacggtaaaccgtacgggttcccggaaccgttacccgttttaaacggaaacccgtttacggttaccgggtaacggggttacggggtaacccgggtaacggggtacgggttaacggaacggttaaacggtaacggttaactaaccgggttaactttaaccgtttaacggtttaaccggtttaacccgaacgttaacccggaaacgttaaccggtaaacggtttacggaacggttaacggttaacgtaaccgggggttagggttaaccggttacggggacgggtaacgggtaaaccgtagggttacccgtaccgggttacgttccgggaacgtacccgggaaccgttggccccgttaccggaccccgttcggtaccgtacgttcccgttaccgtccccgtttaaccccg

SEQ ID NO: 89324 - DNA, 645 bp, Homo sapiens
  misc_feature: GYAE6OF01EQAXI.21.8.A08.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagcatactctacagggggctgtgggctcaggaggcagagctctgggaatcgtcaccatggcctggacccctctcctgctcccctcctcactttctgcacagtctctgaggcctcctatgagctgacacagccaccctcggtgtcagtgtccccaggacaaacggccaggactcacctgctctggagattcattgaccaaaagatatacttgttgttccagcagagtcagccaggccctgtactgtcatccatgagcagtctacgacacgtcgggatcccgtgacgagattctcttcgccctcagtctcgacggacagnggccactttgacttatcgagtcgggaccgacggtgaacgagtggaacgtcgtagacttactagtttcgtaacggcaaccgaggtactaggtacgtacggtacgtagttcggagggggttacgttaccggggacggtaacggggtaacccgtaagggtttaccggtaacccgggtttccccgtttggggttacccgtaacgggtaccccccgtaaaacgggggtccccttaaacccgggttccccccccgttacgggggtttacccgtaacccgtttccccggtttacccccggg

SEQ ID NO: 89325 - DNA, 777 bp, Homo sapiens
  misc_feature: GYAE6OF01EVWML.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacctcggtgtcagtcgtccccaggaccaaacggccaggactcacctgctctggatattcattcgaccaaaagtatattacttgttgttccagcaagaagtcaggccacggcccctagtactggtcatccagtgacggccaggtccgacgaccaccgtccgggtactcccgtagacgtacgtactttccgtacgtcgcccttacccgaaggtcccttaaccgggaagggggtacctacggggttacccgggacccctaaccgtttacggaaccttacgttaccgaacggggttccggggaccccgtaaggggttacgggaacgtacgtacggaaacggtccgtaacgtaaccttaacgttacgtttacggttaaccggactaacccgtaaggaacgtaagggttacggtacggtaccgtaacggttaccggggtaagggggtttacgttaccggggacgggtaacgggggtaacccgttaaacgggttcccgggtacccggttccggtttacgggtacccgtaaccgggtacccccgtaaacgggtccccgttacccgggtacccccccgtttaccggggtcccgttacccgttcccggtttaccccccgg

SEQ ID NO: 89326 - DNA, 851 bp, Homo sapiens
  misc_feature: GYAE6OF01AWJ28.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaacacacgcccacccgttcgggtcgtcaggttccgtaccccgaagggaaaccaaaaccgggccaagggaactccaccgtgctcgtgggaatcttacattacgaaccaaaaagtattacgttactttggttcggttcccagaccgtaaggaacgtcgacggccgacgggtcccctaggtaccgtggttacacgtaccagtcggacgtcccgaggtaccggaaccgtaaccgtacccggtaccgggtactacccgtaggaacggtacgtacgttcttccgtcgcccctacgtacgcgtacgacggtacgtacggtccgtacccctacgttacgtaactcgtacccgggtagggtcccgggacccggtaagggtcggaacgtaggtaacggacgtccttacggtaaccgtttactttaaacggtttaccgttaaaccgcccgttaacccggaaacggttagttaaaccgggttacggttacgttaacccgtaagggtttaccggggggtaaccgggggttttacggtaacccggggccgggggtaaaacggggttacccgaacgggttttaccccgggtacccgggtttaccggttccgggaaccggtacccccgtaaccggggaccgtccccggtttacccccgggtacccccggtttcccggaacccttaccggttccccgtttcccccccggg

SEQ ID NO: 89327 - DNA, 932 bp, Homo sapiens
  misc_feature: GYAE6OF01CZ8SV.21.8.A08.1.454.CMB.1.raw
  modified_base (131)..(131): a, c, t, g, unknown or other
  misc_feature (131)..(131): n is a, c, g, or t
  modified_base (908)..(908): a, c, t, g, unknown or other
  misc_feature (908)..(908): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctctactttcngcactagtcctctgacggtcctcctatgagctgacacacgcccacccgtggtgtcacgtcgtacccccgaagggaaccgaaaccgggccaagggacttccaccgtcgctcgtagggaactacttacgtaacgttacgaaaaccgaaaaagtaattacgtttaaccgttttaggtttagggttaccaaaaaggccgtaaaggtaacggtacccggaacgggtaccccgaaccgggtcccccgttaagtaccggttacggtaccctaacgtacccgtaaggtcgtaaccgggcccgtaacgggtacccggaaccggtaacccgtacccgttaccccgggggtaacttaccccgggtaggtaaacggtacgttacctttcccgtccgtaccgtacccctacccgaaggtttcccgacgggaaacggggacgtaccggtaccggtacccctaaccgttagaacctttacgggtccggacggggttaccggggacccggttaagggcccgggaaagtacggtaacggaaacggttccgtaacgtaccttaacggttaacgttttaccggtaaccggccctaaaccggtaagtaaccgggttaagttaccggggttagttaccggtaaagggttccggggttaacggggttacggttccgggggaaccggggtaacggggttacaaaccgggtttcgggtaccccgtttcgggtacggtacccgggaacgttaccccgggtaaacggttccccggttcccccgtaccccgggtggttaccccncccgggttccgtttaccccccggg

SEQ ID NO: 89328 - DNA, 792 bp, Homo sapiens
  misc_feature: GYAE6OF01ASIK8.21.8.A08.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgccacagtcctctggacggtcctcctatgagctgacacacgcccacccgtcggtgtcacggtccgtaccccgaaggaaccgaaaccggccgaggactccaccgtcgctacggtggagttacttactacgttacgaaccaaaaagtaatttacgttacgttttggttacggttacccgagtcgaaggtaacggtaccgacggacccgaccggtccccgttaggtaccgtcggtacacgtccgagtcggacggccgtacgaccgacgacctaccggtccggactccgtagacgtactcttcngtcgccacgcgtcgacggaacggcgtacggtccgaccctacttacgactcgtacgtcggggtccgggccgagggtaccgggacgtagacggaaacgtccgtacgtactttaacgttaccgttacggtaaccgtccgaacgtaacggtacgtaacgggttaggttaccggtacgttaacgggttaccgggggtaacggggttaccgtaccgggggtacggggtaaacccggtacggttaacgggttcccgtaccccgggtttacgtaccgggtaccccgaaccggtacccgggacccggttccccgttaccccgggttccccccggttaagtccccccgttccgttaaccccggttccccccg

SEQ ID NO: 89329 - DNA, 773 bp, Homo sapiens
  misc_feature: GYAE6OF01BFPKI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggcctcctatgagctgacacacgcctacccgtcgggtgtcacgtcgtccccgaaggacgaaaccggccaggactccacctcgctcgtggtagtattcgattcgaaccaaaagtattatacgtttggttcgttaccagcgaagtaacgtcgacggccgacggtcccctagtactcggtacatccagtcggacggtacgacgtccgtacgaccgacgtccgggacttacccgtagagtacgtactttccgtcgtaccgtccctaccgtacgtccgttacggacggggtaactacgggtcccgtaccttaacccggtttggtaaacctcggttacggacggggttaccggggtacccggtaacgggtacgggacggtaaggtacggtaacggtacgttacggtaacctttacgttaacgtttccggttaaccggaccgtaaccgtacggtaacgtaaggttacggtacggtacgtacggttacgggttacggggttacggtaccggggacgggtaaccgggaaccggttacggtacccggtccggttacccggttcggtaccggaccggtacccgtaccggttccgtacccggtcccccggttaggtccctaccggttcccgtttacccccgg

SEQ ID NO: 89330 - DNA, 876 bp, Homo sapiens
  misc_feature: GYAE6OF01B7X6O.21.8.A08.1.454.CMB.1.raw
  modified_base (182)..(182): a, c, t, g, unknown or other
  misc_feature (182)..(182): n is a, c, g, or t
  modified_base (226)..(226): a, c, t, g, unknown or other
  misc_feature (226)..(226): n is a, c, g, or t
tcagtcgtcgctcgcacgaccggtgctcgatttagcatactctacagggggctgtgggctcaggaggcagagctctgggaatctcaccagtggcctcggacccctctcctcgcctccccctcctcactttctgcacagtctctgacgcctctatgacgctacgacacacgccaccgtcggtntcgagtcgacccaggaacgaaccgcgagactccaccgtgctcgnggagtattcagtacgaaccaaaagtattacttacgtttggttacggtaccaggtacaaggtacgtacggaccggaccgaccggtaccttacggttactcgtaacacgttaaccaggtcgaaccggtaccacggtaccggaaccggaacctacccggtaccggggtaaccctacccggtaggaaccggtagtaccgtttcctaccgtccgtacccctaggaccgtccgaacggtaacgggtacgacgggtaccgtaacccgacgttagtaccgttacgcgggttacgggtaccggggacccgtaagggtacgggtaaacgtaacgtaacggtaccgtacgttaacgtaaccgtttaacgttaccgtaccggaaccgttaaccaaccgggtaaccgtaaacggtacgggtttacgaccggttaaccgggttaggtaaccgggggttaaaccgggggttcggttaccggggggaaccccgggttaaaacgggtaaacccggtttaacgggtttacccggggacccgggttttaacggttcccggggtaaacccgtacccggggaacccgtttacccgggacccccgggtttacccccgtttcccccgggggtaacttacccgtttacccccgtttaccccggttaccccccgg

SEQ ID NO: 89331 - DNA, 746 bp, Homo sapiens
  misc_feature: GYAE6OF01BIB00.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtcgtccccaggacaaacggccaggatcacctgctcgtggagtattcattcgaccaaaagtaatatacttgttcgttccagcagagtcaggccacggcctgtactgtcatccagtcggacgcgagtccgacgaccaccgtccggactcccgtagagacgtcttcctcgtcgcccttccgacgccgtacggaacgggactacgggtccgacctaccgttcggaacttacgtacgacgggtccggggaccgtagggtaggaccggtagtacgtaacggtcgtacgtaaccttacgttaacgtttacggttaccaacccgtaccgtaacggacgtaacgggttacggtacgttacgtacggtttaccggggtaacggggggtttacgttacccggggggaacgggtaacggggtaaacccggttaacgggtttacccgggtacccggttttcccggttaaggggttacccgaaccggggtacccccggttaaacggggtccccggttcccccggtaccccccgggttaccgggttacccccgttaccccgtttcccggtttaacccccccg

SEQ ID NO: 89332 - DNA, 876 bp, Homo sapiens
  misc_feature: GYAE6OF01DA33G.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgaggcctcctatgagctgacacacgcccacctcggtgtcagtcgtccccgaggaacaacggccaggactccacctgtctcgtggagtacttcattcgaactaaaagaatattacttggtttcgttaccagcgaagtagtccgacggcctacggtccccttagtacgtcggtactactaccgtagtcggacggtccgaacggtaccggacggaccctaccggtacccgggtactccccggtagaacggtacggtactttccgtaccgtcggtaccccttccgaacgtcccgttaacgggaacgggtaccgtacggttaccggaccccttaaccgtttaggtaccgttacgtaacgggttaccggggtacccggggtaaccccgtagggggtaccgggtaaacgtacgttacggtaaccgtcgttaaccgtaacgtttaaccgtttaacgtttacggtaaccccgactaacccggtaagttacggtttaacggttaggttacccggttacgttaacggggtacccgggggttaaagggggtttaccgttacccggggggaacgggttaaacccggggtaaccttaacggggttacccggttacccggtttacccggtttacgggtacccggaaaccccggttaccccgggtaacggttacccccggtttacccccgggacccccggttttaccgggttaacccccttccggggttttcccccgtttaccccccgggg

SEQ ID NO: 89333 - DNA, 1200 bp, Homo sapiens
  misc_feature: GYAE6OF01AMK8Y.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggggagaggagcccagcactagaagtcggtcggtgtttccattcggtgatcagcactgaacacagtagactcaccagtggtagttggctgaggtcgttcggttttcctccttgtcttacgttttaaggnggttcgtcctaggtgtcgacggccgtacgtaacggtgggtggtacggtcgggtggggggaggctaggtccggtccgtacgggtccgttcggggaccggttcccgtaggacccttccgttacccgttccgttggtcgaccgtaaccgttcggttcgtacggttacttacgtaacggttccgtcccggttacccttccgtttccgaccccgtattccgggaaccgttccccggttcccggggaccccgtaccggttaaccggaccccgggtaccggttaacggggacgggaccgggggttaacggtggggttaaaggggtttcccgggggtcggtaaacccgtttagtttaacggttccggggtttagggtaaccgttaaggggggtattttaaacccgggggggtaaaacgttacgggggttaaaaaacgggtttactttaaaacgggttttttaaccgttttaaccggggtttaaccccggtaaaacccggggtttaaccccccggggttttaaaacccggggggaaaccgggtttaaccgggttacccggtttaaacccgtttaacccggttaacccggtttaacccgtttaaaccccgggttaaaccggtaaaaccggtaaccgggttaaaacccggttaaacccgtaaacccggtaaaaccccgttaaaaaccgtaaacccggttaaaaccgtttaacccgggtttaaactttaaacccggtttaaacccgtttaaacccggtttaaacccgggttaacccccgggttaacccgggtttaaccgggtaaccgggtaaacccggggtacccgggttaaaaccccgggtaacccgggttaaaccggggtaaccccggttaaacggtttaaacccggttttaaacgtttaaaccgggttttaaacccgggtttaaccggttttaaccgggttaaacccgggtttttacccgggtttaacccggggtttaaccgggttaaacccggggtttaacccgggggttaaacccccgggtttaacccc

SEQ ID NO: 89334 - DNA, 812 bp, Homo sapiens
  misc_feature: GYAE6OF01CTAW8.21.8.A08.1.454.CMB.1.raw
  modified_base (127)..(127): a, c, t, g, unknown or other
  misc_feature (127)..(127): n is a, c, g, or t
  modified_base (168)..(168): a, c, t, g, unknown or other
  misc_feature (168)..(168): n is a, c, g, or t
tcagtcgtcgctcgcacgaccggtgctcgatttagcatactctacagggggtggctcaggaggcagagctctgggaatctcaccatggcctggacccctctcctgcctcccccctcctctactttcngcacagtctctgacggtcccttcctatgacgctacgacacncgcccacccgttggtgccaggtccgtccccgaagggaaccgaaaccggtccaaggtactcccaccgtcggtctaccggtagggacttacttcgtacgtttacgaaaaccgtaaaaaaggttacttaaacgtttcggtttcggttttccggtaccgtagtaaccgaaagaacgttcgaaccggcccgtaccggtcccgtaggttacgtccggtactaccgtccgtagtacggtaccggccgtaacggtaccggaaccgaaccgtccggtaccggaaccttcccgtaggactacggtacttcgtcctcggtcccctaccgagtccgtacgggacggtaacctacggttacccgaccttaccggttacaccgtttacggtaccggacggggttcccgggaccgggttacgggtacggaacggtaacgtacggtaacggtaccgtagtaaccttacggttagttaccgtaactaccacgtaacgacgtaggtttcgaggtacgttaggtcggggttacgggtaggtccgggaacgggtaccggtaacggtcgttccggtacccgttcggttcggtcgaccgtaccggtccggtccgtcccgtaccccggtcgtaccccttaccgtccggttccccgtcccggtccccg

SEQ ID NO: 89335 - DNA, 736 bp, Homo sapiens
  misc_feature: GYAE6OF01B7HFR.21.8.A08.1.454.CMB.1.raw
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
  modified_base (709)..(709): a, c, t, g, unknown or other
  misc_feature (709)..(709): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgacgctgacacacgcccacccgtcggtntcagtcgtaccccaggaccaaacggccaggtactcacctgctcgtgganattcattcgactaaaagatattacgttgttcgttcagcagagtcgaggccacggccccttagtacgtggtcacgtccagtggacggaccacggttacgaaccggaaccgtccggactcccgtagaacggtactactttccacgtccgacccgttacacggtccgtcggaaacgggtacctagggttcccgtacccgtaccgtttacgaacttacgtaccgggtacgggtacccggggtaccctaggggttacggaacgtaggtaacgaacgttcgtacggtaacctttaggttaacgtttacgtacccggaccaacggtaagtaccgtaagggttcggtagttaccgtaagttccgggaaggggtttacgtccgggacggggtaacggtaccggtaacgttaccgggtacccggttaccgttcgggtacccacgggtccccggaaacggttccccacccgggttccccctacgggtacccnccggttccccttaccgggttccccccc

SEQ ID NO: 89336 - DNA, 742 bp, Homo sapiens
  misc_feature: GYAE6OF01EGTZW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccttcgggtgtcgtagtcgtccccaggaccaaacggccaggactcacctgctcgtggatattcagttcgaaccaaaagtaatattacgttgttcggttccagcaagaacgtcgaggaccacggtcccctggtacgtcggtcactcctagtggacggccgaggtcgaccgactccgtccgggacttcccgtagagacttacgttctactccggtccctacgacgtcgtaccggaggtacacgggtcggtaccctaccgttacgaacgttctacgtacgggtaccggggaccggtagggtacgggtacggtacgtaaggtaacgacgtacgtacttaacttaacgtttacgttaccgaccgtaccgacgtacgtaaggtacggttacggtacgtacggtacgggtacggggttacgggtacggggaccgggtacgggtaaccggtaacggttaccggttaccggttaccggttcggtacctaccgggggggggggggggggtaccctaacgggtcccggttaccccggtacccccggttacccggttcccgtacccgttcccgtttacccccgg

SEQ ID NO: 89337 - DNA, 753 bp, Homo sapiens
  misc_feature: GYAE6OF01EELSV.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctctcactttctgcactagtctcgtgacgcctctagtgacgtctagactacgacgccctacccgtcggtgtaccgtaggttaccgtaccccgaagggtaacccgtaaaccggtccgtaaagggtacctcccgtacccgtggacccgttcggtagggacttaacttcgtacttacgaacctaaaagttattaacgttacgttggttcggttaccaagtaccgtaaggtacgtcgacggtaccacggtcccctagtacgtcggtacacgtcagtacggacggtcgagtccggactacgtccggtacggacttcccgagacgtctacgttcacgtcgccctgacgtcgacgtacggcgtaggtaccgtcctaacttcgtaacgtcgtacggacgggtccggaacggtacggtacgacgtagacgtacgtcgtacgtacgtacgttacgttacgtaccgtctaacgacgtaacgtacgttaggtcgtacggtacggttacgggtacgggtacgtaccgggagggtaccggtaacgtaccgggtaccgttaccggtccgtttaggaccgttaccggacccggtaccggtccgttaccccggtacccggtaccggtacccgtccgttcccgttccccccggg

SEQ ID NO: 89338 - DNA, 647 bp, Homo sapiens
  misc_feature: GYAE6OF01EY3HB.21.8.A08.1.454.CMB.1.raw
  modified_base (124)..(124): a, c, t, g, unknown or other
  misc_feature (124)..(124): n is a, c, g, or t
  modified_base (214)..(214): a, c, t, g, unknown or other
  misc_feature (214)..(214): n is a, c, g, or t
tcagtcgtcgctcgcacgaccggtgctcgatttagcatactctacagggggtgggctcaggaggcagagctctgggaatctcaccatggcctggacccctctcctgctccccctctcactttcngcacagtctctgagcctcctatgagctgacacagccaccctcggtgtcagtgtccccaggacaaacggccaggactcacctgctctgganattcattgaccaaaagactatacttgtgttccagcagagtcaggccagccctgtactggtctacgtacacgtcgacgacgtacgtacgacgacgtaccgtacggtaccgtccgtacgacgacgtacttcgtcgtcgtcctaccgtacgtacgtacgtacggacgtacggtacggtaccgtaccgttacgtacgtacgtacgtacggtccgggtaccggtacggtacggtacgtacgtacgtacgtacgtacgtacgtacgttacgttacgtacgtaccgaccgtacgtacgtacgtacgtacgtacgtacgtacggtacgggttacggttacgggtacgggtacggtacgtacgttacggtaccgtacgttcggtacgtaccgtaccgaccgtccgtaccgtcccgtccgtaccgtccgtccgtcccgtcccg

SEQ ID NO: 89339 - DNA, 818 bp, Homo sapiens
  misc_feature: GYAE6OF01BOQ0O.21.8.A08.1.454.CMB.1.raw
  modified_base (796)..(796): a, c, t, g, unknown or other
  misc_feature (796)..(796): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccctacccgtcggtcgtcgacggtccgtaccccgaaggaaccgaaaccggccaacgggtactccacccgttgccttacggtagggatactttaccgtaacgtttaccgaaaccctaaaaaggtaactttaactttaacggttttgggtttaccggttacccgaaggtaccgtaaagggtaaccgtaccgaccgggtacccgaacccgggtcccccgttaggttaccggtccggttaccaaccgttcccgagtaccgggtaccggacccgtacggtacccggaaccgtaacccgtaccgggttcccgggtaaccctcccggtaggaacggttactaccgtttccctcgtaccgccccgtacgacggtccgttacggaacggtacgtacggtccgtaccctacgttacgtactacgtcggtacgggtcccgggaccgtggggtaccgaagtaggtacggagttccgtactaacgttaaccttagttacccggaccacgtaaccgagtaacggtgttacggtgtacgtaggtacggggttagggtacgtccgggagggaaccggttaaccgtaggtacccgtcggttcgtaggaccgccggtacccggaggttccccgtccccggtacctccnccgttcccgtccgtaccccccg

SEQ ID NO: 89340 - DNA, 731 bp, Homo sapiens
  misc_feature: GYAE6OF01AQKR3.21.8.A08.1.454.CMB.1.raw
  modified_base (233)..(233): a, c, t, g, unknown or other
  misc_feature (233)..(233): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcactttctgccacagtctcgtggacggtcctacctagtgagctacgacacacgcccacccgtcggtgtcagtcgtaccccaggaaccaacggccagactcacctgctcgnggatatcattacggaaccaaaagtattacttacgtttcggttcggttaccagacgtaaggacgttcgaacggcccgaccggtccccttaggtacctggtaccacgttccgagtcggaccgaccgtacgtaccgaccgtacgaccgtccgggtactcccgtagacgtacgtacttcctcgtccgcctccgacgttccgaggacggtacgtacgtccggtaccctacttggaaccttgtacgggtcgggtccgggtaccggtagggtacgaccgtaagggtagaaccgtaccggtaacggttactttaacgtttaacgttccgtaacccgtacgaaccgtaccggtagttagtacgggtacgtaggttacggtaccgggtaagggttcggtaccggaagggtaccgacgttaggtccggttccgttcggttagtacccgcgtacccgtaccggtccgttcccccggttacccgtagtcccgtcccttcccggtacccccg

SEQ ID NO: 89341 - DNA, 809 bp, Homo sapiens
  misc_feature: GYAE6OF01BAB4S.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgttggtgtcacgtcgtccccgaggaacaaaccggccaaggataccacctgctcgtggagtacttactattacgaacctaaaagaacttattacgtttgttcggttaccagtcgaagaagtcgacgggccaccggtcccctgtaccgtcggttacactccgagtcggtacggcccaggtccgaaccgaccaccgtcccgggactcccgtaggagtacgtacttccgtcgtacgcccctacacgtccgttacggacgggaccgtacgggtccgacccgtaccgttagtacctagtacccgtaggggtacccggggtccgtacgggtacgggaacgagttacggaaccgtcgtaccgttaacgttaaccttttaggtttaccgttaccgaccgtaaccgaacggtacgtaggttaagggtcggttaacgttacgggtaccggggttacggggtttacgggtaccggggtaaccggggtaaccgggttaacccgggttaacggtttacccggggttaccccggttacccggtttacgggtaaccccggtacccggaaccccgtaacgggtacccccggttacccgggtaccccccgtttacccgggtccccgttacccgtttcccccggttaccccccggg

SEQ ID NO: 89342 - DNA, 896 bp, Homo sapiens
  misc_feature: GYAE6OF01C7SB3.21.8.A08.1.454.CMB.1.raw
  modified_base (135)..(135): a, c, t, g, unknown or other
  misc_feature (135)..(135): n is a, c, g, or t
  modified_base (153)..(153): a, c, t, g, unknown or other
  misc_feature (153)..(153): n is a, c, g, or t
tcagtcgtcgctcgcacgaccggtgctcgatttagcatactctacagggggctgtgggctcaggaggcagagctctgggaatctcaccatggcctggacccctctcctcgcctccccctcctcactttctgcacngtctctgaggcctcctangttttagctgacacagccaccctcggtgtcagtcgtccccgaggaacaaacggccaggactcacctgcctcgtggatacttacattacgaaccaaaaggaattattaaccgttggttacggttaccaagtacaagtaacgtccgacggaccgacggtccccgttagttaccgtcggtcctagtaccctaagtaggacggtacccgaaggttacccggaacggtacccgaaccgttccccgggggaaccttaccccggtaggaacggtaaggttaccttttcccgtacgttacccgtaccccgttaccacgggtaccgttaacccgggaacggggtaacccgttaacgggtccgggtaccccgttaaccgtttaccggtaaacccgtttacggtaccggttaaccgggggtccgggggaccccgggttaaggggtaccggggtaaacgggaagtaacggggtaaacgtacccggttacggtaaacccgtttaacgtttaaccgtttacggttaacctaacccggtaaaccgtaacggtaacggtaacggttacggttaggggttaaccttagggtaccgggtaaggggggtttaacggttccggggtacggggtaaacggttaccggacgggtttacggaacccggtttcccgtttaggaacccggtaccgtaccccggtaaacgggtccccttcccgggtaccccccgttccggttaacccgcccgttcccggtttacccccg

SEQ ID NO: 89343 - DNA, 862 bp, Homo sapiens
  misc_feature: GYAE6OF01BKCCV.21.8.A08.1.454.CMB.1.raw
  modified_base (168)..(168): a, c, t, g, unknown or other
  misc_feature (168)..(168): n is a, c, g, or t
tcagtcgtcgctcgcacgaccggtgctcgatttagcatactctacagggggctgtgggctcagggaggcagagctctgggaatctcaccatggcctcggacccctctcctcgcctccccctcctctactttctcgcactagtcttctcggtacggcctacctatgacncgtgaacacctagccctaccccgtggtcgtcgtacgtcgtaccccgaggaaccgaaaacggccgaaggacttaccaccgtcgcttacgtagggatacgttctaacgttacgaaactaaaagtaacttacgtttacgttcggttttacggttacccgaacggtacgtaacggaaaacggttccgaaacggggcccgtaccggtaccccgttacggttaaccgttcgggttaacctaccgtttaccgtaggttaacggggaaccggtaccggtaaacggtacccggaaccggtaaccgaccccgggttcccgggtaaccttccccggtaaggtaacggtaccgttaccgtttacctccgtaccgtccccgttaacccgagttcccgtaaacggaacgggtacgtacgggaccggttaccctaccgttaacgtacgtaacgtacggtaccgggtaccgggtaccgggtacgggtacggtaacgtaacggtaaccggtaacgtacggttaaccgtaaacgttaaccgtttaacgtttaccggtacacccgttaacgacgtaacgtaagggtacgtacggtacgtacgtaacgggtacgggttacggtacgggacgggtaccggtacgtacgtaccggtccggtcgtacggcgaccgacgtacgccgtcccgtcccttcgtacctccgttcgtaccccg

SEQ ID NO: 89344 - DNA, 844 bp, Homo sapiens
  misc_feature: GYAE6OF01DNTSI.21.8.A08.1.454.CMB.1.raw
tcagtcgtcgctcgcacgaccggtgctcgatttagcatactctacagggggtgggctcaggaggcagagctctgggaatctcaccatggcctcggacccctctcctgcctccccctcctctactttctgcactagtctcgtgacggcctctatgagctgacacacgccaccgtggtgtcagtcgtcccgaggaaccgaacggccaggactccaccgtgcctcgtaggacgtacttctaagttacggaaacctaaaaagtataacttacgtttggttcgtaccagacgaagtaacgtcgacggaccgtaccgaccgttagtacgtcggtacctatccgagtcggacggtaccgtacgtaccggaaccgaccgtaccggtaccgggtactcccggtaggaacggtaacggttacgttccgtaccgttaccggtaccccgttaccggacgggttaccgtaacggggtaacccgggtaaccgttacggggtacccggttaccccgttaaacgtttaccggtaacctttaacggtaccgggtaacgggggtcccggggtaacccggtagggggtaaccggaacggtacgtaggtaaaccggtcggttaaccgtaacttttaacgttacggttaaccgtaaccgaccgtaaccgtaaggtaactacgggttaacggtcgttaaccggtagggttacggggttacggggtttaccgggtaccggggaacgggtaccgggtaaacgtaccggttcggccggttttaccgtacggaccgtacccggaacgtaccgggtccgtccccggttacccgtcggtacttacccgttccgttcccgttccccgtacccg

SEQ ID NO: 89345 - DNA, 825 bp, Homo sapiens
  misc_feature: GYAE6OF01DPYQP.21.8.A08.1.454.CMB.1.raw
  modified_base (131)..(131): a, c, t, g, unknown or other
  misc_feature (131)..(131): n is a, c, g, or t
tcagtcgtcgctcgcacgaccggtgctcgatttagcatactctacagggggctgtgggctcaggaggcagagctctgggaatctcaccatggcctcggacccctctcctgcctcccccctctctactttcngcactgtctcgtgagcctctagtgagtctagaccacgtacgtacccgtacccgtggttcgtccgtacggttccgtacccccgaaggaaacccaaaccgggcccgtaacggacttaccctaccgttcggaccttacgtagggactacttacctacgttaccgaaaacctaaaagtaatttacgtttacgttcggtttaccgtaccgaagtacgaaacgtaacgtaccggaacggtccgtaacccggtccccgttagttaccgtcggttaaccacgttaccagtacggacgccgtacgtaccggaccgaccgtacgaccggtactacccgtagagtactacttcctcgtaccgtcctacggtcgacgtccggaggacgtccgtcgaccgtactacgtaccgtacgtacgacggggtaccgtccggtaggtaaccggacgtgtaaaggtacctacgtacgtaactttaaccgttgtttaccgacgtaaccgaacgttacgtaacggttacggtttacgtacggttacccgagggttaccgggggttagttaaccgggttacggggaacccggttaaacggtaccgttaagggttcccgtaaccggttccggtagtaccggtaccgaaccccgggtccgtacccgggtttacccgaccccgttaccggtaccttacccggttccccgtaacccccggg

SEQ ID NO: 89346 - DNA, 162 bp, Homo sapiens
  misc_feature: GYAE6OF01D2KME.21.8.A08.1.454.CMB.1.raw
  modified_base (148)..(162): a, c, t, g, unknown or other
  misc_feature (148)..(162): n is a, c, g, or t
tcagtcgtcgctcgcacgaccggtgctcgatttagcatactctacagggggctgtgggctcaggaggcagagctctgggaatctcaccatggcctcggacccctctcctgccctcccccctcctctacttttctgccactaggtcctnnnnnnnnnnnnnnn

SEQ ID NO: 89347 - DNA, 854 bp, Homo sapiens
  misc_feature: GYAE6OF01CXAEA.21.8.A08.1.454.CMB.1.raw
  modified_base (293)..(293): a, c, t, g, unknown or other
  misc_feature (293)..(293): n is a, c, g, or t
  modified_base (754)..(754): a, c, t, g, unknown or other
  misc_feature (754)..(754): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagtcgttcgggttttcctccttgtcttacgttttaaggaggtgtccgagtgtcgagggccgactaacgtgggtagggtacgtcggtggggggaggtcagttcgggtccaggtccgtgggggtacgtcccctggcgtccctcgtccgtggtcgacncggtcgttgtacggttacttacgtaggttaccgttccgggtccttttcccgtttcggaccctagttaccggtccgttaccgggttcccggggtccccgacccggacgggttcccctacccgggaaagggtccggggtaaacgggggggtcccgttagggggtaaccgggggttggggggtaccggtaccgttaaggttttacgtcgggttagggttaaccgtagggtaagggtttaagggggaaagttaggaaagggtaagttacgttttaagtttactaccggacggttacccggttacgggtacggtaaccgggtacccgtacttacccgtaaccctacttccgtaacgtacaacggtaactaaccggactaaccgaacccaacacctactacgttaactactaacgtaacgcggtaccggacgtaggtaacccgaggtaccgaacggaccgttacgtnttaaacggttagttaacgttacggtacgtacggtcggtttcggtacgttacgggttacgggaccggggttacccgaccgggttaccgtccgggttacccg

SEQ ID NO: 89348 - DNA, 722 bp, Homo sapiens
  misc_feature: GYAE6OF01D6U3V.21.8.A08.1.454.CMB.1.raw
  modified_base (501)..(501): a, c, t, g, unknown or other
  misc_feature (501)..(501): n is a, c, g, or t
  modified_base (551)..(551): a, c, t, g, unknown or other
  misc_feature (551)..(551): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgagcctctatgagctagacacacgcccaccgttcggtctcagtcgtaccccgaaggaaccgaaaaccggccgaaggtactaccaccgtgtccgtcgtagggatactttcaacgttacgaaaccaaaaagtactaactttacgtttcggttacggtacaagacgaaaggaacgtcggacggccgacggtccctagtacgtcggtacacgtaccagtcggacggcctaggtaccgaacgactaccggtacgggtactccgtaggacgacgttacgttactccgtaacgccctacgacggttacgaggtaacggactacgggccgtacctaacgttcgtaactgtacggacggtccgggaaccgngggtaacgagagtacgaacgtcgtactacttaacgttacgttcgtaaccncggaactaagtaccgggtagttagtccgttaagacggttacgggtaggggtaacgtccgggaggggtaaaccggtacctagggttaccgaaccggtttcgtagggtaaccgaccgtaacccgggagttaccccgtccggtaccccgtaggccttaccgttccgtacccccg

SEQ ID NO: 89349 - DNA, 814 bp, Homo sapiens
  misc_feature: GYAE6OF01E2XX9.21.8.A08.1.454.CMB.1.raw
tcagtcgtcgctcgcacgaccggtgctcgatttagcatactctacagggggctgtgggctcaggaggcagagctctggaatctcaccatggcctggacccctctcctgcctccccctcctcactttctgcacagtctctgacggccttcctatgacgctagacacacgccctacccgtcggtgtccaggtccgtaccccgaggaaccgaaaaccggccgaaggtactccaaccgtgtccgtcttagggactactttcaagtttacgaaaccgaaaaagtaatttaacttaaccgttttggtttcgggttacccaaggtaccgtaaggtaacgttacccgaacgggaccctaaccggggtcccccttaggtaacgttccgggtaactaacgttcccgaagttacgggaccggaccgtaacgggtaccgaaccgggtaacctaaccggtcccgggtaacttccccgttagggaaacgtaacgttcgttacctccggttactaccccgtacgtaacggccttaacccggggaagggaacccttaacgggtcccgggtaccctaacccgtttaggaacccttaacgttacgacgggtccggggacccggtagggtaccggacgtaagtacggaacgtacgtacgtaacttacgttaacgttcggtaccgactaaccgaacgacgtaacgtaggtcgtacgtaggtacggacgggtttaacgtccggggtacggtacggacgtaacgtaccggtaccgttccgttagggctacgacccggagacccgtaccgtccccgtacggtcctcgcccgttcccg

SEQ ID NO: 89350 - DNA, 636 bp, Homo sapiens
  misc_feature: GYAE6OF01BN0I6.21.8.A08.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccacccgtcggtgtcagtcgtccccaggacaaacggccaggactcacctgctctggagattcattgaccaaaagatatacttgttggttccagcagaagtcaggccaggcccctgtactggtcatccatgacggccagtcgacgaccacgtccgggactcccgtgagngtacttctctcgcctccgagtcctcgagggtacaggtcggacctaccgttgactacgtacgacgggtcgggcccgtagggtacggtacgagtaggaacgtcgtacgtacgttactagtttacgtaccgaccgaacgacgtacgagtaggtggtacgtacggttacggtagggggttacgttacggggacgggaacgggtaccgtaacggttacggacccggttccgttacgggttaccacccggtacccgaacgggtcccgtcccggtaccccccgtacggtacccgtaccgttccgttaccccg

SEQ ID NO: 89351 - DNA, 635 bp, Homo sapiens
  misc_feature: GYAE6OF01BVUK1.21.8.A08.1.454.CMB.1.raw
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
  modified_base (357)..(357): a, c, t, g, unknown or other
  misc_feature (357)..(357): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctctactttctgcacatctctgaggcctcctatgagctgacacacgcccaccctcggtntcagtcgcccaggacaacgccaggatcacctgctcgnggagattcattcgaaccaaaagtatatacttggttgttccagcagaagtcaggccacggcccctgtactcggtacatccatcggacggccgagaccgaccgaccaccgtccggactcccgtagacgtagtacttcgtaccncgtccctcagtccctacggacggacacgggtcgaccctacccttgaacgttagtccgacgggtacgggcccgtagggtcggacgaagtacggaacgccgtaagtacctaagttcgtttacggtacctaccgactagacgtagtagtggtacgtgtacggttacgggtacggtcggacgggtacgggacgtaaggttccggtaacccggttccgttggaccgtaccgcccgtaaccggtcgtccccgtccccgtcggtcccttcccgttcccgttcccg

SEQ ID NO: 89352 - DNA, 622 bp, Homo sapiens
  misc_feature: GYAE6OF01B3OJD.21.8.A08.1.454.CMB.1.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacggcctcctatgacgctgacacgagcccaccctggtgtcagtcgtccccgaggacaacggccaggatccacctgctcgnggagtacttcattgaaccaaaagatnttacttgttcgtcagcagaacgtcgacgccgacggtcccctgtaccgtggtacactacagtcggacgccgtagtccgaccacgtaccgtccggactcccgtagagtactacttcgtcgtctaccctccgagtccgtacggaacggtaccgtacgggtaccgtccctacccgtttagactacgtcggacgggtccggggacctaggggtcgaacggtagtaacggaacgtcgtacgtacttacgttagtttaccgaccgctacgagacgtagtacgtgtacctaggtcggagggttcgtcggagggacgtacgtagttcggaccgttcgtagccgcgaccgtaggccctccggtaccctgtcctcgtccgtcccg

SEQ ID NO: 89353 - DNA, 752 bp, Homo sapiens
  misc_feature: GYAE6OF01BWWRW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctctcactttctgcacagtctctgaggcctcctatgagctgacacagcccaccctggtgtcagtccgtcccgaggaccaaacggccaaggtactccaccgtgctcgtggagtacttcatgaccaaaagaattatacgtttgttgttccagcaagagtcgaggccacggcccctgtacctggtcatccagtgacggcctaggtccgacgaccacgttcccgggacttcccgaggagtacgtattcctccgtcaccccttccgagtccgtacggacggacgacggtccgggtaccctacccgtttgaccgttagttccggacggggttacggggaccccgtaaggggtacgggtaacgtacggttaaggaacggtacgttacgtaaccgttttaacgtaagttttacccggttaaccgtaccgaacccgtaagaaccgtaggttacgggttacggtacgtaacgttcgggtaacgggggtttacgtcgggggaaccgggtaaccggggtaccgtaacgggtttaccggtacccggttttacccgggttacgggtacccgaaccgggtaaccccgacgggttacccgtcccggtaccccccggtcgggttacccttacccggttcccgttccccccggg

SEQ ID NO: 89354 - DNA, 615 bp, Homo sapiens
  misc_feature: GYAE6OF01D20YJ.21.8.A08.1.454.CMB.1.raw
  modified_base (263)..(263): a, c, t, g, unknown or other
  misc_feature (263)..(263): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
tcagtcgtcgctcgcacgaccggtgctcgatttagcatactctacagggggctgtgggctcaggaggcagagctctgggaatctcaccatggcctggaccccctctcctgcctccccctcctcactttctgccacagtctctgacggcctcctatgagctgacacagccaccctcggtgtcagtgtccccaggacaaacggccaggactcacctgctctggatattcatgaccaaaaagatatacgtgttggtcagcagactnacggcaggcccctgtactcggtcatccatgagccagtcgacgacnccgtcgggatccctganagacttntcncgctacngctcgaggcnggtcgacctacttgactatcgagtcgggccagggtcgggacagtgaacgctcgtaaacgttactagttcgttacgcccgaaccgtacgaacgagttaaggtacggttactacggtaacggttacggggggttaagttccggggacgggtaacggggaccgtaaacgggtttaccggtacccggttccggttttaggcccgttaaacggaccccgtaaagggaccgttccgaccccgtacgtccgggttcctacccgttcccgg

SEQ ID NO: 89355 - DNA, 721 bp, Homo sapiens
  misc_feature: GYAE6OF01C47NW.21.8.A08.1.454.CMB.1.raw
  modified_base (133)..(133): a, c, t, g, unknown or other
  misc_feature (133)..(133): n is a, c, g, or t
  modified_base (171)..(171): a, c, t, g, unknown or other
  misc_feature (171)..(171): n is a, c, g, or t
  modified_base (655)..(655): a, c, t, g, unknown or other
  misc_feature (655)..(655): n is a, c, g, or t
  modified_base (684)..(684): a, c, t, g, unknown or other
  misc_feature (684)..(684): n is a, c, g, or t
tcagtcgtcgctcgcacgaccggtgctcgatttagcatactctacagggggctgtgggctcaggaggcagagctctgggaatctcaccatggcctggacccctctcctcgcctcccccctcctcaccttttcngcacagtctctgacggcctcctagtgacgctacgaacnccgacgtacccacccgtggttcgtcacgttccggaccccaaggaaccgaaccggccacggactcccgaccgcgtccttcgacgacacggtacgtacgggaacttaccggaacccgtaaaaaggtaattaggtacgtttaacgttttaaccggtacggttaaaacccaaacggaaacggttaacccgaccggaccggaaccgttacccggtcccgttaggtacgtttaagagtaaacttaagtaacgtaaacgacgacgttaggaacgcccggacctaggactacgaccttccgaggacgtacgtaccttcgtcgcgtaacctcgacgtcgaacgtaggacagccgtacgtcgtacttacgactagtacgtagtaacgacgtacgagacgaggacgaggacgtgacgttaagtattacgaccgtaagaccgtaaggtcaggtaatacggattaccgtgttacggttcgggttacgcggggtaacncggaacgtatcccggtacgtaccggtacnggtaaccacggtacccgagggtccctcccggtacccg

SEQ ID NO: 89356 - DNA, 731 bp, Homo sapiens
  misc_feature: GYAE6OF01BBNDM.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctggacgcctcctatgacgctgacacacgccctacccgtgtgtccagtcgtccccaggacctaaacggccgaggactacacctgctcgtggagtacttcattacgaccaaaagtatatacgttgttgtccagctaagaagtccgaacggtccgaccggtccccgttagtaccgtcggtacctactccgagttcggaccggtcccgtagtaccggaccgaccgtacccggtccgggtacctcccggaggtaccgagttaccttcgtacctcgtacccctcgacgtcgtacggacgggtaccgtacgtccggtaccctacgtttcgaaccgtttacgtacggtacgggtaccgggtaccccgtagggtccgggtaacgtacggtacgtaacggtccgttaacggtacctttaacgtacgtttaacggttaccgaccgtaacccgtaagaccgttagacggttcggtacgtaggtacggtaggggtacgttaccgggacggtacggtaccgtacggtacgtacccggttacggttcgaccggtacgaccccgtacggcccgtcccgtaccccgtcggtccctccgtcccgttccccg

SEQ ID NO: 89357 - DNA, 746 bp, Homo sapiens
  misc_feature: GYAE6OF01BIHH0.21.8.A08.1.454.CMB.1.raw
  modified_base (621)..(621): a, c, t, g, unknown or other
  misc_feature (621)..(621): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcgttgggttttcctccttgcttacttttaaggaggtgtccagtgtcaggcgcaacgtggtggagtcggtgggggagctagtcggtccaggccgtgggacggtccctgacgtcctcctccgtgtcgcagtcgtcgtggtattccgtagttacgtcggtccttccgtttcgcctagtcgacctacggttccgggcccgccggacggtccgtaccggacgggacggtaacgggggtccgtggggtagggttacggggtcggtacgtagtttacgtcgttagggttagtaggtaaggttacgggaaggttggaaggtaagttaacgtttatttaacgttacggaacggttaccgtacgggtaacgggaacgggtcccttattacccgactaccttcaacccggaagacgtaaacctaacggtaccaaccctaaacgtaaccacttaagttcgttaaacttccgtaactaaacggtcggtacccgngtaggacgccggtacccgagaacccgtgtaccttagtacgttacttcggtagttacgtcgtttcggtttagaacgggttcgggtaaccgggaccccggaacggttacccggttcgggtaaccccg

SEQ ID NO: 89358 - DNA, 702 bp, Homo sapiens
  misc_feature: GYAE6OF01BGNCV.21.8.A08.1.454.CMB.1.raw
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttccctccttgcttcttttaagaggtgtccagtgtcaggcgcaacgtggtggagtcgtggggggagcagtcggtccagccgtggggacgtccctgacgcctctcctgtcgcagcgtcgtggtactcgtagtactccgggtcctttccgtttgccctagtcggtccgaccggttccggggtccccgaccgtacgggtccctaccccggtaaggggaccggaacggggggtccgtagggggtaggtggggggttcggaccgtaatttcgtcgtgggtatggtaagtaggggaagtggaggtacgtattacttatgacggttctccgggtaggaaccgggcctacgttccgacctatccgtcccaaggacaacgtacgacgaacccaaacaacctctaacgttcgttacttaccttaacgaactcgggacccgtcgagacgacggaccggaagccgacggtcttaggtcgttaacggtactcgggttaacggtagttcgttacgggccggttaaggtaccggggacccggtaaaccgggtcccgttcgggtaccccg

SEQ ID NO: 89359 - DNA, 768 bp, Homo sapiens
  misc_feature: GYAE6OF01D18Q7.21.8.A08.1.454.CMB.1.raw
  modified_base (129)..(129): a, c, t, g, unknown or other
  misc_feature (129)..(129): n is a, c, g, or t
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgaggcctcctatgagctgacacacgccacccgtggtntcagtcgtcccagacaacggcagtctcactgctcgtggatattactatacgaacctaaaagtaattactacgttggttcgttacgagacaagaacgtccgaacggccgaacggtcccctagttaccgcggtactaacgtcagtacggacggccgtacggtaccggaaccgaccgtaacggtcccgggaactccccgtaaggagtaacgtactttccgtaccttcggtcccctacgacgtaccgtacggaagggacctcgggtacccggtaccctaaccgttacaacgttaccgtacggtaaccggggtccggggtacccgtaagggggtaccggaaccgaggtaccggtaaacgtccgttacgaccgttttaaacgtacgttttaaccgggtacctaccgaacggtaacgacgttaaacggggttagtacggttacgtaacggttacggggtaagggggtttctaccgggggacgggtaaacggtaacggtacgttcggttaacccgggtaccgttggacccgtacgggacccgttacggcccgttacccccgaccccggttaggtcctaccccggtttccttaccccggg

SEQ ID NO: 89360 - DNA, 931 bp, Homo sapiens
  misc_feature: GYAE6OF01C840P.21.8.A08.1.454.CMB.1.raw
  modified_base (129)..(129): a, c, t, g, unknown or other
  misc_feature (129)..(129): n is a, c, g, or t
  modified_base (319)..(319): a, c, t, g, unknown or other
  misc_feature (319)..(319): n is a, c, g, or t
tcagtcgtcgctcgcacgaccggtgctcgatttagcatactctacagggggctgtgggctcaggaggcagagctctgggaatctcaccatggcctcggacccctctcctgcctcccctcctcactttcngcacagtctcgtgacggtcctctagtgagctagaccacacgccctaccgtcggtcgtacgtaggttccgacccgaacggaaccgaaaccggcgacggtactaccgaccgtcgactcggtaggactattacgatacgaacaaaagtacttattacgttggttccgtaccagtcgaagacgtcgacggaccncggtcctagtcgttgaccacgtacagtcggaccgaccgttacgaccgaactaccggtaccgttccgggacttaccggaggtaacgacgtttcctccgtacgtaccgtacccgtcgaagtttcccggaaacgggtaacgggaacctttccggggaccgttaaacccccgtttagtttaaccggaccgttaagtaccggggtaccggggtaacccggggtaccggtaaggggtaaccggttaaacggtacgggttaagggaacccggtttacgtaaacggttttaacccggttaagttttaaccggggttttaccgaaccccgtaaaccgggtaaacgtacgggtaaacccggtttaagggtaacccggggttacggttaaccgggttaacggggtttaaccgggggggtaaggttttaccggggaccggggggaaaccgggtaaccgggttttaaaaccggtccgggggttttaaccccgggtccgggtttaacgggtcccggtaaacccggggtacccgaaccccggggttaaccggtccccggtttaaccccccgggtcccgtttaaaaccggtccccggttaaccgtttcccccggggttttaccccccc

SEQ ID NO: 89361 - DNA, 989 bp, Homo sapiens
  misc_feature: GYAE6OF01CJ5ZY.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctcgccctccccctcctctactttctgcacagtctcgtgacggcctcctatgacgctagacacacgccctacccgtcggtcgtcgacggtccgtaccccgaaggaaccgaaaccggccgaaggtactacctaccgtcgtccgttcgtagggtactattactaagttacgaaaccaaaaagtaattacttacgtttggttacggttccgaagacgaagtaacgtcgaaccgggacccgtaccggtccccgttaggttaccgttacggtacctaaccgtaccgtagtacgggaaccggaccgtaacggacccggaaccgaacccgtaaccgggtcccgggtacctcccgtaggaacgtacgttaccttccgtccgtaccgtccctaaccgacggtccgtacgggaacggtacgtacgggtacccggtacccttaaccgttacgtaacgttacggtccggtaacggggtcccggggtacccgtaggggacggtaacggtaagtacgggtaacgtccgttaacgtaaccgtttaacgtttaaccgggtttaaccgtaccgtaacccgaaccggtaaacggtacggttacgggtttaacggggttaccgttaaacggttacggggttaaaccggggggttacggggttaaacccgggttcggggggaaaacccgggttaccgggggtaaacccgggtttaaacgggttttccccggggttaaccccgggttttaccgggttaaccggggtaccccggtaaacccccggggtaaccccggtaaccccggggtttcccccccgggaaccccccggttttacccccccggggttaccgggtttaacccccgttttaacccggttcccccccgggttttcccccccccggg

SEQ ID NO: 89362 - DNA, 667 bp, Homo sapiens
  misc_feature: GYAE6OF01BKRB6.21.8.A08.1.454.CMB.1.raw
  modified_base (103)..(103): a, c, t, g, unknown or other
  misc_feature (103)..(103): n is a, c, g, or t
  modified_base (119)..(119): a, c, t, g, unknown or other
  misc_feature (119)..(119): n is a, c, g, or t
  modified_base (127)..(127): a, c, t, g, unknown or other
  misc_feature (127)..(127): n is a, c, g, or t
  modified_base (154)..(154): a, c, t, g, unknown or other
  misc_feature (154)..(154): n is a, c, g, or t
  modified_base (187)..(187): a, c, t, g, unknown or other
  misc_feature (187)..(187): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (643)..(643): a, c, t, g, unknown or other
  misc_feature (643)..(643): n is a, c, g, or t
tcagtcgtcgctcgcacgaccggtgctcgatttagcatactctacagggggctgtgggctcaggaggcagagctctggaatctcaccatggcctggacccctntcctgcctcccctctnacttttcngcacagtctcgtgagcctctatggacnctagacactacgcctaccgtggtatcagttccncccgagaacaacggcaggactccgacctgcttcgnggactcttacagtcaactaaaagtnttagtcttaggttcgttaccgatcgaagtaacgtcacggaccacggtaccctagtacgtggtctaacgtcctagtacggacgtaccgtagacgacgtaacctacgttaccggtaactccgagtaacgtacgtactcgtctacggccttacgacgtctacggaacgtacgtacggtcctacgtacgttgaacgttacgtacgtacgggtaccggtacggtacggtacggacggtaacgtaacgacgtaacgcgttaaccgttaagttccgttactaccgacgtacgagacgtaagtcgtacggacgtacgtaggtaggtacgtccggtaaggacgtaacgtagtaccgtacggtacgttaggtccgaacgtaccggtaacgtccctccgtacccggngtttaccaccggtcccttacccgg

SEQ ID NO: 89363 - DNA, 587 bp, Homo sapiens
  misc_feature: GYAE6OF01A5OF0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggatattcattgaccaaaagatatacttgttggttccagcagaagtcaggccaggcccctgtactggtcatccatgacgccaggtcgacgacacgtccgggactcccgtgagacgtattcctctcgccctcagcctcgaggactaggtcggcctaccgttgactacgtcgaggtcgggaccctagggtcgacgtagtgaacgctagacttactagttcgtacgctacagactaggtaagtcggtacgtagtaccgggtagggttacgtccgggacgggtaacggaccgtaggttccggtaccggttccgttacgggcacggcccgtaaggcccgtacggaccccccgttggtacctccgtccggttcccc

SEQ ID NO: 89364 - DNA, 850 bp, Homo sapiens
  misc_feature: GYAE6OF01A4S92.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcactgtctctgagcctcctatgagctgacacagtcccacccgtcggtgtcaggtcgtccccaggacaaacggccaggactcacctgctcgtgggatattcattcgacctaaaagaattataacgttgttcggtccagtcaagaaggtctacggccacgggcccctgtacgtcgtcacgtccattcggaggccaggtcgaacgtcaccgtccgggaactcccgtagaggactacgttcctcgtacggtccctacccgtaggtccctacgggaacgggtacacggtccggaccttaacccttggaacctttaacgtccgtacgggtacccgggggtaccccgtaagggtacggggtaaaccggacgttaacgggtaaaccgggtaccttaacgggtaacccgttttaaaccgggttaacgtttttaacggggttaaccccggtaacccgaacccggtaacgggttaaacgttaacgggttaacggggttacccgtaacgggtaacgggttaaccggggttaacgggggggtttaaacggtttccgggggaaacccgggggttaaccggggtaaacccgggttaaacggggtttacccgggtaaacccgggttttcccggttacgggttaccccggaacccgggtaccccggtaaccggggtaccccgtaaccccggtccccccggttaaggtaccccttaaccggttccccggttaaccccgg

SEQ ID NO: 89365 - DNA, 691 bp, Homo sapiens
  misc_feature: GYAE6OF01ED3AT.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtntcagtcgtccccgaggaaccaaaccggccaggactcacctgctcgtggatattcattcgaaccaaaagtaattattactttggttcggttaccagacaaggtaacgtcgacggccacggtcccctgttactggtcatccagtcggacggccacggtacgacgaccaccgtccgggactcccgtaggagtacgtacgttcctcgtcgccctaccgacgtcctacgggacggacgtacggtccggaccctaccgttacggaacttacgtacggtacgggtaccggggccggtagggtacggacgtaaggtacgacggtactacgtacttaacgttcgtttacgtaccgaccacgagaacgtacggttaggtcgttacgtaggttacgggtaggggttacggtcggggaacggacgggtactaacgggttccggtacccgttcggtacggtaccgacccggccgtaacggtcccgtcccgggcccccgttacggtccctcccgttccgttcccccg

SEQ ID NO: 89366 - DNA, 748 bp, Homo sapiens
  misc_feature: GYAE6OF01AV68R.21.8.A08.1.454.CMB.1.raw
  modified_base (135)..(135): a, c, t, g, unknown or other
  misc_feature (135)..(135): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (274)..(274): a, c, t, g, unknown or other
  misc_feature (274)..(274): n is a, c, g, or t
tcagtcgtcgctcgcacgaccggtgctcgatttagcatactctacagggggctgtgggctcaggaggcagagctctgggaatcctcaccatggcctggacccctctcctgcctccccctcctcactttctgcacngtctctgacggccctcctatgagctgacacacgcccaccctcggtntcngtcgcccaggaccaaacggccaggtactccgacctgctcgtaggatattcattgaaccaaaagattatacttgtcggtcagtcagacgtnacggccacgccctgtactggcatccgatggcgaccaggtcgacgacaccgtccgggaactcccgtagacgtactacgtttcctcttccgaccctaccgacgtccgtaccggaggggtaacccaggttacccggaccccttaaccgtttacggactttaccgtcggtaacggggttcccggggacccggtaaagggtggtaaaccggtacgtaaggaaacgtcgtacgttaacttaacttaagttacgttaacaccgtaaccgaagtaaccgtagttacggtcgggttactacggtacgggacggggtttacggtaccggggtagggaaccgggtaaccttaacggttaccgggttaacccggttcccggtttaggttaaccggacccgggacccccgtaaacgggttccccgttaccccgggtccccccggttaccggtttaccccgtacccgtttcccccggtttaaccccgg

SEQ ID NO: 89367 - DNA, 990 bp, Homo sapiens
  misc_feature: GYAE6OF01CKMB7.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctactgacggtccttcctagtgacgctacgacacgacgccctacccgtcggtgtcgtacgttccgtccccgaggaaccgaaaccggccaagggacctaccaccgtgtccgttacgtaggaacttacttacctagttaacgaaaccgaaaaagttacttacgtttacgtttcggtttcgttaccgagtacgaacgtacggtaccgaccggtaccgtaacccgggtccccgttagtacgttcggactacctaccgaggtcgaccggccgtaacgtaccggaaccgtaccgtaccggtacccgggtacctacccggtaggtaacgtacgttacctttccgtacccgtccgttaccccgacccgtacggtacccgtaacgggtaacggggtacccgtaccggggtaacccgtaccccgtttaaccgttacgtaacccgtacggttaccgggtaccgggggtaccccggggtaaccccggttaagggggttaccggtaaacgggttccggtaaaggtaacccggttaaccggttaaccgttaaacccgttttaacggtttaacgttttaacccggtaaccccggtaaacccgtaaccggaaacgttaaccggtttaccgggttaacggggtttcgttaaacccgggttacgggttaacgggggttaacggggttaacccgggttacccggggaacggggtaaaccggggtaacccggttacggggtacccgtttaacccgggtccgggtttacgggtacccggtaaaccgggtaccccgggttaacggtccccccggttcccgggtacccccgttaccgggttaccccgttccccgtttccccggtttcccccccggg

SEQ ID NO: 89368 - DNA, 693 bp, Homo sapiens
  misc_feature: GYAE6OF01DG5K0.21.8.A08.1.454.CMB.1.raw
  modified_base (176)..(176): a, c, t, g, unknown or other
  misc_feature (176)..(176): n is a, c, g, or t
  modified_base (486)..(486): a, c, t, g, unknown or other
  misc_feature (486)..(486): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgagcctcctatgagctcgacccacgcccaccctggtntcagtcgtacccaggaccgaaacggcaggactcgacctgctcgtggatattcattacgaaccaaaagtatattcgtttgttacgtacagactagaagtcacggccacgtccctgtacgtgctactccagtcggacgtcagtacgaccgacaccgtccggactcccgagacgtagtacttcgtctcgccctacgacgtcctacggacggctacggtccgtaccctacgttcacgttcgacgtacgggtccgggacgtaagggtcggacgtagtacgaacgtctacgtaacttaacgttacttaccgtaacnccgaaccgtaagaccgtaaggttacgttcggtacgtacggtacgggtaggggttaacgttcggggaacggtacgggtaaacctacggttccgttaacccggttacggttcggacccgtaaccggtccccgtaacgggtccccgttaccccgggtccccgtttaacggacccgtttacccgttcccggttcccccgtttacccccccg

SEQ ID NO: 89369 - DNA, 853 bp, Homo sapiens
  misc_feature: GYAE6OF01DXVAS.21.8.A08.1.454.CMB.1.raw
tcagtcgtcgctcgcacgaccggtgctcgatttagcatactctacagggggctgtgggctcaggaggcagagctctgggaatctcaccagtggcctcggacccctctcctgccctcccccctctctactttctagccacagttcctctggacggccctacctagtggagcctagaacacgacacccacccgttcgggtcgtcgtacggtccgtaccccgaaggaacgaaccggccgaggactcccaccgtgcctagtaggtaatacttacgtagttaccgaaacctaaaaagtaagtttaacgttaacgtttggttttaccggttaccgaaggtaacctaaaggtaacgtacggaccggaccgtaccgggtccccgttaagtacgttcggtactactaccgtagtcggaacggaccgtaacggtaccgaaccggaccgttaccggtacccgggtacctccgaaggaggtacgtacttcctcgtcctccccgtacgaccgtaccgtacggacggtaccgtacgtcccgccttaacgtcgtaacctacgtaccggtcgggtaccgggaaccgggtagggacggtaaccggtagtaacggtaacgtacggtacgtaacttaccggttaacgttccggtaaccgtaccgaaccgtaacggtaactaagggttacgggttacgtaacgttagggacggggtttacggggttaccggtaccggggtacgggtaccgggtaacggttacgggttaccggtaccggtttacgggtacgttaccggaacccggtaccgtacccgggtcccgtcccccgtaccccggttaccgttcccgttaccccgttccggttaccccccg

SEQ ID NO: 89370 - DNA, 853 bp, Homo sapiens
  misc_feature: GYAE6OF01AXL5U.21.8.A08.1.454.CMB.1.raw
  modified_base (181)..(181): a, c, t, g, unknown or other
  misc_feature (181)..(181): n is a, c, g, or t
  modified_base (347)..(347): a, c, t, g, unknown or other
  misc_feature (347)..(347): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcactttctgcactgtctcgtgagtcctctatgagctagacacacgcccaccgtcggtntcgtacgtcgtacccgaggaacgaaacggccaggactccactcgctcgtaggatattctacgttacgaacctaaaagtattacgttacttggttacgttacgagacaaggtaacgtccgaacggaccgaccggtccccgttagtacgtcggtaacctacgtaccgngtacgggacgaccgtacggtaccggaaccgtaccgtacccgggtaccggaccttacccggttaggaacgtacgtttaccgtccgttacgtccgtacccgttaccgacgtccgtacggaacgggtaccgtacggttacccggcctaccggttagtaacccgtacgttaccgggtacggggttacccgggaacccggttagggggtacggaacggtaaggtaacggtaaccgtacgttaacgtacttaacgttacgtttaccgtacccgaactaaccgggggtataaccggtacgtttacgggtaccggtaacgttaaacgggtacggggtttaaccggggttaacgggttaccggggacgggttaacccggacggtttaaacggtcccggtaacccgggttttcggtaaccggtacccggtacccgtaaaccccgggagtttacccccggtaccgggttacccccgttacggttacccccgtacccgtttccggtttacccccccgg

SEQ ID NO: 89371 - DNA, 771 bp, Homo sapiens
  misc_feature: GYAE6OF01B4LDE.21.8.A08.1.454.CMB.1.raw
  modified_base (176)..(176): a, c, t, g, unknown or other
  misc_feature (176)..(176): n is a, c, g, or t
  modified_base (219)..(219): a, c, t, g, unknown or other
  misc_feature (219)..(219): n is a, c, g, or t
  modified_base (335)..(335): a, c, t, g, unknown or other
  misc_feature (335)..(335): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgacgcctcctatgagctagacacagtccaccgtcggtntcagtcgtcccgaggacaaacggcaggactcacctgcttacgnggagtactcagttcgaacctaaaagaattattaccgttgttcggttaccagtacaagtaagtcacggaccacggacccctgtaactggacatccagtggagccagtcgacgtaccncgtaccggactccaggactagtacttctcgtcgaccctcgacgtacgtacgaacggggaccttagacgggacccttacgttagaccgttacgtaaccggtgggtaccgggtacccggtacgggtacgggtaaccggtaggtaacggtaaacggtacttacggtaaccgtttaacgttaacgtttacggtaaccgtaccgaaccgtaaacgtaaccggtaaacggttacggttaacggttaacgtaacggttaaccgggtaacgggggtttaccggtacggggtaacgggtaaaccggggtaaaccgttaacgggttaacccggtacccgggtttaccggttacggtacccgtaaccgggacccggtaaacccggtcccggtaacccggtccccccgttaccgggtaaccgtccccggttccggtttaccccccggg

SEQ ID NO: 89372 - DNA, 811 bp, Homo sapiens
  misc_feature: GYAE6OF01DCNKO.21.8.A08.1.454.CMB.1.raw
  modified_base (130)..(130): a, c, t, g, unknown or other
  misc_feature (130)..(130): n is a, c, g, or t
  modified_base (285)..(285): a, c, t, g, unknown or other
  misc_feature (285)..(285): n is a, c, g, or t
  modified_base (341)..(341): a, c, t, g, unknown or other
  misc_feature (341)..(341): n is a, c, g, or t
  modified_base (435)..(435): a, c, t, g, unknown or other
  misc_feature (435)..(435): n is a, c, g, or t
tcagtcgtcgctcgcacgaccggtgctcgatttagcatactctacagggggctgtgggctcaggaggcagagctctgggaatctcaccatcggcctcggacccctctcctcgcctcccctctcactttcngcacagtctcgtgcgcctacctagtgacgtctacgacaccgcgacccgtaccgtcggtcgtacacgggttccacccgacggtaacaaacccgggcgacggtactccgacctcgcttacggaggtactacttcgtagtaacgaacaaaagtacttntacgtttggttacgcagacgtacgagtcgacgccgacgtcccttagcgtacgtacnggtaccaggtcgacgtacgtaccgacggaactaccgtacgtccgggtaccttccgaaggtacgtacttacgttaccggttccaccggttacccncgtaccggacggtaacggaaccgggtaacgtcccggttaaggtccccctaagtttaccggtaacccttagtacccggggtacgggtaccggggtaccggtacgggtaacgggaaacgtcggttaaacggaccgttacgggtaacttaccgttaaacgttcgttaacgttaacgacccgtaacgcgtaacgggtgtaacggttaggtaccgtaagggtttaccgggaggggttccgttacggggaaaccgggttttacggaacggtttacgggtaccggttaccggttacggttaccgggtcgtaacccgggcggtaaccggtcccttccccgggggcccttacggggaaccctttccgggtcccttaccccccggg

SEQ ID NO: 89373 - DNA, 746 bp, Homo sapiens
  misc_feature: GYAE6OF01A7XYR.21.8.A08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagcctctgacggcctcctatgagctagacacacgcccacccgtcggtntcgacgtccgtaccccgaaggaaccgaaaccggccgaaggtactacctaccgtgactcgtaggagtacttacgacgttacgaaccaaaaagtaatacttacgtttggttcggttaccagtacgaaggtaacgtccgacggacctaccggtccccttaggttaccgtggtaccacgtaccgaagtcggaacgaccgtacggtaccgaacgtaaccgtaccggtcccgggacttcccgaagaggacgttcttacctcgtccgtaccctaccgacgtccgtaacggacggtacgtacggtccgaccctaccgttagtaccttacgtaccggtacgggtccgggacccgtagggtacggacgtaagtaccggaagtcgtacgttactagtttactacggtaccacgtaaccgtaggtacgtagtacggtacgtacgtaggttacgggtaaggggtcgtacgggacgggaacggttacgtacggttaccggaccgtttcgtacggacgaccgaacccggtacgtcccgttccccggtaccccgtaggttaccctcccgttcgttccccccg

SEQ ID NO: 89374 - DNA, 854 bp, Homo sapiens
  misc_feature: GYAE6OF01DFN6K.21.8.A08.1.454.CMB.1.raw
tcagtcgtcgctcgcacgaccggtgctcgatttagcatactctacagggggctgtgggctcagggaggcagagctctgggaatctcaccatggcctggacccctctcctgcctccccctcctcactttctgcacagtctctgacggcctcctatgagctgacacacgcccaccgtggtgtcagttccgtaccccaggaaccgaaacggccaaggactccactggcctcgtggagtattctagttacgaaacaaaagtaattattacgttggtttacggttcccgaagtacgaaggtaacgtccgaacgggaccgtaccggccccttaggtacgtcggtctacgttccagtcgggtacgaccgtacggtaccggaaccgaccgtaaccggtcccgggtacctcccgtaacggtacgtacgttaactttcctccgtacggtacccctccgtaccgtccgttaaccggaagggacccgttaggtccggaaccctttaccgttacgtaaccttaacgggtccggtaacggggttcccgggggtaaccggtaacgggtacgggggaaacgttacggtaaacggtaacggtaccgttacgtacgtttaaaccgtttagggttacccgttaagacccgtaacggtaacgtaacgtacggtttacggtaggttcccgttaaggacggggtttaacgggttaggggttaccgggaccgggtaacgggttaaacccggtaacgggttccggtaccccgttttacgggtacccggtagaccccgggttaccgtaacccggggtccgtttccccccggtaccccgggtacccgttaacctccccgggttcccgtttaccccccggg

SEQ ID NO: 89375 - DNA, 703 bp, Homo sapiens
  misc_feature: GYAE6OF01E1I3Z.21.8.A08.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagcccaccctcggtctcagtcgtccccgggaanaaacggccaggactcacctgctcgtgganattcattcgaaccaaaaagtattattactttgttcggttccagcaagagtcaggccacggcccctgtactggtactatccagtgacggccaggtccgacgaccaccggtccggactcccgtaggacgagtacttcctcgtccgccctaccgacgtcctacggaacgggactacgggtccggacccttaaccgttacggaaccttacgtacggtacgggtccggggacccgtaggggtacggaacgtagtaggaacgtccgtacgaaccttacttaagttcgttaaccgcctaaaccgtaggaacgtaaggtacggttacggtacctaggttacggggtaacggggttacgttaccggggacgggtaaccgggtaaccgtaacggtttccggaacccgtttcggttacggaccgaccggtacccgaacggtcccgtccccgtaccccgttcggacctaccttcccgttcccgttacccccc

SEQ ID NO: 89376 - DNA, 833 bp, Homo sapiens
  misc_feature: GYAE6OF01B3EVD.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctccccctcctcactttctgcacagtctctgacggcctcctatgagctgacacagcccacccgtcggtgtcacgtcgtaccccgaggacaaaccggccaggactaccacctgcctacgtggagtcttacgattccgaaccgaaaaagtattaacgtttacgtttggttacggttaccaggtactaaggtaaacggtccgacgggtacccgaaccgggtaccccgttcggttaaccgttcgggttacctaacgtaccctaggttacggaccggtacccgtacggttaccggaacccgtaccgacccggttacccggggaaccttccccggtaagggtaaccggacgttaacgttttccgttacccgtcgtacccccgttacccgaggtcccgtaacggtacgggacgtacggtccgtaccctaccgtttagacttacgtaccggtacgggtccgggtaccgagggtcgggaacgtacgtaacgtaacgtcctaacgtaaccgttacttacgttacggtaccgaactacccgtaagaccgtagttaggtacgtacgtacggtagggtaacggggttactacggggaacgggacggtaaccggtacggtttccgtaccgttcccggttacggtaccggtaccgtacccggtccggtcccgtaccccgggtaccccccgtcggttaccccttaccgttccccgtttaaccccgtccccccgttaacccgg

SEQ ID NO: 89377 - DNA, 885 bp, Homo sapiens
  misc_feature: GYAE6OF01E2XKP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctcgcctccccctcctcactttctgcacagtctctgaggtcctctatgacgctgacacacgccctacccgtggtcgtactacggtccgtacccccgaagggaaccgaaaaccgggccgaacgggactaccgtacccgttgtaccgttcgtagggaagttactttaccgtaacgttacgaaaccgtaaaaagtaactttaacgtttaacgttttcggtttaccggtacaaggtacgtaacggaacgtacgtaacgggacccgaacccggtccccgttaggttaaccgttcggttaacctaccgttaccgaacgttaggggtacccgggtacccgtaacggtaacccggaacccgtaccgttaaccccgggttaccccgggtaacctccccggtaagggaacggtaaccgttccggtttacctaccggtccgtacccccgtaccgtaaccggtccggttaaccgggacggtaccgtacggttcccggtacccgtacttaccggtacttacgtcggacgggtaccggggccgtaggggtacgaacggtagtacggtacgtacgttacgtaacctttactacggtttacgtaccaccacggtaacgtacgtacggtaacgtcggtaccgtaaggttacggggttacgggttagggtaccgggtacggggtaagtaacccggtaacggttaccgggtaacccgttcggttaccgcgttaccggacccggtacggttccgtacccccgtccggtaccggtcccttcccggttccgttacccccgg

SEQ ID NO: 89378 - DNA, 633 bp, Homo sapiens
  misc_feature: GYAE6OF01CKLSC.21.8.A08.1.454.CMB.1.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacactacgccaccctggtgtcagtcgtcccaggaacaacggcaggatcactgctctgganattcattgaactaaaagattntacgttgttcgttcagcagagtcagaccaggtcccctgtactggcatccagtgacggcagtcgacgacacgtcggactcccgngagagtacttcnctacgccctacgacgctacggaggtacacggtacggaccctaccgtagaaccttataccggtaggttccgggcccgtaagggtacggaaccgtagtacggaacgtcggttccgaacttacgttagtttacgaccgacctaaccgaagacgtacgtaggtacgtacctagttaccggtaggggttagttccgggaagggtacggaccttaggtaccggtaccggttccgttaggaccctacggacccgaacgggtccctcccggaccccgtacggttcctaacccgttccgttacccccg

SEQ ID NO: 89379 - DNA, 861 bp, Homo sapiens
  misc_feature: GYAE6OF01B3KLX.21.8.A08.1.454.CMB.1.raw
  modified_base (138)..(138): a, c, t, g, unknown or other
  misc_feature (138)..(138): n is a, c, g, or t
tcagtcgtcgctcgcacgaccggtgctcgatttagcatactctacagggggctgtgggctcaggaggcagagctctgggaatctcaccatcggcctcggacccctctcctcgcctccccctcctctactttctgcacngtctctgacgtcctctatgacgctcgacacgacgccctaccgttcggtcgtcgacggttccgacccgaaggaaccgaaaaccgggccaaggtacttacccgaccgttcgtaccgttcgtagggtaacttacgtttactaacgttaaccggaaaacctaaaaaaggttaactttaacgtttaacgttttgggtttacggttaccagtacgtaaacggaacggtaccgaacgggcccgtacccggttacccttaggttaccgtcggtacctacgtaccgaaggtcggacggtaccaacggtaccggaacctaccgtccgggttacccggtaccttcccggtaaggaacggttacgttaaccttttcccgtaccgtacggttaccccgtacgtaaccggtccgtaaacgggacgggtacgtacgggcccgtacccttaacgtcgtacgttacgtacgggtacgggtacccggtaccggtagggtacggacgtacggtaacggacgttacgtacgttaacgttaacgttaccgttacgtaccgaacgtacgtacggtaacttcggtaacggtcgtacggtacggttacgggtaagggttacggtacgggacgggtaacggttaccgtacgggttaccggtaccgttcgggttacgacggtccgtacccggtaccgttcccggtacccgtacccgttacggtccttacccggttccgtttacccccgg

SEQ ID NO: 89380 - DNA, 728 bp, Homo sapiens
  misc_feature: GYAE6OF01C5GQ6.21.8.A08.1.454.CMB.1.raw
  modified_base (110)..(110): a, c, t, g, unknown or other
  misc_feature (110)..(110): n is a, c, g, or t
  modified_base (433)..(433): a, c, t, g, unknown or other
  misc_feature (433)..(433): n is a, c, g, or t
  modified_base (508)..(508): a, c, t, g, unknown or other
  misc_feature (508)..(508): n is a, c, g, or t
  modified_base (516)..(516): a, c, t, g, unknown or other
  misc_feature (516)..(516): n is a, c, g, or t
tcagtcgtcgctcgcacgaccggtgctcgatttagcatactctacgagggggtgggctcaggaggcagagctctgggaatctcaccatcggcctcggacccctctcctcncctcccctctctactttctgcactgtctctgacgcctactatgacgtctagacacgacgccctaccgtcggtcgtacgtacgtccgacccgaaggaaccgaaaacggccaaggtactaccgaccgttgccgtcgtagggattacttactagttaacgaaacaaaagtattaacttacgttggttacggtaccagacgtaagaacgtccgaacggccgaccggtccctagtacgtacggttcacgttacacggtcgaaccgggcctagtaccggaaccgaaccgccggtacggacttccggagatacgtacttctcgcgtaccngacgcacgtacggactcggtccgtacctacgtgaaccgttagcggtacgggtacggaccgaggtacgagtaaggngtaacgtntaacgtaagttacgttacgttacgtaccgaacgtacgacgtaagtacgtacggtcgtaattacgggtacggttaggggtaacggtcgggtaacggtaacggtaccgttagttaccggtaccgttacggtacggtaccgaaccggaccggtaccggtacccgtccgtccccgttaacggtaccttccggttccctaccggttccccttacccg

SEQ ID NO: 89381 - DNA, 808 bp, Homo sapiens
  misc_feature: GYAE6OF01CIY00.21.8.A08.1.454.CMB.1.raw
  modified_base (194)..(194): a, c, t, g, unknown or other
  misc_feature (194)..(194): n is a, c, g, or t
  modified_base (354)..(354): a, c, t, g, unknown or other
  misc_feature (354)..(354): n is a, c, g, or t
  modified_base (613)..(613): a, c, t, g, unknown or other
  misc_feature (613)..(613): n is a, c, g, or t
  modified_base (630)..(630): a, c, t, g, unknown or other
  misc_feature (630)..(630): n is a, c, g, or t
  modified_base (777)..(777): a, c, t, g, unknown or other
  misc_feature (777)..(777): n is a, c, g, or t
tcagtcgtcgctcgcacgaccggtgctcgatttagcatactctacgaggggggtgggctcgaggaggcagagctcgtgggaatctcaccatgggcctcggacccctctccgtcgcctcccctctctcgtttctgacacgtacgtctcgtggacggtcctctagtcgacgctagacacgcgccctaccgtgggtntccgacgtccgtacccgaggaaccgaacgtccgaaggcttcaccgtgtcctggtagactattacgagtacgaaacgaaaagtcttagttacggtttggtacgtaccaaggtcgaaggtaacgtcgacggaccgtccggtacccgttgtacgtcgactacnccgtagcggacgtccgaacggttccggaaccgttaccggtaccgtaccggggtacctttccggacggtaacggaagtttccgttccgtccggtacccgttaaccggtcccggtaaggtcccgtacgggtaaacgggaccgttaccggtccccgggtaaccctttacgtttaccgagttaaccggttccgggacgggtaaccggggacccgtaggggaccggtaacgtagacggtacgcgtacgtacgttacttacggtntaccgactacgtaacgngtaagttcggtcgtagtacggtacgggggtacggttcgggttacccgggaggggtaacccggtacgggttaacgtcccgggtaccgtttaccggttacgaccggtacccggtacgggtaccggtcccgtaccggtcccttaccggtnttacccgtccgttacccgttcccctccccgg

SEQ ID NO: 89382 - DNA, 873 bp, Homo sapiens
  misc_feature: GYAE6OF01CBHF0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtggtgtcacgtcgtccccaaggaaccgaaaccggccgaggactccaccctgcctcgtggagtacttcgattacgaaccgaaaaaagtacttacgttaacgtttggttaccggttaccaaggtcaaagggtacgtccgacggtacccgaacgggtcccccttaggttaaccgcggtacctacgtttccaacggttcggaaccggtcccgtaagggtacccggaaccgaaccgttaccggtcccggggtacctttcccgaggtaacggtaacgttccttcggtccgtcgtcccccagaccgtacgtaacggaccggggtaactaggtcccgtaccttaaccgtttagaacgtacgttccggacgggtaccgggggaccgtacgggtacggtaccggtaagtcggtaaacgtccgtaacgttaaccgttaacgttacgtttaccgtaacccgtacgaaccgtaacgtaacgtaacgggtaggttaccggtagtacgggttaacgggttaacgggggttaccgggtacggggtaaccgggtaacggggttaaccggtaaccgggttaccggttaacccgggtttcccggttaccgggtaccggtaacccggtaacccggtaaaccgggttccccggttaaccccgggttcccccggttaacccggttaccccgttacccggttacccggttttcccccccggg

SEQ ID NO: 89383 - DNA, 703 bp, Homo sapiens
  misc_feature: GYAE6OF01BTO5C.21.8.A08.1.454.CMB.1.raw
  modified_base (223)..(223): a, c, t, g, unknown or other
  misc_feature (223)..(223): n is a, c, g, or t
  modified_base (416)..(416): a, c, t, g, unknown or other
  misc_feature (416)..(416): n is a, c, g, or t
tcagtcgtcgctcgcacgaccggtgctcgatttagcatactctacagggggggagaggagcccagcactagaagtcggcggtgttccattcggtgatcagcactgaacacagaggactcaccatggaggtttgggctggacgtcgttcgggttttcctcttgcttctttaaggaggtgtccaggtgtccagggccactaacgtgggtggagtcggtagggggngctagtcggtccgaggtccgtggggacgtcccgtggacgtcccgttccgtccgtggtcgacgtcggtcgtcggtaggtattaccgtaggttacgtccggtctttccttcggacctagtcggacctacgggtaccggggtccccaccggtaacggtcccttaccgggaggaccggtaacgggggtcggtagggngggttcgggtacggacgttagttaccgttggtacggttagtagtaggtagggacgtggagtagtagttatttagcgtaacggtcgttacgacgggtacggtacctacgttacacgtactacgtacaagtacgactaacgtccacaaactacgtacgtacttacgtattacctaacgaacgtacgtaccgcgtacggagtacgaccggtagaccgacgtacgtataggttacgtagtgtacggtactcgttacgtcgtacggtcggaaccgtacggacgtcgtaccgg

SEQ ID NO: 89384 - DNA, 917 bp, Homo sapiens
  misc_feature: GYAE6OF01C7N5I.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggtgggctcaggaggcagagctctgggaatctcaccatggcctcggacccctctcctcgtcctccccctcctctactttcngcacagtctctcggacggtcccttcctagtgacgtactacgaaccaccgaccgtcccctacccggttgggtcgtaccgtacggttcccggtaccccggaagggaaaccgaaaccggccgaaggtacctcccgtaccgttcgtccgttcggtagggtaacttacttactacgttaaccgaaaccgtaaaaagtacgtttaacttacggttttggttaccgtaccgaagacgtaagtaacggtccgaccggtacccgtacccggtcccgtagttaccgtacggtctaacctaccgtaggtaccggaaccggccgtaccggaccggaaccgtacccgtaccgggtacccgtaccgttccggaagtacgtaacgtccgtttccgtccgtccgtacccctacgaccgtcggttacggaacggaaccgtcggtaccctaccgttacgtacgtaactacggtccgggtacggggtcccgggtaacggtacggtacgtacgacggtaacgacgttacgtacgttaaccgtttagttacggttaaccgacctaccggtaaccgtaggtagttaccgggttagtacgtacggttacggggtaacggggttcggggtaacggtacggggaacccgggttacggaaccgtttacgggtaccccggtaccgggtttacccgggtaaccggtaacccggacccgggttaacccgtcccgggttcccccgtacccccggttcccgggttacctcccccggtttaccccggttcccgggttccccttcccccggttacccccg

SEQ ID NO: 89385 - DNA, 670 bp, Homo sapiens
  misc_feature: GYAE6OF01BKABI.21.8.A08.1.454.CMB.1.raw
  modified_base (223)..(223): a, c, t, g, unknown or other
  misc_feature (223)..(223): n is a, c, g, or t
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
  modified_base (356)..(356): a, c, t, g, unknown or other
  misc_feature (356)..(356): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgcccaccctcggtgtcagtcgtccccaggacaaacggcaggactcacctgctcgtggatnttcattgaaccaaaagactattacgttgttgttccagtctagacgtnacggccacggcccctgtactggtcactcntgcgccagtccgacgtacaccgtcgggactcccgtagatcgtacttctactcgcccncgacgtctaccggagggacctacggttccgaccccgttaccgttaggaaccttagtccggagggtaccggggtccctaaggggtcgacgtagtacggacggtccttaggtaacgttattaggttaccgtaaccgcaaccgaacgtacttaaggttacggttacgggtactacggttaccggggtaaggggttccgtacggggaaccgggttacggaaccggtttaggtccggaacccgtttccggtaggcgtacccggacccgtacggtcccgtccccgcccccgttaggtccctaaccgtccgtttacccccg

SEQ ID NO: 89386 - DNA, 1040 bp, Homo sapiens
  misc_feature: GYAE6OF01A52KV.21.8.A08.1.454.CMB.1.raw
tcagtcgtcgctcgcacgaccggtgctcgatttagcatactctacagggggctgtgggctcaggaggcagagctctggaatctcaccatggcctggacccctctcctgcctcccctctcactttctgcacagtctctgacgcctcctatgagtctgaccactacgccctaccgtcggtgtacgacgtcgtaccccgaggaaccgaaacggccaggactccgaccgtgctcgtggtagtacttcgattacggaaccaaaaaggtacttaacgttacgttcgggtttacgttacccgaagtcgaaggtaacgttcgaccggactaaccggtcccctaggttacctgggtaccctatacccgtaaggtccgtaaccggccgtaacggttaccggaccgtaaaacccggttacccggttccgggtaaccttacccggtaagggttaacggacgtttaccgtttaaccgttccgtccgtacccctttaccggaacgtaccgggttacggaaccggggttaaactacccgggttacccgtacccgttaaaccgttaccggtagtttaaccggaacccggttaccgggggtaacccggggtacccgggtttaaacggggttacccgggtacgttaaacggggttaaaccggtaacccgggtttaaccggaaccgggttttaacccttaagggtttttaccccgtttaacgggtttaacccccggaaccccggttttaagggaaacccgtttaacccgggtaacggttaaccggggtttacccgtaccggtttaaccggggttaaccgggttaacggggggttaaccccgggtttcgggggaaaaccccgggggtttaccgggttaacccggtttaaaacccggggttccccgttaaaccccgggggtttttaccccggtttaaacggggacccccggttaaacggttaaccccccgggtaaccggtttacccccggttacccccgtacccccggggttttaccggtacccccctttaagggttcccccgttttaaccccccccgggg

SEQ ID NO: 89387 - DNA, 1052 bp, Homo sapiens
  misc_feature: GYAE6OF01EQGN3.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctctcactttctgcacagtctcgtgacgtccttcctatgagtctgaacacgacgtcccaccgttcggtgtcctacgttccgtacccccgaaaggaaccgtaaaaccgggccgaacggtacttcctaaccgtggtccttcggtacggaagttactttcgaacgtttaccggaaaacctaaaaaaggttaacctttaacgttacggtttttacggtttacggtttaacccgaagacgtaaaggtaaaacgtccggaaccggacccgtaaccgggttcccccgttacggttaccgtcgggtttaccaaccgttacggtaacggttcggggtaaccgtacccgaacggttacccggaacccggtaaccgttaacccgggttccccgggttacttaaccccggtaggaacgttaacgttccgtttacccgtaccggttaccgtccccctaaccgtaaacgggtcccggttaaaccggggaacgggtcccgttaacccggggtacccggttacccccgtttaaacggttaacccgtttaaccggtttaacccggttacgggggtaaccggggttccccgggggaacccgggtttaagggggtaacccgaaacgggttaccggtaacgggttaaaccgggtacgttaaccggttaaaccttttaaccgggtttaccgtttaaccgggaaacccgttacgtaaacccgggttaacgaaccgggtttaaggtttaccgggttaacgtaccgttaaagggggttaccggggtttaacggggttacccggggttaaccggggagggtaaacccgggttaaaccggtttcggtaccccgggttaccgtttcccggtaacggtaccccgtacccggaaccccggtacgggtttacccccgcccgggttaaccccgtcggttaccccgtccgttccccggtttcccccg

SEQ ID NO: 89388 - DNA, 816 bp, Homo sapiens
  misc_feature: GYAE6OF01CEQPR.21.8.A08.1.454.CMB.1.raw
  modified_base (649)..(649): a, c, t, g, unknown or other
  misc_feature (649)..(649): n is a, c, g, or t
tcagtcgtcgctcgcacgaccggtgctcgatttagcatactctacagggggctgtgggctcagggaggcagagctctgggaatctcaccatggcctggacccctctcctgcctcccccctcctctactttctgcacagtctctggacggcccttcctagtgacgtctacgaccaccacgcccctaacccgttcgggtcgtccgtaggttccgtacccccgaagggaaccgaaaaccgggcccgaaggtacctacccgaccctgtaccttcggtagggtaacgttactttacctagttaccgaaaaccgtaaaaagtaactttaacgtttaccggttttggtttaccggttacccaagacgtaaggtaaacggtccgaacggcccgtaccggtcccccgttggttaccgtcggtacctactccgtaggtcggaccggccgacggtaccggaaccgaccgtaccggtacccggactcccggtaggaacgtacgtcctttaccgtccttccgaccctaccgtacgtccgtaacggacggtactacgggtaccgtcccgttaacgttacgtacttacgccggtacggggtccgggtaccgagggtacgaacgtaggacgacgtacgttacgtaccttagttacgtacgtaccnccgtaacgagtacgtaaggttcggtacggtacgtagggtacgggtaggggttccggtacgggacgggtaaccgtacgtacggttccggtaccggtccgttacggacctacgggaccgtccgtccggtccccaccccggttagtaccccgtccgttcccggtcccccg

SEQ ID NO: 89389 - DNA, 890 bp, Homo sapiens
  misc_feature: GYAE6OF01B795H.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctagacacgacgcccacccgtcggtgttacacgttcgtacccccgaggaaccaaaccgggtccaaggacttccgaccgtgacctcgtaggtagtaactttccagttcgaaccgtaaaaaagtaacttagttaaccgtttggtttacggttacccgagaccgtaagtaaacggttccgaacggtaccctaacggggtcccccttaggttaccggtttacgggtaccttaacgttccccgtaaagttcggaaaccggtcccgttaaggtacccggaacgtaacccggacccgtttacccggggaaccctttccccggagtaaccggtaacggtaacgtttccgttccggtccgtacccccgtttaaccggagtaccccgttacggaaaacgggtaaacgggttccggaaaccccttaccgggtttacaaacccgttttacggaacccggtacggggttacccggggtacccggtaacggggttacggggaacccggtaggttaacggaacggtaaccgttacggtaacccgtttaataacgttttaccggtaaccgtaccgttaaccaacgggtaacctaacgggttcggtaacgttacgtacgtacgggttaacgggttaggttcgggacggtacggaaccgttaagtcgggttaccgtaccgttggtaccgtacggccgtaacgggtccctccgtacccccggttcgtaccctccgttcccgttcgtaccccccg

SEQ ID NO: 89390 - DNA, 688 bp, Homo sapiens
  misc_feature: GYAE6OF01CSUBO.21.8.A08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagcatactctacgagggggctgtgggctcaggaggcagagctctgggaatcgtctaccattggcctggacccctctcctgcctaccccctctcacgtttctgccacaggtctcgtgacggcctccgtatgagtctacgtacacgcgcccaccgtcggtgtcgaggtccgacccgaggaacaacggccgaggactccactgctcgtggatnttacattacgaactaaaagatattacgttgttcggtccagacagagtcgacggccgacgtccctagtacgtcgtcacgtccagtggacggcctacggtaccgacaccgtacgtccgggactcccgagacgagttactccgtctcgcctccagcctacggacggactacggtcgaccctagttacgactagtcgtacggggtccgggaccgtagggacggaacgtacggtaggaaccgcgttacgtaacttacgttacgttacgttacgacaaccgtagtacgtagtacggttacgtagtacggtagggtaacgggttcgtacgggacggtaacggaacgttcggtacgttaccggttaccggttagacccggaacggtaccccggaacggttcccgtacccccgttaccccggtgttacccgtcccgtttcccggttccccccgg

SEQ ID NO: 89391 - DNA, 825 bp, Homo sapiens
  misc_feature: GYAE6OF01B7C7Y.21.8.A08.1.454.CMB.1.raw
  modified_base (786)..(786): a, c, t, g, unknown or other
  misc_feature (786)..(786): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctcgcacagtctctgacgcctcctatgacgctcgacacacgcccaccgtggtcgtcgacgttcgtacccgaggaacaacggccaggactccacgtgtccttcgtaggacgtacttaccaagtttaccgaaacctaaaaaggttaacttaactttacgttttggtttacggttaccaggtaccaaggtaacggttcccgaacgggacccgtaccggttacccccgttaggttaccgttaccgggttacaaccgtttacccgtagtaccggaaccgggtccgtaacggttaccgaacccggtacccgtaaccgggttccccgggaactttaccccgtagggaaaccgtacgtttaccgtttccttccggaccgttaccccgtaccgtacgtacccggtaaccgggtaacggggtaaccgtacgggttcccgggtaacccctttaaccgggttaactacgtttaccgtccggtaaccggggtaccggggttacccggtacgggttaacgggaccgttaacgtaacggtaaacgtccggttaacgtaaccgtttaacgttacgtttccgtaacgaccgtaaccgagtaccgtaggtacgttacgtacgtacgtcggtacgggtacgttggacggacgtacgtacgtcggtacgtcgtggacncggtaccgacgtcgtccggtccctgtcctccgtcgtccc

SEQ ID NO: 89392 - DNA, 1047 bp, Homo sapiens
  misc_feature: GYAE6OF01AZ2TO.21.8.A08.1.454.CMB.1.raw
  modified_base (133)..(133): a, c, t, g, unknown or other
  misc_feature (133)..(133): n is a, c, g, or t
tcagtcgtcgctcgcacgaccggtgctcgatttagcatactctacagggggctgtgggctcaggaggcagagctctgggaatctcaccatggcctcggacccctctcctgccttcccccctcctcacttttcngccacagttctctgacggcctcctagtcgagctagacctacgacgacccctacccgtggtcgtacgacggttccgtaccccgaaggaacccaaaccgggtccaacggtacctcccgtacctacggcttccggtaggtaacgttacttacctaacgttaaccgaaaacctaaaaaggtaactttacgttttaaccgttttggtttaccgggtaccctaacgacgtaacggtaacggttcccggaaccggacccggtaccccgggttacccccgttaggtttaacccggttacgtacccgttaaccgtaccccggtaagttaccgggggaaaacccggttccccgtaaccggggtttaccccgaaaccggttaccccggaaccccgggtttacccggggtaacccctttacccgggtaagggaacgggttttaaacccttcgttttacccccgtttcgtacccccgggtacccccttaaccggacgggttaccccgttaaacggggaaaccggggttaaaccccgttcgggttaacccccggtacccggtttaacccgtttaaagggtaaccccccttgggttaccgggtaaacccgggggttcccggggtaaccccgggttaacgggggtaaccgggtaaccgggttaaacggtacggttaaaccggtacggttaacgttaaaccgtttaccggtttaacggtttacccgttaaccggtacccgaaccggtacgttaaacggttacggtttaacgggtaccgttaacgggtacggttaacgggtaagggttacggtacgggtaccgggtaacggtaaccgttacggtaccggttccgtacggttcggacgtcccggaccggtaccggcccgttacccggtccccgttccgacccgttaccgttccgttacccccg

SEQ ID NO: 89393 - DNA, 921 bp, Homo sapiens
  misc_feature: GYAE6OF01ECC3D.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggagtccctcctatgagctagacacacgccctaccgtcggtgtcacggtccgtaccccgaaggaaccgaaaccggccgtaaggaccttaccgtacccttgccgttacgtagggtaagttactttacgtaacgtttaaacgaaacccgtaaaaaaaaggttaatttaaaccgttttacgttttaacggggttttcggtttaacccgaaacgttaaccgaagggtaaaaccgttacccggaccgggacccgtaaacccggggtccccccttttaggttaaccggttacggttaccctaacgttacccgaaggtttaacggggaccggtaaccccgtacgggtaaccccggtaaaccgaaccgtaccccgggttaccccgggaacccttacccggtggtaaacggtaacgttacctttcccgtcgtaccctacccgtaccgacgtacccgtacgggaacgaacgccggtaccggacccttacgtacgtactacggtaccggtcggggtacccggacggtacgggtaacggtacgtaagttaacgacgtacggttactaacgttattaacgtttacgtaccgaccgaacgtacgtaacggtaacggttacggtacgtaggtaacggtacggggttacgggtacgggtaccgggaacgggtacggtaaaccggttacggtacccggtaccgtttccggtacggttaacccgcggtaacccgggaacgttccccggtacccccgttcgggtaccccgttacgttccccgttccccggttaccccccg

SEQ ID NO: 89394 - DNA, 756 bp, Homo sapiens
  misc_feature: GYAE6OF01ATEO9.21.8.A08.1.454.CMB.1.raw
  modified_base (294)..(294): a, c, t, g, unknown or other
  misc_feature (294)..(294): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccgaggacaaacggccaggactcacctgctcgtggagtcttcattcgaccaaaagatattacttgttcgtccagcagagtcgacggccgacgtccctgtacgtcgtacnctccgagtcggacggtaccacgtccgaacgaccgtaccgtacccggtactcccgtagaggtaacgtattccgtcgtccgtacccgtcgacgtcgtaccggtacgggtacgtaacgggtccggtaccctaccgttacgtacgttacgttcggacgggttccggggaccggtagggtacggaacggtacgtacggaacgtccgttaacgtaaccttaacgtttagttaaccggttaccgaccgtaccgaaggttaacgtagttacgggttcggtaccgtagggtacgggtagggggttacgttccggggaacggggttacgggtaaccgttaacgggtttacccgggtaccgtttacccggtttagggtacccgtaccgggtaaccccggtaacgggttccccggttaccccggtccccccggttacgggttccccttacccgggtttcccgttaccccccggg

SEQ ID NO: 89395 - DNA, 789 bp, Homo sapiens
  misc_feature: GYAE6OF01DG5JK.21.8.A08.1.454.CMB.1.raw
  modified_base (133)..(133): a, c, t, g, unknown or other
  misc_feature (133)..(133): n is a, c, g, or t
  modified_base (452)..(452): a, c, t, g, unknown or other
  misc_feature (452)..(452): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacngtctctgacgcctcctagtgagctgacacacgcccaccgtcggtctacagtccgtacccgaggaacaaaccggccaggtactccactcgactcgtagggactacttacagttacgaacctaaaataattacttacgttggttacgtacagaccgtaaggaacgtcgaacggcctacggtccccgtagttacgtcggtactacgtaccgtaagtcggtacggacctacggtaccggaaccgtacgtaccgtaccgggtactcccgaggagtaacgtcgttccgtctaccgtaccctcgacgttccgtacgacggtaacgnggttaccgaccttacgttacgacttacgtacggtacgggtaccgggacccgtagggtacgtaacgtagtacggtaacgtcgttaacgaacgtttaacgttacgtttaccggtaacgaaccgtaaccggtaagtaccggttaaaggttcgggttaacggttactacgggttacggggtaacgggtcgttaccggggaaccgggtaaacggtaccggtttaagggttaccggtaccccgggttttaggtacccggtaacggtacccgggtaaaccggtaccggttccgttccccggttacccgttgggttaccctaccggttcccggtttaccccccgg

SEQ ID NO: 89396 - DNA, 622 bp, Homo sapiens
  misc_feature: GYAE6OF01CE3Q0.21.8.A08.1.454.CMB.1.raw
  modified_base (165)..(165): a, c, t, g, unknown or other
  misc_feature (165)..(165): n is a, c, g, or t
  modified_base (180)..(180): a, c, t, g, unknown or other
  misc_feature (180)..(180): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (366)..(366): a, c, t, g, unknown or other
  misc_feature (366)..(366): n is a, c, g, or t
  modified_base (426)..(426): a, c, t, g, unknown or other
  misc_feature (426)..(426): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctagcacagtctctggacgcctactatgacgctgacacgnccctaccgttcggtntcgagttccgacccaggaacacggcaggacncactgctcgagagnttcattcgaacaaaagatattcttggttcgtcagcaaggtaancgaggccaggtccctgtacgtcgtanacgtcagtgacggacctcgacggaccacaccggtccgacttcggagaacgtaagtctttccgctcgtacccncgaggtcacgtacggaactgggttaccacctacgtcgagtcgtcgacgggtcggtaccgnggtacggacgtaagtcgaacgtcgagttactacgttagtcgttacacgacgtagacgtagtacggtgtacgtaacgtcgggagggttacgtcggggaaccggtagggtaaccgtacggttcgtacccggtcgttacggaccgtacggaccgtaacggcccgtaccgccccgttcggacccttcgtcccttaccccg

SEQ ID NO: 89397 - DNA, 831 bp, Homo sapiens
  misc_feature: GYAE6OF01EYJQH.21.8.A08.1.454.CMB.1.raw
  modified_base (233)..(233): a, c, t, g, unknown or other
  misc_feature (233)..(233): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacgcctctatgagctacgacacacgcccacccgttggtacgtcgaggtcgtaccccgaggaacgaaaccggccgaggactccactcgcctcngacagacgtcggactacgaacgaaagtaatacgttagtactttacgttacggaaccaaacgaggaacgtaccgaaccggtcccgaccggtacccgttgttaggtttacgtagtaaagtaacttaaaaggaaacaaccgtacggtaaggaccgggtaccgtccgaacgtaacggtaacgtaccgtacccgtaggacgtaacgtaccgtttccgtacggttaccgcccgttacccggtacgaacccggttaaccgggaacggtaacgtaactcgggtaccggttaccgtaaacgggttactaacggttacctaacggtacggtaaaccgggtaacttaacgggaaggtaccggaaacgggacgggtaaaccggtggttaacgtaaccgttaacgtttacgtttaaccgtaacgtaaccgaaagtaaagttaaccggaaaggttaacggtacggttaaggtaccgttaagggttaacggttggggttacgggttaccggggaagggaccgggtaaccggtaaggtccggtacggtaaccgttaccgggaccgtaccggggaaccctaaccggtacccggtccggtccccggttaaccccgg

SEQ ID NO: 89398 - DNA, 930 bp, Homo sapiens
  misc_feature: GYAE6OF01BR1XR.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctcgccctccccctcctctactttctgcacagtctcgtgacggccttacctatgacgtcgtacgaaccacgaccgccccgtacccgtcgggtcgtacgtacggtcccggtaccccgaaacggaaccgaaaccgggaccgaaggtacctacctaccgttcgtccgttacggtaggtaacgttacgtttacgtaacgttaaccggaaaaacctaaaaaagttaactttaaacgttttaacggttttacggttttaccgggttaaccgaacggttaaccggaaacggtaacggttaccggaaccgggtaaccccggtacccggttacccccgttaggttaaccggtccggtaacctaccgttaccgaacggttacgggacccggtacggtaaccggtaccggaaccggtacccggtacccgggttacccgggtccttaccggtagtaaccgggttacgttaccgtttccgtacccgttcccgtacccgtaaccggtacccggtacccgggtaaacgggtaccggggtaacggttacccgggtacccggttaaccccttaaccgttacggttaacgttccggtaaccgggggtacgggtacccggggaacggtcggggtaacgtaacggtaggtacggtaacgttacctacgttaacctttagttaccgttacgtaccgactaacgtaacgtacggtagtaggtcgtaaggttacggtggggtacggttcggtacgggacggtaacgtacgtacggttacgtacggttcgtacggcgaccggacgtaccgcccgttacccgcggtcctccctccgttccgtaccccg

SEQ ID NO: 89399 - DNA, 735 bp, Homo sapiens
  misc_feature: GYAE6OF01CF4XC.21.8.A08.1.454.CMB.1.raw
  modified_base (237)..(237): a, c, t, g, unknown or other
  misc_feature (237)..(237): n is a, c, g, or t
  modified_base (291)..(291): a, c, t, g, unknown or other
  misc_feature (291)..(291): n is a, c, g, or t
tcagtcgtcgctcgcacgaccggtgctcgatttagcatactctacagggggctgtgggctcaggaggcagagctctgggaatctcaccatggcctcggacccctctcctcgccctccccctcctctactttctcgcactacgtctcgtgacggcctcctatgacgtctagaccaccacgccctacccgtgtcgtcagtccgacccgagaaccgaacgcagactcactgctgtagatnttacgacgtacaacaaaacgtatattacgttgtttagtacaagacaaggtaacncgaccggccacggtccttagtaccgtagtacctaccgtctagacgtacggcgtaccggtacgaccgtacctaccggtccggtacctccgaaggaagttacgtacttttacccgcgtaccgtacccgtccacgtacccggtcggaaggtacgtaccgggtacgtacccttaaccgtgttaacgtcgtacggtaccgggtaccgggttaccggagggtacgggtaacgaacggtacgaacggtacgttacgaacgttacgtttaacgttactaccgaacgtaaccgaacgtacgtaaggttacgtacggtaacggtacgtacggtaacggggttcgggttacggacggggaacgttacggtaaccggttacgtcccggttgttaccggccctaagggaccccgtgttaccccgccgttaccccggctactcccgtcgtaaaccccg

SEQ ID NO: 89400 - DNA, 805 bp, Homo sapiens
  misc_feature: GYAE6OF01COR8F.21.8.A08.1.454.CMB.1.raw
  modified_base (570)..(570): a, c, t, g, unknown or other
  misc_feature (570)..(570): n is a, c, g, or t
tcagtcgtcgctcgcacgaccggtgctcgatttagcatactctacagggggggagaggagcccagcactagaagtcggcggtgttccattcggtgatcagcactgaacacagaggactcaccagtggagtttgggctgagtcgttgggttttccctccttgtcttacgttttaaaggaggttgtccgagtgtcgaggccgacgaacgtgggtcggaggtcggtaggggggagctaggtcggtccagccggtggggagtccctgacgtcctctccgtgtacgctaggtcctacgtggtacttcgagtcgttccggtccgttcctttcgcctagtccggtaccgtacggtcccggggtccccgacgtacggtccctaccgggaggaccggtaggggtcggtagggtacgggtggggtacgtaccgtaagttcgtcggtaggtaggtacggtaaggtaggaacggtggtaagtagtattagtacttacgaacggtcgtaccggtaggtaacggtccgtacgtactaccgacgttcgaacccgtaagtacgaacgactacgaacctaacaaccnctaactctaactactaacgacgtaccgtacgtaccgtagaccggtaccggaccggtaacggaccggttaaaccgtacggttaacgttaacggttacgttaacggttaccgttaacggggttcgttttaaccgggtttaccgggttaacccggggtttaacgggggtttaccccgggaaaacccggggttttaacccgggttaaacccccggttttcccggggttaaacccccggg

SEQ ID NO: 89401 - DNA, 941 bp, Homo sapiens
  misc_feature: GYAE6OF01DBAEO.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccaccctcggtntactaggttaccgtcccccgaggaaccaaaccgggccaacggactcccaacgttgccttcgtacggaatacttactacgttacgaaccgtaaaaagtaattactttaacgttttcggttaacggtttcccgaaagtccgtaaaggtaaaccgtccgtaaccgggaccctaaccggtcccccgttagttaccgtcggtaccaacttaccgagtcggaacggtccgtaacggtaccggaacggtacccgtacggttacccgggaacttccccggaggtaacggtacttaccttccgtttaccgccggtaccccttaccgaaggtccgttacgggaaccgggtaaccgtacggtacccgggaacccgtttaaacccgtttacgtaaacggttcgttaaccggtacgggggtacccgggtacccggttaaggggaccggtaaacggttacggtaacggtaaacgggcccttaacggttaaccttaaacccggttttaggttaacccgttaacccggaacgtaacccggaacgtaaggtaacggtttaccggtaacggttacgtaaggttaccgggggttaacgggggtttacccggtaggggggtaacccggggtaaaccggttacggttaaaaccgggtttcccgaacccgggttttacccgtttagggaacccgaccgggaacccccgggttactaccccgggttaccccttacccccgggttacgggttacccgtacccgttttccccgggttacccccccgg

SEQ ID NO: 89402 - DNA, 863 bp, Homo sapiens
  misc_feature: GYAE6OF01EVM31.21.8.A08.1.454.CMB.1.raw
tcagtcgtcgctcgcacgaccggtgctcgatttagcatactctacagggggctgtgggctcaggacggcagagctcgtgggaatctcaccatggcctcggacccctctcctcgacccttcccccctcctctactttcctgcacgagttctcgtaggacggtcccttcctagtgacgctacgaccacacgcccctacccgttcggtgtccagtccgtaccccgaaggaaccgaaaccgggtccaggactccaccgtgtcctcgtagggacttattcgtaattaccgaacctaaaagtaacttattaccgtttggtttcggttacccagtacctaagtacgtccgacggacccgccggtacccgttaggtaccgtggtacctacacgtagtacgggaccgccgtaacggaccaaccggtacctacccggtacccgggtacctcccgaggaacgtacgtaccttccgtacctccgtaccgtacccaggtacccgtccggggaaaccggtacgttacccggggaccttacccctaaccggtttagaccgtttacgtaccgggtacccgggtccgggtacccggtaagggttaccgggacgttaacgggtacggtaacgtaccgttacgttaaccgtttaaccgtttacggtttaccgtaccgacccgttaacccgaaggttaaccgttacggggttaaggttaccggtacggttaacggtagggggttaaccgggttacgggtaccgggggacgtaaccggggtaacttcggggtttaccgtacgttcggttaccgggactccggtaccccgtagtccccgtaccccggttcccgtaccgttccctacccggttcccgttcccccgg

SEQ ID NO: 89403 - DNA, 894 bp, Homo sapiens
  misc_feature: GYAE6OF01D5K9H.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctcgcctccccctctcactttctgacactagtctctgacggcctcctatgagtctagacacacgacccacccgttcggtgtaccacggtccggtacccccgaaggaaccgaaacggcccaaggaccttccgaaccttcggaccttcgtgggactactttactaattacgaaacctaaaaaggtaacttacgtttaacgtttgtttaccgggttccaacggtacgaaggtaaggttacccgaaacgggtccgtaaccggtacccctttaggtaaccgttcgggttactaacccggttaccgtagttacgggtaccgggacccgtaaagggttacccggaacccggtacccggttaaaacccgggttaccccggggtaccttaccccggttaaggggaacgtaacggtttaaccttttccgttaccggtccccggtacccttaccggaaacggtccggtaacgggtaacgggacgtacccgggtaccggtacccctttaacgttaacgggtaaccttaccgtacggtaacgggggttacccggggaccggtaacggggttacgggaccgtaagtaacgggtaacgtacgttagtaccgttaacttacgttacgtacgactacgtacgacgtagttacggtacgtcgttaacgtcgggttaaggggttacgtacggggacgggtaccgtaacggtacggttccggttacggttcccgttaggcgttaaccggcccgtaaccgggtccgtaaccccgtccccggttacggcccttccgttccttaccccggg

SEQ ID NO: 89404 - DNA, 1019 bp, Homo sapiens
  misc_feature: GYAE6OF01BSEST.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctcccccttcctctactttctgcacagttctctggaggcccttcctatcgagctagacacagccctacccgtggtgtacacgtcgtacccgaggaaccgaacggccaggtactccactcgctcgtaggtagtacttcaagttaccgaaccgaaaagtaattagtttacgtttggtttacggtccagtacgaagtaacgtaccgacggcccgtaccgggtcccttacggttaccgtcggtcctacgtaccctaggtccggaaccgggcccgtaacgttaccgggaacccgtaaccgtacccgggttacccgggaccttacccggtaggtaaacggtaccgtttacgtttcccttaccgtcccgtacccgtacccgtcgggtacctacgggtaaccgggtacctaacggttccggtaaccccttacggtttcggaacccttaaggtcccgggttaccgggggtaccggggaccccgggttaaggggtacccgggtaaacggtacgggttaaacgggttaacgtaccggttaaccgttaaaccccgtttaagtttacggttttacccggttaaacggtacccctaaacccggtaacgggttaaaccgttaacgggtttacggggtttaacccggttacggttaaccggggttaccgggggttaaacggggggggttttccgggttaaaccgggggtaccggggggttaaaccgggttaaacccggttaaccgggggtttttacccgggttaaccccggggtttacccggtttaccgggggttaacccggtaaccccggttaacccggggttaaaccccgggtcccccggttacccccggggtccccccgggttttaacgggaccccccgttttacccttccccggggtttacccgttcccccccggttccccccg

SEQ ID NO: 89405 - DNA, 735 bp, Homo sapiens
  misc_feature: GYAE6OF01D0O7E.21.8.A08.1.454.CMB.1.raw
  modified_base (111)..(111): a, c, t, g, unknown or other
  misc_feature (111)..(111): n is a, c, g, or t
  modified_base (136)..(136): a, c, t, g, unknown or other
  misc_feature (136)..(136): n is a, c, g, or t
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (225)..(225): a, c, t, g, unknown or other
  misc_feature (225)..(225): n is a, c, g, or t
tcagtcgtcgctcgcacgaccggtgctcgatttagcatactctacagggggggagaggagcccagcactagaagtcggcggtgtttccattcggtgatcagcactgaacanagagactcaccatggagtttgggcngagtcttggtttcctccttgcttcgtttaagnggtntccagtgtcaggcactacgtggtggaggtcgtgggggagcgtagtcggtaccncggtacgtcggggacggttcccgtaggtacgtcccttccgttccgttggtcggactacggtccggttctagggtaacttcggtaacgtcgttccggtactttccgttcggacctagtcgcctcggtccgggtcccgccgtcggtacctaccggaggtcggaacggggtctagggggtagttcggggacgttacgtaagtttacgtacggtagttacggtaggtacgttaggggtaagtggaagtaagttatttaattacgtccgtaagtccggtacggaaggtaccgggtacgtacgttaccaactacgtactacccgtaatacggaacacgtacgaaacccaacaaaccgtactaacgttacgttaacttacctaaacgtaccggtaccgaccgaccgtaggaacgtacgccggtaacgacgacgtaactgttacgtaacgttcgtatacgggtactcgtttaacgcgttacgggtaccggaccgtaccgggtaccgtcgggttaaccc

SEQ ID NO: 89406 - DNA, 734 bp, Homo sapiens
  misc_feature: GYAE6OF01EWDFR.21.8.A08.1.454.CMB.1.raw
  modified_base (131)..(131): a, c, t, g, unknown or other
  misc_feature (131)..(131): n is a, c, g, or t
  modified_base (167)..(167): a, c, t, g, unknown or other
  misc_feature (167)..(167): n is a, c, g, or t
  modified_base (371)..(371): a, c, t, g, unknown or other
  misc_feature (371)..(371): n is a, c, g, or t
tcagtcgtcgctcgcacgaccggtgctcgatttagcatactctacagggggctgtgggctcaggaggcagagctctgggaatcctcaccatggcctggacccctctcctgccctccccctcctcactttcngcacagtctctgacggcctcctatgacgctgacacncgcccacccgtcggtgtcagtcgtacccgagaccaacggccaggactcacctgctcgtaggatattcagttagaccaaaaagtatacttacttggttcgtacagtcaagaacgtcgacggccacggccctagtacgtggtacatccgagtcggacggtccaggtccgaacggactaccggtccggacctcgagaagtatcttcncgtacgcccgtacaggtctacggaggtacaggtccgtaccctacgttgaacctagtccggacgggtccggggaccgtaggggtacggacgtacgttaaggacgtactagtaacctttacgttacgttacggttaaccgacgtaaccggtaactaacggttaagtagggttaccgtagtacggttaacggggttacgggggttaccggttacggggaccgggtaagggtaacccgttaaagggttcccgggttaaacccgttcggtttaaccgggacgtaccggtaccccgggtaaacggtccccggttacccggttacccccggttaccggttaccccgtaccccggtttccgttacccccgg

SEQ ID NO: 89407 - DNA, 818 bp, Homo sapiens
  misc_feature: GYAE6OF01BBOPB.21.8.A08.1.454.CMB.1.raw
  modified_base (169)..(169): a, c, t, g, unknown or other
  misc_feature (169)..(169): n is a, c, g, or t
  modified_base (387)..(387): a, c, t, g, unknown or other
  misc_feature (387)..(387): n is a, c, g, or t
  modified_base (532)..(532): a, c, t, g, unknown or other
  misc_feature (532)..(532): n is a, c, g, or t
tcagtcgtcgctcgcacgaccggtgctcgatttagcatactctacagggggtgggctcagggaggcagagctctgggaatctcaccatggcctcggaccctctccgtcgccttccccctctacactttctgacactagtctcgtacggacgtcctccttagtagagccncgaaccgaactaccgcccaacccggttcgggtctacctacggtccgtacccgaacggaaccgaaacggcccgtaggtaactacctccgtggtccttacgtaggacggttacttaccgagttaccgaaaaccgttaaaagtattacgtttaccttgggttacgtaccgatacggaagtacggcgtacggacctacgggtcctaacggtcttggactacncgtagacgggaccgccgttaagccgaccggttaaccgaccggttaccggtaaacgttcccggtaagacgtaaggtcccgtttactcgtaaccccggctaccggagtccgaacgacggtacctcgggttaacgccttaggtaaccncgtttaaacgggcggtacgggtcgggtaccggtacggtaacggacgtacggtaaggtacgtaccgttacgtaccgtacgttaagtaccgttacgaccgttaacgacgaacggtacgttaggtccggttaacgtacggtacgggggtaacggttacggtcggggaacgggacttaaacgggtacggtccggtaccggttcggtacgttacggaaccgtaccggtacccggtcggtaccccggtaccccttcgggacttacccggttcgtcccccggttccgtccccg

SEQ ID NO: 89408 - DNA, 694 bp, Homo sapiens
  misc_feature: GYAE6OF01DAI7S.21.8.A08.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagcatactctacagggggctgtgggctcaggaggcagagctcgtgggaatctcaccagtggcctacggacccctctcctcgccctccccctctctactttcngcatagtctcgtggacgtccctactagtgacgtcacgacacgaccgccctaccggtggtctcgacggtccgacccgaaggaaccgaaaccggcgtaggtacctccgtacgtcgtacgtacggtaaggattactacgtaagtaaccgaaacgtaaaagtacttacgttacggttcggttacgtaccgagacgtaaaggtaccgtacgaccgtaccgaccggttcctagtacgtacgtcaacgtcgagtacggacgaccgtaggacgaccgtaccgacgttccggctacgaagtcgtactcttccgacgtcgacctgacgtcgacggaacgtgacgtccgaactcgtagtacgtagacggtcggacggtacggaggacgtagtagacgagtacgtctacgtattcgtagtaccgacaacgagtacgtgtacgtgtacgtacggtaggttacgggtcgaacgggtacggtaaggtaccggttacgtaccgtaccggttcgaccgtacgacccggtccgaccgtccctacccggtcctaaccgtcctcgtccccggttacccg

SEQ ID NO: 89409 - DNA, 737 bp, Homo sapiens
  misc_feature: GYAE6OF01E3QAY.21.8.A08.1.454.CMB.1.raw
tcagtcgtcgctcgcacgaccggtgctcgatttagcatactctacagggggtgggctcaggaggcagagctctgggaatctcaccatggcctggactcctctcctgcctccccctcctcactttctgcacagtctctgaggcctcctatgagctgacacagcccaccctcggtgtcagtcgtccccaggacaaacggccaggatcacctgctctggagtacttcattgaccaaaaagattatacttggttcgtccagcagaagtcaggccaggcccatgtactgtcactcatgaggccagtcgacgacacgtccgggatccctagagagtcttctctcgccctcacgctcgagggtacaggtcggcctaccgtttgaaccttacgttacgacgggttaccgggggaccccgaggggttcgggaaccggtaagtacgggaacgtaccgtaggtaaccgtaactttacgtttcggttaaccgacccaacccgtaaggaaccgtaggttaacggttacgggtaccgtaaggttaccgggtaacgggggggtttacgttacccggggtacggggaacggggtacccgttaaagggtttacccgggttaaccccggggtttcccgtttacgggggttaacccgaccggtaaccccgggtaaaccgggtacccggttacccccgggtacccccccggtttccccggggtttacctaccccgttccccggttttaccccccggg

SEQ ID NO: 89410 - DNA, 818 bp, Homo sapiens
  misc_feature: GYAE6OF01ESXEK.21.8.A08.1.454.CMB.1.raw
  modified_base (170)..(170): a, c, t, g, unknown or other
  misc_feature (170)..(170): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgcttcttttaagnggtgtccagtgtcaggcgacaacgtgggtggagtcgtgggggagcagtcggtccaggccgttaggggacgttccctggacgcccttccgtccgtggtcgacgacggtccgttcgtgggatttccgaaggttactccggtaccttcctttgccctagtcgacctacgttcgggtcccgaccgtaggtccttaccggacgggacgtaaggggggtccctagggggtaacggttgggggtcgtacgttaacgtttaacgttccggtagggttaacgttggtaagggttaggggtaaaggtcgggaacggtaaagtaatttaacgttttacgtaccgaacggttacccgttaccgggtaagggtaaaccgggtccgttaacgttacccgaaaccctacttcccgtaacccgaaaggtaacgtaaactaaccggtaccgaacccgaaaaccctaaacgtactaaccgttaggttaacttaacctaacggaaacttccgggaacccgtaccgtagaacggtaccggacggtaacggacgtaccggtacgttaagtagtttaacgttacgtacgggttaactcgggtttacgtttaggacccttagggggtacccggggtaacctaaccggggttacccgtcgggttaaccccgg

SEQ ID NO: 89411 - DNA, 759 bp, Homo sapiens
  misc_feature: GYAE6OF01CKK22.21.8.A08.1.454.CMB.1.raw
  modified_base (130)..(130): a, c, t, g, unknown or other
  misc_feature (130)..(130): n is a, c, g, or t
  modified_base (135)..(135): a, c, t, g, unknown or other
  misc_feature (135)..(135): n is a, c, g, or t
  modified_base (163)..(163): a, c, t, g, unknown or other
  misc_feature (163)..(163): n is a, c, g, or t
  modified_base (332)..(332): a, c, t, g, unknown or other
  misc_feature (332)..(332): n is a, c, g, or t
  modified_base (422)..(422): a, c, t, g, unknown or other
  misc_feature (422)..(422): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttcngcacngtctctgacggcctcctatgagctgacncacgccctacccgtcggtgtacacggtccgtaccccgaaggtaaccgaaacgggcccaggactccaccgtcgctcgtaggtagtactcagttacgaaacctaaaagtaattattacggttgttcgtacagtacgaggaactcgacgccgaccgtccgtattcgcgactntaccgagtcgaccggactaggtaccgaacgtaccgaccgtcgggaaccttcccgtaggaactacgttacgttcctacgtcgtccctaccnggtacctcggaaacggggttccgaaacgttccggaacccttaccgttagaaccgttacgtacggtacgggtaccggaccggtacggtacggacgtaacggtacgtaagaccgttagtaaccgttgttaaccgttacggttaaccgtaacgtaacccgaacgtaaggtaacggttaggtcgggtaaccgtggttacgggtagggttacgggtcggtaacggggtacggtaccggttaaacggtccggttaaccggtcggttacggtaccggtccggacccggtaacgtccggtcccggtaccccgtaccggttaccttccgtacccgtttacccccgg

SEQ ID NO: 89412 - DNA, 655 bp, Homo sapiens
  misc_feature: GYAE6OF01BOTU8.21.8.A08.1.454.CMB.1.raw
  modified_base (476)..(476): a, c, t, g, unknown or other
  misc_feature (476)..(476): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccctacccgtcggtgtcagtcgtacccgagacgaacggcaggatccactgcctgtaggatatcattcgaactaaagtatatacgttgttcgtaccagacgtaagacgtacacggcacggtccctagtactcggtacactccagtaggcgtccagtcgaacgacgaccgtccgggactcccgtagacggtatacttccgtcgtcgtccccgtcgacgtcccgtacggaccgggtacgtacgggtacgcccttacgtagttactagtccgtagggtaccgggaccggtagggtcgacggtagtacggaacgtntaccgtaacgttactagtttcgaccgactaccgaggtactaacggtacgggtactacggtagtagggtacggggtcggtacgggagggtaccggaacgttagggtcccgtacggttcggtcgacgaccggtcgtacgtacccgtcccggccccttacggcctacgttccgttacccccg

SEQ ID NO: 89413 - DNA, 933 bp, Homo sapiens
  misc_feature: GYAE6OF01EZLVQ.21.8.A08.1.454.CMB.1.raw
tcagtcgtcgctcgcacgaccggtgctcgatttagcatactctacagggggctgtgggctcaggaggcagagctctgggaatctcaccagtggcctcggacccctctcctcgcctccccctcctcactttctgcacagtctcgtgacggcctcctatgacgctagacacgacgccctacccgtcggtgtctacgtcgtccccgaggaaccaaaacggccgaggacttaccaccgtcgaccgttcgtagggacttagttaccgaagttaccgaaaccgtaaaaagtaaattacttacgtttagtttccggttaccacggacgtaacggtaacgtaccgacggaccgtaccggtaccccttacggttaccgtccgggtaacctacgtccgaagtacggtaccggtacccgtaacggtacccgaacggtaaccctaccggtacccgggtacctccccggtaagaacggtacgttaaccgtttcgtccggtaccgtaccccgttaccgaaacggtccgtaaaccgggacggggaacctaggggttccccgggtacccctaaacggtttacgtaacccgtttacgtaccggtacggggtacccgggggtaccccgtaagggggttacccggaaggttaaacgtaccggggaaagtccccgttaaggtaacccgtttaacgttaacgtttaccggttaacccgaacccgaacccgttaaggttaccgtaacggtttaacggtacggtaacgtacggtttaccggggttaaagggggttaacccgtacggggtaaccggggtaacggttaacccgtaacggggttaccggttacccggttacccgttaggggttaccacccccgggttaaccgaccgggttacccgtacccccggttaccccgggtccctttaacggtccccgtcccgtttaacccccgg

SEQ ID NO: 89414 - DNA, 734 bp, Homo sapiens
  misc_feature: GYAE6OF01D74HB.21.8.A08.1.454.CMB.1.raw
  modified_base (707)..(707): a, c, t, g, unknown or other
  misc_feature (707)..(707): n is a, c, g, or t
tcagtcgtcgctcgcacgaccggtgctcgatttagcatactctacagggggctgtgggctcaggaggcagagctctgggaatctcaccatggcctggacccctctcctcgcctcccccctcctctactttctgcacagtctctgacggcctcctatgagctgacacacgcccacccgtcggtgtcagtcgtaccccgaggaccaaacggccaggactccacctgctcgtaggatattccattacgaccaaaaagtattacttacgttgttacggttaccagaccgtaagaacgtcgacggccaccgggtccccttgtacctggtacactaccagtcggacggccctaggtccgaacgacctaccggtccgggacttcccgaggactacgtactttccgtacgttcgacccgtccgagtcctaccggaggaacctcgggtaccggaccctaacgttcgtaacgttcgtacggtacggggtaccgggacccggtagggtacgggaacgtacgtacggaacgtacgtacggtaactttacgttacgtttacgtaccgactaaccgagtacgtaggtacgtcgggtactacggtacgggtaggggttacgtcggggtaacgggaacgggtacgtacggttaccgggtacccgttcgggttacggcccggaacggcccggtaacgggccccgttacccggtacccccggttnttcccgtcccgttccccgttcccccgg

SEQ ID NO: 89415 - DNA, 870 bp, Homo sapiens
  misc_feature: GYAE6OF01B21LM.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctgacggtccctcctagtagagctagacacacgcccgtacccgtcggtgtacgacgtccgtacccgaagggaaccgtaaaccggaccgaacggtactacctaccgtggtcctacggtaggtacgttacttacgtaacgttaaccgaaaccgtaaaaagtaactttaacgttacgttttaggtttaccggttaacccgaggtaaccgtaaacggtaacggtaccgaacccgggacccggtaaccccgggtacccccgttacggttaaccggttccggtacctaaccgtccgtaaggttacgggaaccggtacccggtaacggtacccggtaaccgacccggtaacccggtacccgggtaaccgttcccgaaggtacggacgttacgtttcctaccgtccgtcccctacgacgtaccgtaagggtaccggaacgtcgggtaccgacccttaccgttacgtacgtacgtacgggtacgggtacccgggtccggtaggggtacggtaggtacgtaaggccgtacgttacgtactttacggtacgtttaacgtacccgacggaacctaggtaacgtggtacgttacggtacgtaacgggtacggggttaagggttacgggtccgggtaacgggacggtaacggtcgttaaccggtccggttccgtaggtaccgacccggacggtacgtccccgtcccggttaccccggtagtcccgtaccgttccgttcccccgg

SEQ ID NO: 89416 - DNA, 934 bp, Homo sapiens
  misc_feature: GYAE6OF01BE91C.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtggggctcaggaggcagagctctgggaatctcaccatggcctggacccctctcctgcctccccctcctcactttctgccacagtctctgaggcctcctatgagctgacacaacccaccctgggtntcagtcgtccccgaggaaccaaaccggccaggatccaccgtgcctcgtgggactattcattcgaacctaaaagtaattacttaccgtttggtttcggttaccagtaccaaggaacgtcgacggcccacgggtccccctaggttacgttgggtacctactccgtagttacggaccgggccctaacggttcccggaacccggaaccggaacccggttaccccggggtaccttacccccggttagggtaacggtaacgttaacgtttccctttacgtccggtcccctaccggacgtaccgtaccgggacggtacggacgggttcccggacccgtttaccgttacggaaccttcgttaccgggtaaccgggggtttaccgggggccccggtaagggggttccgggaacggtaacgttacggggaagtacccgttaacgttaacgttaaccgtttacggtttaacgttaccgaccccgtaataacccggtaacgggttaaggttcgggtacgggttacggttaaccgggttaacggggtacgggggtttaaacgggtccgggggttaccgggggtaaaacccggggtaccgggtttaaacggggtttcccgggaacccgtttttacccgggggtttacgggacccccgggttaacgggaaccccggtacccgggttaccgggttacccccccgggtcccccgggtttacccgggttacccgtacccccgttttcccggtttccccccgttacccccccgg

SEQ ID NO: 89417 - DNA, 715 bp, Homo sapiens
  misc_feature: GYAE6OF01BEEWK.21.8.A08.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagcatactctacagggggctgtgggctcaggaggcagagctctgggaatctcaccatggcctcggacccctctcctgcctcccctcctcactttctgcacagtctctgacggcctcctatgagctgacacacgccctacccgtcggtntcgtacgttcgtcccccgaaggaaccgaaaccggccgaggtactaccgtacctcgccttcgtaggaagtacttacagttacgaaaccgaaaaagtattacttaacgtttggttacggttaccaagtaccgaagtaagtcgacggtaccacggtcccctaagttaccgtcggtacacctcgagtcgtacggccgagtccgaaccacgtaccgtccgggtactcccgtaggaacgtacgtacttccgtacgtccgtccgtcgtaacgccctacgggaaccggtacgtacggtaacccggaccccttaacgtttacgaccgttactacggaacgggtcgggacccgtagggtaccgagtaagtacgacgtccaagtactacgtagttacggactacgactaacgtacgtagttaggtacgacgtagttaacgggagggttaccgtgggacggtacgacgtacggttacggaccgttcggacgtaccggacgtccggaagtcccggccttcccggagtccgtacccgttcgttcccgg

SEQ ID NO: 89418 - DNA, 847 bp, Homo sapiens
  misc_feature: GYAE6OF01DVANL.21.8.A08.1.454.CMB.1.raw
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
tcagtcgtcgctcgcacgaccggtgctcgatttagcatactctacagggggctgtgggctcaggaggcagagctctgggaatctcaccatggcctggacccctctcctcgcctccccctcctctactttctgcacagtctctgacgcctcctatgagctgacacacgccctacccgttcggtagtccaggttccgtacccccgaaggaaccgaaaaccggcccaaggactaccaccgttcgtccttacgtagggaatactttacctaacgtttacggaaaacctaaaaaaggttaacttaacgtttaccggttttacggttttacgggtttaacccaaggacccgtaaaggaaacggttccgaaaccgggacccgaacggggtcccccctttaggtaccgttcgggttacaaccttccgaagttacggaccggaccgtacgtaccgaaccggtaccgtaccgtaccgggaacttcccgtagaacgtatacttcncgtcgccctcganaccgtaggacggtacacggtccgcccttaacggtcgaacttcgtacggtacggtccggggaccgttaaggggacgggaacgtagtaacgtaacgtacgtacgtaaccgtttaacttaggtttaccgttaccggaaccgtaacgaacgtagttaacggtaacggtcgtacgtaacggttaccgggttaagggggttacgtacgggacggggtaacggtaaccggtaacggtttaccggaacccggttttccggtagggccgtaaccgggaccccgtaacggtccccgttaccccgggttaccccccgttacggttaccccgtccgtttcccgttccccggg

SEQ ID NO: 89419 - DNA, 876 bp, Homo sapiens
  misc_feature: GYAE6OF01A6L0Q.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgcgacgtcgacccaggacaaacggcaggactcacctgctcgtggatacgtacattacgaaccaaaaagtacttaagttacgtttgttacggttaccagacgaagtaacgtcgtacggaccctacggtcccccttaggtaccgttaggtacctaacgtaccgaagttacgggaaccggtacccgtaacgggtaccgaaccggtaaccgaacccggtaccccgggtaacgttaccccgtaaggtaacggtacgttaaccgtttaccgtccgttaacgtcccgttacccagggtacccgtaggtaacggtaacggtaacggtccggaacccgtaacgttagaaccgtttaaccgtacgggtaacgggtacccgggggtaccgtaacgggggtacggggtaaacgtaacgggtaaacggtaacggttacctaaccggttaaacgttaacgtttaaccgtttaccggtaaccggtaaccgaaccggaacggtaacggttaagggtaggttaccgggttacgtaacgtaccgggggttaacggggttacggttacggggtaaccgggaacggggttaacccgtaaggttaccccgggttaccggttaccggtttaacggaccgttaacccgggtaccccgtaagggtccccgttaaccccggtacccccggtaggtttcccgtaaacccggttcccgttccccgg

SEQ ID NO: 89420 - DNA, 763 bp, Homo sapiens
  misc_feature: GYAE6OF01COM8S.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggtgggctcaggaggcagagctctgggaatctcaccatggcctggacccctctcctgcctcccccctcctctactttcngcacagtctactgacgtcctcctatgagctgacacagcccacccgtggtgtcagtcgtaccccgaaggaaccgaacggccgaggatccacctgctcgtggatattcatcaaaccgaaaagtattacgttacgtttggttaccggtacagtaccgaagagtcgacggccacggtccctagtactcggtacacgtccgagtacggacgccgtacggtccgaaccgtcctaccggtccggtacgttcccgtacgaggtacgtctttaccgtcgtcgtccctacgcggttccgtacgggaaggtcgtacggtaccggcccttaacctacgtaccgttagtaccggtacggggcccgggtaccgtacgggtcgggacggtaagtacggaacgttcggtaacgtacgtttaacgttcggtttaaaccgtaccaccgaacccgaagtaccgtaaagggttcgttaacgggtctaacgggttcgggttacgggggtaacgttccgggggacgggtagggtaaccggtaaccggttccgtaaaccggttcggtaccggttaccgaccggacccggtaacgggtccctccccggttccggtcccggtacccttccggtacccttccccggttccccctaccccgg

SEQ ID NO: 89421 - DNA, 670 bp, Homo sapiens
  misc_feature: GYAE6OF01AZQ13.21.8.A08.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagcatactctacaggggctgtgggctcaggaggcagagctctgggaatctcaccatggcctggaccccctctcctgcctccccctcctctactttctgcacagtcctctgacgcctcctatgagctgaccacacgcccaccctcggtgtcagtcgtccccgagacaaaccggcaggactccactgctcgagtancttcactgaacaaaagacttattacgttgttgttccagcgacgtaagtcgacgaccgtaccgtccctagtaccgtgtacgtactcagtagacggcgtagtacgactacggacctaccggtacccggtaccgtacccgtaggtacgtacgttaccgttcgtaccgtccgtcccgtaccgaccgtacgtaccggtacggaacgtcggtccgtacccgtacgttactacgtacgtacggtacggtaccggggacgtagggtacggacgtagtagaacgtctaccggtattacgttagtacgtacgacaccgaaggactaggtacgtaggtcgtaacggtacggtacgggttacggtcggtaacgggaggtaccggtaagttaccggcccgttacgtggacccgtacgaccgacggtccgaccgtccccgtacgtcctcgttccccg

SEQ ID NO: 89422 - DNA, 794 bp, Homo sapiens
  misc_feature: GYAE6OF01CNCKL.21.8.A08.1.454.CMB.1.raw
  modified_base (132)..(132): a, c, t, g, unknown or other
  misc_feature (132)..(132): n is a, c, g, or t
  modified_base (181)..(181): a, c, t, g, unknown or other
  misc_feature (181)..(181): n is a, c, g, or t
tcagtcgtcgctcgcacgaccggtgctcgatttagcatactctacagggggtgggctcaggaggcagagctctgggaatctcaccatggcctggacccctctcctgcctccccctcctctactttctgcacngtctctggacgccctactatgagctacgacacacgccctacccgtggtntacacgtccgtaccccgaaggaaccgaaaaccggcaaggtactcccaccgtgccgtcgtaggtatacttactagttaccgaaacctaaaaagtacttagttaccgtttggtttaccggtaccagaacgtaacggtaacggtccgacggaccgtaccggtccccgttaggtacgtcggtcctactaccgaggtacggtaccgcgtaacggtaccgaaccgtaccggtacggtaccgggtacttccggaggtacggtacgttacttccgtccgtccgtacccgtaccgacgtaccgtacgggaacggtacgtacggtacccggtacccttaacgttacggtaccttacggtaccgggacgggggtacccgggtcccggtaaaggggtcgggtaaaccgtagggtaccggtaaaccgtttgaaaccgtttaacttacggtttaacggtttacgacccggtaccgaacgtacggtacgttagggtacggtcgtacgtagggtcgggtagggtcgacggggtacggacgtacggttcgtccgacggttcgtacggccgacgaccgtccggttaccctcccggttccgtcgtacacctttcccgtaccgtcccctcccg

SEQ ID NO: 89423 - DNA, 1079 bp, Homo sapiens
  misc_feature: GYAE6OF01AMVTE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctcgcctccccctcctctactttctgcactagtctcgtgacggccctcctatgagctcgacacacgccctacccgtcgggtgcgtacgtcggtaccccgaacggaaccgaaaccgggccaacgggtacctcccgtaaccgttcggtaccgttccggtaggggtaaactacttttacgtaacgtttaccggaaaaacccgtaaaaaagttaaactttaacgttttaaccggtttttacggggtttaccgggttttaaaccccgaagggtaaacccgtaaaacggggttaaaccggttaaccggtaacccgggggtaccccgggtaaacccgggtttcccccccgttaaggggtttaaccccgttcggggttaacccgtaaccgttacccgtaacggttacggggaacccggtaaccccgtaaacgggttacccggaaccggtaacccggtaaccccgggtttacccggggtaaccttcccggtaaggttacggaaccgttacgttttacccgtccgtacccgtacccggtcgtaaccggtcccggtaaccgggtacgggtaccgtaccgggttacccggacccgtttaaccgttacgggtaaaccccgtttaggtacccgggttaccgggggtaccgggggtacccggttaacgggggttacggggaacgttacggtaacgggtaacgtaccggtaaccgttacgttaccgttttaacgttaccggtaaccgtaacccgtaacggtaccgaaggtttaccggtaacggttcgggacccgttaacgggggttaccgggttagggggttaaccggttaccggggtacggggtaacccggttaaccggtacggtttaccccggttaccggttacccggtacggtacccggtacccggccccgggttaaacgggtccccggttaccccgggtacccccgtttaggcccccgtttaccgttccccggtttaacccccgg

SEQ ID NO: 89424 - DNA, 915 bp, Homo sapiens
  misc_feature: GYAE6OF01ES2FE.21.8.A08.1.454.CMB.1.raw
  modified_base (161)..(161): a, c, t, g, unknown or other
  misc_feature (161)..(161): n is a, c, g, or t
tcagtcgtcgctcgcacgaccggtgctcgatttagcatactctacaggggctgtgggctcaggaggcagagctctgggaatctcaccatggcctggacccctctcctcgcctccccctctctactttctgcacagtctctcgacgtccttacctagtcgancgtacgaacacaccgccctaccgttcggtcgtccgtagttccgacccgaaggaaccgaaaaccggtccgaaggacttacccgaccgttcgtacctcgtaggtacttacttacttaagtaccgaaaccgtaaaaagtaatttaacgttaacggttttcggttacgttacccgaagtaacggtaacgtaacgtccgaccggtaccgaccggttcccgtaagttccgttggtacctacgtaccgaaggtcggaaccgtcgtaacggtccgaaacgtaaccgtacggtacccgggtacttacccgtagggtaactacggttactttccaaccggttcgtacccctaggtaaccgtacgtaccgggaacggtactacccgggtacgtacccgttgttaaccgaacgtaccgttggaaccgggtccgggtaaccgtaaggggtaccgtaaagtcggtaaacggtaccgtagtttaaccgttaacgtacgtttaaccggtttaccgtaacccccgtaagtaaccccgttaagaacggtttaacggtaacggtttaccggaacgttaaccgggttaacggggtttacggggtaaccgttaccggggaaccgggttaaccggtaaccggtttaaccgggtaccggtttaacccgttccgttaaacggggtccccgttaaccggacccgtttaccgggccccccggtttaaccgtaccccccggttttaccgaaccctttcccggttaaccccgttaccccccg

SEQ ID NO: 89425 - DNA, 729 bp, Homo sapiens
  misc_feature: GYAE6OF01A9TIZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggactcacctgctctggagattcattgaccaaaagatatacttgttggttccagcagaagtcaggccacggcccctgtactggtcatccatcgagccagtcgacgacacgtccgggactccccgtgacgagtattcctctcgccctccgagtctacggaggacaggtcgcctaccttgacttagtcgtagggtcggggccctagggtcggaacgtagtaggaaacgtcgtacggtaaccttaacgttaacgtttacggttaacccggacctaacccggaaggtaacgttaagggttaacgggttcgggtaacctacggtttaaccggggtaacgggggggtttacgttacccggggggaaccgggggtaacgggtaaacccggttaacgggtttacccgggtaaaccccgggtttccggtttacggggtacccgtaccgggtacccccggtaaggggtccccgttaccccgggtacccccccggttaccgggttacccttacccggtttcccgtttaacccccccgg

SEQ ID NO: 89426 - DNA, 756 bp, Homo sapiens
  misc_feature: GYAE6OF01CA2SD.21.8.A08.1.454.CMB.1.raw
  modified_base (131)..(131): a, c, t, g, unknown or other
  misc_feature (131)..(131): n is a, c, g, or t
tcagtcgtcgctcgcacgaccggtgctcgatttagcatactctacagggggctgtgggctcagggaggcagagctctgggaatctcaccatcggcctcggacccctctcctcgcctcccctctcactttcngcacgatctcgtgacggtcctctatgacgctacgacacacgccctacccgtggttcgcacgtccgtaccgaggaacgaaccggacgagactacacgtcgtacgtcgtaggtatacttacatacgaaactaaaagacttaacgttcgttaggtcgttacagacgtaagacggtacgacggtaccgtaaccggtcccttaggtaacgtcggtacctacgtaccgataccgggacgaccggtagaccgtaaccggaccaaccgggttaccggtacctccgtaaggacgtacgttactttcgacgttacccgccgacgtacgacgtacgggaacgtacggtacgtccgtaacctacgttactaagttaccgacgggtaacgggtacgggtaccgtacgggaggttaacgacgttaaccggaaagttccggtaactaacgtttaacgttaacggttacgaacgttaaccgacgggtaactaacggttcggtaaccggttaagtacggtacgggtacgggttaaacgggtcgggttaacgggacccgggttaagaacggttggtaccgtccggtacgtagacccggagaccgtcgtacctcccggacctcggtacttccgtcccggtaccc

SEQ ID NO: 89427 - DNA, 599 bp, Homo sapiens
  misc_feature: GYAE6OF01A43AH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaccacagcccacccgtcggtgtcagtcgtccccaggacaaacggccaggatcacctgctcgtggagtacttcattcgaccaaaaagtatattacttgttggttccagcaggaagtcaaggccacggcccctgtactggtcactccatgaggccagtcgacgacgaccgtccgggactcccctagagacgtattctctcgccctcccgagcctcgagggacagtccgccaccgttgacctatccgaggtcggggccccgagggtacggacgtagtaggaacgtcgtacgacttacgttagtttcgttaccgcacccagaccgtaggtagtggtacagtcggaggggttatccgggacggagggacgtagttacggacccggttcgttacgggtcacgcccgaacgggccctccgtccccgtacggtcctcgtccgttccccg

SEQ ID NO: 89428 - DNA, 777 bp, Homo sapiens
  misc_feature: GYAE6OF01DFNDQ.21.8.A08.1.454.CMB.1.raw
  modified_base (183)..(183): a, c, t, g, unknown or other
  misc_feature (183)..(183): n is a, c, g, or t
  modified_base (217)..(217): a, c, t, g, unknown or other
  misc_feature (217)..(217): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (709)..(709): a, c, t, g, unknown or other
  misc_feature (709)..(709): n is a, c, g, or t
tcagtcgtcgctcgcacgaccggtgctcgatttagcatactctacagggggctgtgggctcaggaggcagagctctgggaatctcaccatcggcctcggacccctctcctcgcctcccctcctcactttctgcactagtctcgtagcgacctctatgacgctagacacacgcctaccgtggtncgtacgtcgacccaggaacaaccggtccgaagcncgtacctgacctgtacgatcgttacattacgaaaccaaaatacttaacgttcgtttacggttacggtaccaagtccgaaggtaacggtctaaccgggaccgtccggttaccctcggtacgttacggctanccgtanacggggacctacgacggtacccgaacggtactacccgggacgggtctaccggtacggatacgttactccgttcacccggtccttccggataccggtacggaacggtaccgtcgggttaccctaccggtacgttacggtaccttaggaccgggttacgggacccggggtacggtacgggtacggaacgtggtaacgtaacgtcgttaacgttaccttagtttaaccggtacgttaacgaaccgtacgaacggtacgttaacggtacggtacgttcgggaagggttacgggttaacgggtacgggttacggacggggttacggtaccggttacggtccgttaacggttccgggttaanacccggtacgggaaccgtaccggttacgccccggtttccgtaactcccgttcccgaccgtttccccgg

SEQ ID NO: 89429 - DNA, 747 bp, Homo sapiens
  misc_feature: GYAE6OF01BWF9G.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccacccgttggtgtcgagttccgtaccccgaagggaaccaaacggccaaggactaccacctgctcgtagggaatattcaattacgaaccaaaaagtaattatacgtttggttagttccagacaagaagtcacggaccgacggtccccttgtactggtctactccgatggacgcctaggtccgacgaacctacgtcgggacttcccgtagaacgacgtacttccgtctcgacccttaccgaagtccttaacggacgggtactaacgggttcccggaccctaaccgtttagaacccttagtaccggtacgggtacggggtacccgaagggttacggaacgtagtacggaacgtccgttataaccgttacgttaagtttacggtaccactaaccgagtaacgtagttaaggtcgttacgtacggtacgggttaggggtttacgacggggtacgggtaacggtaaccgtacgggtttcggtaaacccggttcgtttacgggtaccgaaccggtaccccggtaaagggtccccgttacccgggtcccccgttagggtccctaacccgttcccgggtttaacccccg

SEQ ID NO: 89430 - DNA, 658 bp, Homo sapiens
  misc_feature: GYAE6OF01EGDF3.21.8.A08.1.454.CMB.1.raw
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
  modified_base (646)..(646): a, c, t, g, unknown or other
  misc_feature (646)..(646): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacggcctcctatcgagctgacacacgcccaccctcgattcgtcagtcgtccccgaggaccaaacggcaggtactccaccgtgcctcgtaggactattccattcgaaccaaaagtattatacgttgttcgtcagcagaagtcgacggccacggtcccctggtacgttggtcacgtccagtcggacggccaggtcgacacaccgtccggatccgtganagtacttcctcncgtccctacacggtctacggacgggtacncggtcggtccctacgttagactacgtcggacgggtacggggtacctagggtcgaacgacgtggaactcgtacgtaaccttatacgttacgtaccactaacgagacgtaggtacgtcgggtacacggttacgggtaggggttacgtcggggtacgggaaccggtaccggttaacggttccggtaaccgtttccggtacgggttcccacggtcccgacggttccgtaccccgtaccccggtcgttaccncccgtttcccgg

SEQ ID NO: 89431 - DNA, 957 bp, Homo sapiens
  misc_feature: GYAE6OF01E3C5D.21.8.A08.1.454.CMB.1.raw
tcagtcgtcgctcgcacgaccggtgctcgatttagcatactctacagggggctgtgggctcaggaggcagagctcgtgggaatctcaccatggcctcggacccctctcctcgtcccttccccctcctctacttttctcgcactagttcctcgtgacggtcccttcctagtgacgtctacgaccaaccacgcccctacccgttcggtcgtactacggtccgtacccccggaacggaaaccgaaaccgggaccgaacggtaccgtacccgtaccgtcgtccttcggtaggtagtacgtttacgtaacgtttaccgaaaacctaaaaaagttaaacgtttactttaacgtttttggtttaccggtaccgtaagtaccggtaaaaggtaaccgttaccggaaccgggtacccgtaacccggttccccgtagggttaaccggttccggtaacgtaacctccgtaaggtacgggtaaccggtacccggtaaccgggtaccggaaccggtaacccgtaaccccgggttaccccgggtaccgtttaccccggtaaggaaaccgggttactttaacctttccggtttacccgtacccggtacccccgttaccgtacgggtcccggttaaacggggtaccggtaacggtaccggggtacccgttaccccgtacgttaactaacggttaccgttacgggtacggggtcccgggtaaccgggtagggtaacggtacggtaaacggtacggtaacgtccgtaacgtttaacgttaaccttacggtttaaccgaaccgtaccgtaacgtaacgggtacgttacgggtttacggacggttaccggttaaggtacgggggttaaccggttggtacccggggaaggtaccgtacggtacggtccgttacggttccgtaggacccgtcggaccgtccgcgtaccccggtcgtaccgctcccgttaccgttccccg

SEQ ID NO: 89432 - DNA, 1085 bp, Homo sapiens
  misc_feature: GYAE6OF01ELAT1.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctcgcctccccctcctcactttctgccacacgtctctgacggcctcctatgacgctcgacacacgcccacccgttcggtgtcacgtccgtccccgaaggaaaccaaaccggccgaaggactccgaccgtcggccttcgtaggacgttaacttcgtaagttacgaaccgaaaaagtaatttaacttacgttttcggtttacgggttacccaaggtaccgtaaggaaacggttaccgaacggggtacccgtaaccgggtacccccctttaggttaaccggttcggggttttacccaacgtttaccccgtaacggttacgggtaacccgggtacccgtaacgggtttacccggaaaccggtaacccgtaaccccgtttaccccgggggtaacgttaccccccggttaggaacggtaaccgttaacgttttccccggacccgtttaccggtaccccccggttacccgtaacgggttacccgtaacccggggtaaccggggaaccgtttacggggtacccccgggttaaccttaaccccggtttacgttaaccgtttaccgtaccgggttaacggggtcccggggggttaaccccggtaacggggtaccggggtaaccgggtaaacgttaacgggaaccgggttaccgttaaccgggtttacctttaaacccggtttaacgttttcccgggttttaaacccgacccgtaaccggttaaacgggtaacgggtttaaacggttacgggttacggttaaccggttaacggttaccgggggtttaacggggggttaaccgttaccgggggtaacgggtaacccggggttaacccgttaaacggggtttacccggttaccccggggtttcccgggttttaacgggaccccggtaacccgggaaccccggtaaacgggtccccgttaccccccggggtacccccggtttacccggtaacccgttacccgtttcccggtttcccccccggg

SEQ ID NO: 89433 - DNA, 709 bp, Homo sapiens
  misc_feature: GYAE6OF01DV9ZJ.21.8.A08.1.454.CMB.1.raw
  modified_base (299)..(299): a, c, t, g, unknown or other
  misc_feature (299)..(299): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctggtgtcagttcgcccccaggaacaaacggccaggactcactgctctggatattcattcgaaccaaaagtaattattacttgttggttaccagcagaagtcaggaccacgccctgtatgtcatccangacgcgagtcgacgacaccgtaccggctcccgtagacgtacgtatttctacgtcgcccctaccgtacgtcctacggtaacgggactacgggtcgacccgttaacgttacgtaacttactccggtaaggggttcccggggaaccgtacggggtacgggaaccgtaagtaacgggaacctacgttaacgtacctttaaccgttagtttacggtaccgtacgaaccacgacgtacgtaggttggtaccgtagtacgggtaggggtttaacgttcggggaacggggttaccggtaaacggtacggtttacggtaccccggtttcggttaaccgggccgtaaccggaaccccgtacgggtccctcccgggttacccccgtcgggttaaccctcccgtttccccggttacccccgg

SEQ ID NO: 89434 - DNA, 790 bp, Homo sapiens
  misc_feature: GYAE6OF01A2C9U.21.8.A08.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagtcgtcgctcgcacgaccggtgctcgatttagcatactctacagggggggagacggagcccagcactagaagtcggcggtgtttccattcggtgatcagcactgaacacagaggactcaccatggagtttgggctgagcttgggttttcctccttgcttcttttaagaggttgtccagtgtcaggcgacaagtggtggngtcgtggggngcagtggtccaggccgtgggacgtccctggacgcctctcctgcgcgagtcgtctggtactcgagtacgtcggtccttaccgtttcgcctagttcgactcggtcggggtccccgtcggacggtccgtacccggaggggaccggaaggggggtccgttaggggtacgggtagggggtcggtaccgtagttttacggccgttaggggtaagtagggtaaggttagggaaggttacggaagtaggttaatttagtttaacgttacgacggttaccgttaccggtagggaaccggtaccgtacgttacccacgtactccgtaccaaggtaaccgaacaagtaccgaaacccaaactaaccgtaaccgtagttaccgttaacttacctaaacgtaaacgtccggaccccggtaccgtaggaacggaccgtaccgggaaccgaaccgacgggtttactagtttaaccggtttacgtttaaccggtaccggttaacgggtcgttttagggttccgggtttaaacggtccgggttaccggggggtaaaccccgtacggggtaacccccgggtttccggtacccccgg

SEQ ID NO: 89435 - DNA, 842 bp, Homo sapiens
  misc_feature: GYAE6OF01E0V5U.21.8.A08.1.454.CMB.1.raw
tcagtcgtcgctcgcacgaccggtgctcgatttagcatactctacagggggctgtgggctcaggaggcagagctcgtgggaatctcaccatcggcctcggacccctctcctcgcctcccctcctctactttctgcacagtctctggacggtcctacctagtgacgtctacgacacgacgccctacccgtcggtcgtacgtacggtccgtaccccgaaggaaccgaaaccggccgaacggtacctacctaccgttcgtaccgttcggttagggtacttacgttacttaacggtaaccgtaaaacgtaaaagttaacgtttaacgttttacggttttacgggtttaccgaaccgtacgtaacggaaacggtaccgtaccggacccggtaccggtacccggttaccggttacgtacggttacgtacctaccgtacggcgtacgggaccgtaaccggtacggaccggtaaccgtaccggtaccggtaccgtaccgtaccggtagacgttattccgtcgtccgtccgaccgtacgtacgtacggaacggacggtacgtacggtaccgtaacttacgtacgtacgtacggtacgggtaccggggaccggtaacgggtagggacgtaagtacgggtactacggtacgtacgttaactacgttacgtaccgactaccgaacgtacgtagtcggttacggtcgtacggtacgggtacggggttcggtacgggacggggtacggtaaccggtacgttaccggtccgttaccggtggtacccgacggacccggtacggtcccggttccccggtacccggttccgtaccgccctttacccggcccttaccccgg

SEQ ID NO: 89436 - DNA, 719 bp, Homo sapiens
  misc_feature: GYAE6OF01EILS4.21.8.A08.1.454.CMB.1.raw
  modified_base (138)..(138): a, c, t, g, unknown or other
  misc_feature (138)..(138): n is a, c, g, or t
  modified_base (314)..(315): a, c, t, g, unknown or other
  misc_feature (314)..(315): n is a, c, g, or t
  modified_base (365)..(365): a, c, t, g, unknown or other
  misc_feature (365)..(365): n is a, c, g, or t
  modified_base (661)..(665): a, c, t, g, unknown or other
  misc_feature (661)..(665): n is a, c, g, or t
tcagtcgtcgctcgcacgaccggtgctcgatttagcatactctacaggggctgtgggctcaggaggcagagctctgggaatctcaccatcggcctggacccctctcctgcctcccctcctcactttctgcactacgtncgtcgtcgacgtcctacctacgtgacgtacgtacgaccactaccgaccgtccgtcgtcgtcgtacgtaccgtaccgacggacgaaacgacgtacgactactacgtcgtcgtagtagtactacgtacgtacgtacgtaacgtaaacgtaacttacgttacgttcgttacggtacgtnnaacggtaacgtacgtaacggtaccgtacgggtaccccgtacggtaccgtncggttctaacttccgtacgtacgtacggaccgtacgtacggaccgacgtaacgtaccgggacgtaccctccgacgtacgtagtacgtacgtacgtcctcctacgaccgtccgtacgggacgtacgtacgggtaccgtaccgttacgtaacccgtacgttacgtacggtacgggtacccgtacgggtacgggaccgaacgtacggtaagtacgtacgtacgtacttacgttacgttaccgtacgtaaccgtaacgtacgtacgtacgtacggtacgtacgtacggtacggtacggtnnnnncggtacgggtacggtacggtacggtacggtaccggtaccgttcggtccgtacgg

SEQ ID NO: 89437 - DNA, 950 bp, Homo sapiens
  misc_feature: GYAE6OF01CTJTL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgccttcccccctctctacctttctgccacagttctcgtgacggtccctcctagtgacgctcgaacacgacgccctacccgttggtcgtacgtacggttccgtaccccgaaggaaacgaaaccggccaagggacctacctaccgtgaccttcgtagggatacgtttactagtttaaccgaaaccgtaaaaagtattaacgttacggtttcgttacggttacccgaagtacgtaagtaaacggtcgtaaccggaccgtacccggggtacccctaggttccgttcggtaccctacttacccgaaggttccggaaccggtaccggtaacgtacccggaaccggtaaccgtacccggttacccgggtaaccttaccggtaacggtaacggttaacgttcctttccgtctacccgggtcccgtaccctacgtacggtaaccgaaccgggttaaccgacggtttacccgaaccccgtttaccgttcgtaaaccgttccgttaccgggtacggggttcccggggaccgaggggttaccgaggtaaagtacggaaacgttccgttaacgtaaccgtttaacgtttacgttacgtaacccggtaaccgaacccggtacggtaacggttaacgggttacggttaaccggttacgtacgggtttaaggggggtaacggggttttacggggtcgggggaaaccgggtaaaccggggtttaacggtacgggtttaccccgggtacgttaccgggttacccgggacgtaaaccccgggtcccgtaacccgggtcccgttacccccggttaccccggttaccgttccccggtaccgttttccccggttaacccccccg

SEQ ID NO: 89438 - DNA, 1124 bp, Homo sapiens
  misc_feature: GYAE6OF01BQ53J.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctcgacacacgccctacccgtcggtcgtcgacggttccgtacccgaaggaaccaaaccgggccaagggactccgtaaccgtcgaccgttacgtagggaacttacttacgtacgttacggaaaacctaaaaagtaactttaacgtttaccgttttcggttttaccggttaccgtaacggtaccgtaaaggtaacgggttacccgaaccgggtacccggtaaccgggtccccccgtttaggttaccgttccgggttacctaacgttccgtaagtacgggacggtccgtaacgggtaccgaaaccggtacctacccgggttaccggtaaccgttcccccggtaaggtaaccgggtaacgttaccgtttcgtacccgttaccggtacccttaccccggtaggttaccccgggtaacgggtaacggggtacccggttaacggggtaccccggtaccccgtttaaaccggttaccggtaaccgttacggtaacccggttaccgggggttacccggggtaccccgggttaaaggggttccggggtaaaccggtaacggtttaaacggggtaacccgggttaaccgttaaaccggttaacccggtttttaaacgttttaacccggttttaaccgggttaaccccgaaacccggttaaacccggtaacgggtttaacccgggtaaggtttaaccggggtttttacgggaaacccgttttacggggtaaccgggggttttaaacgggggggtttcccggttaaccggggggtaaaccgggggttaaaccggggttaaccccgtttaaacgggggtttaacccccggttcccgggttttaaccgggttacccgggttaaccccggaaccgggtaaccccgggttaaacccgggttccccggttacccccggttaaccccccgggtttacccgggtttaacccttaccccgggtttaccccgttttaaccccccccccgg

SEQ ID NO: 89439 - DNA, 908 bp, Homo sapiens
  misc_feature: GYAE6OF01AHUDM.21.8.A08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagcatactctacagggggctgtgggctcaggaggcagagctctgggaatctcaccatggcctcggacccctctcctcgcctccccctctcactttctgcactgtctctagacgccttctatgacgtctacgacacgcgtccctacccgtgggtctactacggtccgtaccccgaaggaaccaaccgggtcgaacggactacctaccgtntccgtcgtagggactactttcgaacttacgaaaccgaaaagtacttacgttacgttgttacggttcgacgacgtaagaacgtaccgaacggccgtaccggtccctacggtaccgtcggttaccacgtaccgtagtacggaccgtccggtacggtaccgaccgaacgtacccggtaccggtaccttccccggtaaggtaccgaccggttaacttcccgacgttccgacccgttaacgcggtacccgtacggaccggtcgaaccggtccgtaccgttacctacggttactaaccggtcgtacgggtaccgggaccgtagggtaccgggtaagtacgtacggtaacggtacgtacgttaaccggtttaacgttacgttaacccgtaccgaacccggtaacgtaacgtaacgggttaaccggttacgggtaaccgttacggggtaaccgtttacgggggtaaacgggggtttaccccgggtacgggaaccggggttaacccgggtaacgttttaaccgggtaccccggtttaacggtacccggggttttaccgaaccgggttaaccccggtacccggggttaacccccgggtaccccggttaccccccggtttaaccccggggttaccgttaccggttccccccgggtttttaacccggttccccccggg

SEQ ID NO: 89440 - DNA, 851 bp, Homo sapiens
  misc_feature: GYAE6OF01B1KXE.21.8.A08.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngttctcctggacggtcccttcctagtgacgctcggaaccacacgtcccacccgttggtcgtcgaggtccgtacccccgaaggaccgaaaaccggccgaaggtacttccgtaacccttggcccgttacggtacgggtagttacttaccgtacgtttacgaaaacccgtaaaaagtaacttacgtttaccgttttacggggttttacgtacccggtaagtacggtaaacggttaacgtccgaaccgggcccgtaaaccgggtccccgtttaacggttcggttacgtaacgtaactccggtacggtccggtaaaccggacccggtaaggtacccgggaaccgtacccgtaccggtaccccgggtaacctttccgggaggtaacggtaacgttaccgtttcccgtcgttcccgtacccttaccggtacgtacccgttacgggaacgggcgttaccggacggtccccttaacgttcgtaacgtacgtccgtaggggtccgggaccggtggtaacggacgtacgtaacgagtccgtaccgtacttacgttagttcgtaccgaccgtaaccgtagtacgtaacggttacggttcggaacgtacggtcggggttaacgtcgggttacgggaacggtacggtaactccgggttaaccggtacgttcgtaacggtccgacggtccgaagttcccgtcccgacccgttggacttccgccgttcccccg

SEQ ID NO: 89441 - DNA, 636 bp, Homo sapiens
  misc_feature: GYAE6OF01DGQBL.21.8.A08.1.454.CMB.1.raw
  modified_base (135)..(135): a, c, t, g, unknown or other
  misc_feature (135)..(135): n is a, c, g, or t
  modified_base (146)..(146): a, c, t, g, unknown or other
  misc_feature (146)..(146): n is a, c, g, or t
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (487)..(487): a, c, t, g, unknown or other
  misc_feature (487)..(487): n is a, c, g, or t
tcagtcgtcgctcgcacgaccggtgctcgatttagcatactctacagggggctggtgggctcacggaggcgtagagcttctggaattctcaccatggcctcggacccctctcctgcctcccccctctcactttcngctacgcgtcnctgagtccctctatgatacgnacacncgccaccgtgtnacngtcgcccgagacaacggcagctcacngctctagatctcatacgaacaaanactnttcgttgtcgtcatcagtacgtgcgacctacgcccttagtacgtcgtacacgtacagtcggacggacctacgacgaacaccgtacgtccggtactccgtagaacgtatacttcgtactactacctacgacgtactacggagtacgtacgtaccgcccgttacgtacgacgtcgtaacgcggtccggacgtacggtaggaactagtaacgaacgtctaagtaacttacgttacgtacgtacccgtanaaccggtagtacgtaagttcggtacgtacgtacggtacgggtaggttacggtcgggaacgggaccgttaacgtacggttcgtacgtacggtgtaaccgacgaccgaggtacccgtcccggtaccgttcgacgtccgttccgtaccccgg

SEQ ID NO: 89442 - DNA, 1071 bp, Homo sapiens
  misc_feature: GYAE6OF01B5U6C.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgccttcccccctcctctaccttttctcgcacagtctcgtgacggcctacctatgacgctgacacacgcccacccgtcggtgtcacggtcgtaccccgaggaaccgtaaaccggccgaagggtactccaccttggccttacgtggtacgtacttcgtagttacgaacctaaaagtatacgttacgtttggtttacggttaccagtacgtaacggtacgtaaaacgcgggacctaccggtcccccgttagtaccgtcggtacacttaccgagttggaccggtaccgaacggttaccgggaaccgtaaccgaccggttacccggggaacttccccgtaaggaacggtacgttacctttccgtccgttaccggaccctaccggtacgtcccggtacgggaaccgggtaacgtacgggtacccgtaacccgttacccggttacggtaaccgtttaccggtaaccggtacggggggttaccccggggtaaccccggtaaggggggttaaccggaacgggtaaccggtttaacgggtaaacggtacccggtttaaccgggttaaaccgttttaacccggttttaaacggttttacccggtaaaccccgggtaccccgtaaaccccggtaaacgggtaaaccggtttaacggggtttaaccggggttaccgggttaacccggttaaccgggtttaccgggggggttaaacggggggtttaacccggttaacccgggggaccgggggttaaaacccgggttaaaccgggttaaacccgggggtttttaccccggtaaccccggggttttaccccgggttttaccggggtaaaccccggtaaacccggggtacccccgggttaaaaaccggggttcccccgggtttacccccccggggtaaccccccccggttttaaccgggggtttaccccctaacccccggggttttcccgttttaaaccccccccccggg

SEQ ID NO: 89443 - DNA, 898 bp, Homo sapiens
  misc_feature: GYAE6OF01CKWM3.21.8.A08.1.454.CMB.1.raw
  modified_base (184)..(184): a, c, t, g, unknown or other
  misc_feature (184)..(184): n is a, c, g, or t
tcagtcgtcgctcgcacgaccggtgctcgatttagcatactctacagggggctgtgggctcaggaggcagagctctgggaatctcaccatggcctcggacccctctcctcgcctccccctcctcactttctgcacagtctctggacggcctcctatgagctagacacacgcccacccgtcggtnacaggtcgtacccgaggaaccaaacggcaggactccaccgtgctcgtagggatattcattacgaaacctaaaaagtataattacgttggttcggttaccagcgtaagtaacgttacgacggaccgtaccggtacccgttacgtacgtcggtactactaccgacgtacgaacggccagtaccggaaccgtaccgaccgtaccgggtactacccgtaggtacgtagtacgttcctacgtccgtacccgtaccagtacctacggacggggtaaccgtacggcccggtacctaccgttaacggtaaccgttacgttaccgggtaacggggttacccgggggaccccggtaacgggtaacggggtaaacggttacggtaacgggtaacgaacgtaaccggtttaaccggttaatttaacccgggtttacggttaaccccggtaacctaaacccggtaaagaccgggtttaacgggtaacgggtttaccgggtaaccggttacggttaaccgggggtaaggggtttaaccggggttaccgggggtaccggggtaaacgggttaacccggttaaaccgggttacccgggttaacccggtttcccgggttaacgggtaacccggtacccggtaaccccgggtaaccggtaccccggttaccccgggtacccccccgggttaccgtaacccggttaccccggttcccgtttacccccccgggg

SEQ ID NO: 89444 - DNA, 701 bp, Homo sapiens
  misc_feature: GYAE6OF01B6ECV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctctcactttctgcacagtctctgaggcctcctatgagctgacacacgcccacccgtggtgtcagtccgacccgaggaaccaaacggccgaggactccaccgtgctcgtaggatacttcgattacgaaccaaaagtattacgttacgtttggttcgtaccgagtacgaagaacgtcgacggccacggtccccttagtactcggtacactccgagtcggacggccacgtccgaacgaccgtaccgtccgggactcccgagacgtacgtactttcgcgtccgccctacgacgtccgtacggacggactaggtaccgtacctacgttagaccttacgtacgtacgggtcccgggaccgtagggtaccggaacgtagtacggacgtccgtacgtacgttaacgttacgttaccggtaccgacgtaaccgaagtacgtaacggttggtacggaccgttaggtaccgggttaggggtcgttacggggacggtaacgggtaccgtacgggttaccctaccggttcgtacggtaccgacggtacccgaacggtcccgtcccgccccgttacgtcctccgttccgttaccccg

SEQ ID NO: 89445 - DNA, 768 bp, Homo sapiens
  misc_feature: GYAE6OF01DXU1E.21.8.A08.1.454.CMB.1.raw
  modified_base (164)..(164): a, c, t, g, unknown or other
  misc_feature (164)..(164): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctaacacncgccaccctcggtgtcagtcgtcccgaggacaaacggcaggatccacctgctcgtggagtattcacttcgaaccgaaaaagtattacttacgttggttacgttaccagacaagtaagtcgacggccgacggtccccttgtactgggtcctactaccagtggacggaccgacggtaccgacgacaccggtaccgggtactacccgtggaacgagtactttctctcgtccctcgacgtctacggaacggtacgtacggtcggtcctaacgttcgaaccttactacggtacgggtaccggggtcccgtaacggggttgggaaccgtagtaggaaacggtcgttacgtaaccgttacgttaactttaggttaaccgtaccgtaaccgtaacgtaaccgtaagggttaacggttacggtacgtaacggttacggggttaaccggggggttacggtttaccgggggacgggggtaacgggtaaccggttaaacggtttaccgggacccggttttaccggttcgggttaccgaaccgggtaccccggaacggtcccgtacccggtcccccggttacggttcctacccgttccgtttcccgttacccccccg

SEQ ID NO: 89446 - DNA, 958 bp, Homo sapiens
  misc_feature: GYAE6OF01BTNWG.21.8.A08.1.454.CMB.1.raw
tcagtcgtcgctcgcacgaccggtgctcgatttagcatactctacagggggctgtgggctcaggaggcagagctctgggaatctcaccagtggcctcggacccctctcctcgcctcccccctcctctactttctgcacagtctctgacgccttcctagtgagctgacacgacgccctaccgttggtacgtcgacggtccgtaccccgaaggaaccgtaaaccgggccgaacggtaacctccgtaccgttcgtaccgttcggtaagggtaacgttacctttacgtaaccgttaacggaaaaccgtaaaaaaggttaaactttaacgttttaaccggttttcgggtttaccggtaacccgaaacggtacggtaaaacggtaaaccggtccggtaaccgggtacccggaacccgggttcccccgtttaggttaccggttaaccgggtaccttaaccgtaccggtaaggttaccgggaccggtacccggtaaccggtacccggaaccgtaaccgtacccgggtacccgggtaacctccggtaggaacgttacgtttccgttacctcgtcccggtaccctaccgacggtccggtaacgggaacggtaccgtaccggttaccccggttaacctaacccggtttaacggtaacttaccggggttcgggaaccggggttacccggggtaacccgggtagggttaaccgggacgtaacgggttaacggtaaccggttacgtaacgtttaaccttacgtttacgtaccggtaacccgaccggtaaccgtagtaaggttacggttacgttacggtacggtaacgggttcggggttaaccgggttcggaccggggtaacgggtaaccggtacgttaaccggttacccggtaccggttcgtacggaccggtaccgtccgtaccggtccccgtacccgtccccggttagttcccgtccgttcccgtaccccg

SEQ ID NO: 89447 - DNA, 957 bp, Homo sapiens
  misc_feature: GYAE6OF01EPAE6.21.8.A08.1.454.CMB.1.raw
  modified_base (143)..(143): a, c, t, g, unknown or other
  misc_feature (143)..(143): n is a, c, g, or t
tcagtcgtcgctcgcacgaccggtgctcgatttagcatactctacagggggctgtgggctcaggaggcagagctcgtgggaatcctcaccagtcggcctcggacccctctcctgcccttcccctcctctactttctgctaacngttctcgtgcgtccctactagtcggacgtcgacgaacaccgtaccgtcccgtacccgttggtaccgtctacggtccacccggaacggaaccgaaccggtcgaacgtaccttaccacgtgtccttaggaggtattactacgtaacgtaacgaaacctaaaagttatttaccgtttagggtttgtttacccgacggactaacggaacgtagtacgaccggacgttacccgtcccggttataccggtacggtactacctaacggtacgtaccggacccggtaccgtaaccgggtaccggaaccctaccgggtttacccggaccggtttacctaccggaaggaaccgtttacctttactacccgttcgtacccgtcccgttaaacgacgggtacccttaacgggggacggtaacctaccggggttcccttaaaaccggttcgtaacggtaacccggtttacggtaaccggggttaaccggtccgggtaaccgggtacgggttaaacggaacggtttacaaacgggttaccgtacggttaacggttttacggttaacttttaaaccggtttacggaaccccgtaacgttaaccgggtacgtaaacggtttaacgggtccggttaacggttaacgggttaccgggtttaacgggggtaacggggtttaccggtaaccgggggtaacgtaaaccggggttaccggtttacccggtagggtttaaccccggttcggttaaacgccccggtaaacccgacgggttacgtccccggtacccgggtacccttccggtttaccctaccgggtcccttaacccccgg

SEQ ID NO: 89448 - DNA, 852 bp, Homo sapiens
  misc_feature: GYAE6OF01DOTEF.21.8.A08.1.454.CMB.1.raw
tcagtcgtcgctcgcacgaccggtgctcgatttagcatactctacagggggctgtgggctcaggaggcagagctcgtggaatctcaccatggcctggacccctctcctcgcctcccccctcctctactttctgcacagtctcgtgacgtcctcctatgtagcgtagacacacgccctacccgtggtctcgtagtccgtacccgacgaacaaccggccaggactcaccgtgtccgtacgtagagttacttacctagttacgaaaccgtaaaagtaacttactttacggtttaggtttacggttaccgaagtacgtaaacggttaacgaccgtaaccggtcccgaaccgggttccccttaaggtccgttaccggtactaaccgtccgtaacggcgggtaacccggcgtaaccggtacccggtaccgtaacccggttaccccggttacccgggtaccttacccggtaaaggtaccgttacgttaccgtttccttccggtcccgtacccttaaccggaccgtcgtaacgggtacggtaccgtacgggtacccctaaccgttacgtaccgttacgtacggtcgggtacgggtacccgggaacgttggggaccgtagacgtagtcgttaccgtacgttaacgttacgtttacgtacgtaccgccgaaacccgttagtaccgttaggttaccggtacgttaaggtcggttaacgggggtaggtttaacccggcggggttaaccgggaacgttaccggtccggttaccgtaccggttcggtaccggtacgcccggaaaccgttcggaccccgtacccggttccccgtacggttaccgtcccgtttccccggttccccccg

SEQ ID NO: 89449 - DNA, 915 bp, Homo sapiens
  misc_feature: GYAE6OF01A82EP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactctctgcacaggctctgacgcctcctatgagctgacacacgcccacccgtcggtgtcacgtccgtccccgaggaccgaggaccggccgaggactaccgacctcgctccgtgaccaagacgtcggtacgtacggaaccaaaaggtaattagtacgttacgtttaacgttaccggtaaaccaaacgaacggaaccggaccgaacgggacccggtaccggtaccccgtttagggttacggttaacggttagtaacgttaaacttaaacggtaaaacgaccgtacggtaacggaccgggtaaccggtaccccgttacgaaacggtaacgtacccgttacccggttaaggaccggtaccgtttaacgtttccggttccggttaccggtaccgttacccgaacgggttacccgtaaaccgggaacgggtaaccgtacggaaccgttaacgggtacccgttaaacgggttaccgtaaccgttacgtaacgggttaaccgggtaaacggtaaacccgggtacggtaacggggaacccgtaacggggggttaaacgggacccggtttaaggtaccggtaacgttaacgtttacgttaaccggttaacgaaaccgtaacggtaaggttaacccgaaggttaacggtagggtaaccgttccgtagggttacgggtttcggggtaacggcccgggtaaacggggaaccggaaccggttacgtacccgggttaacccggttaacccgttacccgggttaacggacccggtaccggtaacccgggtaaccccggttacccccggg

SEQ ID NO: 89450 - DNA, 775 bp, Homo sapiens
  misc_feature: GYAE6OF01CKLNY.21.8.A08.1.454.CMB.1.raw
  modified_base (485)..(485): a, c, t, g, unknown or other
  misc_feature (485)..(485): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgaccacagtctctgtacggtcccttcctatcgagctcgacacgacgcccacccgttcgggtcgtcacgtcggtaccccgaagggaaaccgaaaccggtccgaacggtactaccgaccttcgctacgttagggaatacgttactattacgaacaaaagactattacgttgttcggtactagacgaacgtaacgtcgacggtccaaccggtcccttaggtactcggtacacgtaccgaagcgacggacccgtagtacccgacgactaccggtcccgggtataccgtaggagtacgttacttcgaccgtgaccctccgagtcccgacggtaacggaacgtcgtaacgccttaacgttanaacgttacgtacggtacgggtcccgggtaccggtaaggggttaaccgtaaggtacgttaagggacctacggttaactaccgtttaaagttaacttacggttaaccgcaaccgtaaagacggtagttaagggtacgtaacgtaggttaaccggggtacgggttaacgggttccgggaacgggtaccgggtaacctaaccgggttacggtaccggttcgttacgggaacctcggaaccctacggttaccgtccccggtacccgttcggaacccgtccttcccggttaccccg

SEQ ID NO: 89451 - DNA, 761 bp, Homo sapiens
  misc_feature: GYAE6OF01A3N9R.21.8.A08.1.454.CMB.1.raw
  modified_base (173)..(173): a, c, t, g, unknown or other
  misc_feature (173)..(173): n is a, c, g, or t
  modified_base (397)..(397): a, c, t, g, unknown or other
  misc_feature (397)..(397): n is a, c, g, or t
  modified_base (463)..(463): a, c, t, g, unknown or other
  misc_feature (463)..(463): n is a, c, g, or t
tcagtcgtcgctcgcacgaccggtgctcgatttagcatactctacaggggggctgtgggctcaggaggcagagctctgggaatctcaccatggcctcggacccctctcctcgcctccccctcctcactttctgcactagtctcgtcgacggcccttcctatgagtctgaccanacgcccacccgtcggtgtcacggtccgaccccgaggaaccgaaaccggcaggactccacctgctcgaggactacttactatacgaaaccaaaagtaacttattacctttggtgttaccagactaaggacgtcgacggaccgaccggtccctagtactcgtctagcctagtcggaccgcgtagtaccggaactaccgccgtaccgggactccggtagagtacgtnttccgtcctccgtccctcgcggactaccgggaacgggtacctacggtcccggtcctaacccggttnaaccgttacggtcggtacgggtaccggggtacccgtagggtacggaacgacggtaaggtacgtaccgtacgtaccttaggttaaccgtttcgaacccgtacaacgtacggtaacgttagggttacggtacggtaacgtacggttaggggttacgggttaccgggtacggggaccggggtaaccggttaacggtaaccgggttccgggttacccgttaccgggttacgaccgtacccggtacccggtacgtccccgttacccgggtcccgttaccgtccgttcgttacccgtcccccgg

SEQ ID NO: 89452 - DNA, 719 bp, Homo sapiens
  misc_feature: GYAE6OF01DWJJI.21.8.A08.1.454.CMB.1.raw
  modified_base (218)..(218): a, c, t, g, unknown or other
  misc_feature (218)..(218): n is a, c, g, or t
  modified_base (349)..(349): a, c, t, g, unknown or other
  misc_feature (349)..(349): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagccacctgatgtcagtcgtcccaggacaacggcaggactcacctgctcgtaggatntcattcgaacaaagtatagtacttgttcgtaccagacagaacgtcgacgccacggccctagtaccgtggtacactccagtcgacgccagtcgacacacgtccggactccgtagagtactactcgtcgtacncccgtcacgtaccgtacgacgggtacgtacggttccgacccttaccttacggtaccttagtaccggtacggggtaccgggtaccggtaacgggtaggaacggtaacgtacggaaccgtactacgttaacctttacgttacgtttaccggtaaccaccgtaaccgaacggtaacgttacggtaacggtaggtaccgtaacggttacggggttaacgggttacggtaccggggaaccggggttaacggtaaccggttaacggtttcccgggtaacccggtttaccgggttaacggtaccgaacccggtacccggtaaaccggtcccgtaacccccggtaccccgttccggttaccctcccgtttaacccccg

SEQ ID NO: 89453 - DNA, 922 bp, Homo sapiens
  misc_feature: GYAE6OF01CKAUD.21.8.A08.1.454.CMB.1.raw
  modified_base (127)..(127): a, c, t, g, unknown or other
  misc_feature (127)..(127): n is a, c, g, or t
  modified_base (132)..(132): a, c, t, g, unknown or other
  misc_feature (132)..(132): n is a, c, g, or t
tcagtcgtcgctcgcacgaccggtgctcgatttagcatactctacgagggggtgggctcaggaggcagagctctgggaatctcaccatggcctcggacccctctcctgcctcccctctactctttcngcacncgtctctgacggtcctacgtatcggacgtctacgaccacgcgtacccaccgttcggttgtacgtacggttcccggtaccccgaagggaaccgaaaccgggcgacggtactaccggtacctggtaccgttacgtagggtaacgttacttacgtacgttacgaaaaccgtaaaagttactttacggttacgttttggttaccgtacgacgtaacgtaacggtacgtaccggaccggtacccgtacccggtcccgtttaaggttaccgtcggtaacctacgttacccgaggtaccggaccggtccgtaacggtccgaaccgtaccgtacccggttccggtaccttaccggtagaacggtacgtttcccgttccgcccgttccgtacccttacgggacgtaccggttacggggaacggtacctcggtacccggttaacccctcgggttaataccgtaacggttcgggtaaccggggtccgggtaaccgggtagggtaacgggaacggttacgtacggtaccggttacgtaacggttaccgttaacgtttacgttaaccggtaccgacgtaacggtaccggttaaggaacgggttacgttacggtacgttaggtacccgggggttagggtaccggtacggggtaacgggtacggtaaccgttacgggttacccggtacccgtttcggtacgggtacccgaaccgggtacccgtccgggttcccgttaccccggtaccccggttacgtacccggttcccggttaaccccgtttccccgttcccccggtttaccccg

SEQ ID NO: 89454 - DNA, 914 bp, Homo sapiens
  misc_feature: GYAE6OF01CO2B1.21.8.A08.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccatggcctcggacccctctcctcgcccttccccctctctacctttcngaccacgtacgtctccgtggacgtccctacctagtgacgctacgaccacgacgtccctacccgtggttacgtcacggttccgtacccccgaggaaacgaaacccggccaaggactaccacgtgaccgttgacgggtactacttcgaacgttacgaaaccaaaaaggttacttacgtttacgttggttacggtacctaaggacgacgtaaacgtccgaaccggaccgtaccggtacccgttacggtacgtccggtactacgtaccgtagtacggaccgaccgtaacgtaccggtaaccgcgtacccgtcccggtacttcccggtaaggtaccgacgttaccgttccgtccgtccgtacccgtacgaccgtaccgtacggtaaccgggtaccgtacgggttaccccggaacccgttaccggtttacggaactttaccgggtaccggtacccgggggttacgggaacccgggtaacgggttaccggaacgtaacggtaacggtaccggttactacggttaacctaacggtttaccgttaaccggttacgaacccgtaacgtaaccgtaaggtacggttaacggtcggtaacgttaccggggtaacggttacgggggttaaccggtacggggtaacccgggtaaggggtaaccggttacgggttaaccggttacccgggttaccgttaccggggtacccgtaaaccgggacccggtaacccggtcccgttacccccggtccccgttaccgtaaccccgttcccgttccccgtttaacccccggg

SEQ ID NO: 89455 - DNA, 858 bp, Homo sapiens
  misc_feature: GYAE6OF01A2CXI.21.8.A08.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagcatactctacaggggctgtgggctcaggaggcagagctctgggaatctcaccatcggcctcggacccctctcctcgcctccccctctctacttctcgcactcgtctcgtcgacgtccttctatgntcgtagacacacgccctacccgtggtcgtcgtacgtccgtacccgaacggaaccgaacggcctaacggtactccaccgtcgtcgttacgtaggaagttacttactacgttacgaaaccgaaaaaagttaacgttacgtttaacgtttcgggttacggttccaggactaaggtaacgtccgaaccggaccgtaccggtcccgtacgttacggtcggtcctaacgtaccgagttcggacgtaccggtaacggacccggaaccgacgtacccgggttccggaaccgttcccgtaggaccgtacgtacctttccgtccgtactccccgtcggaccgtccgtaaccggtaacgggtacgtacggtaccggtcccgttacggtaacgtaccgtttacgtaccgggtacggggtacccgggacgttacggggtaacgtaaccggtaggtaacgtaacgtaccgtaacgttaaccgttaagttacgttaaccggtaccggtacctaaccggaaggtaaccggttaaggttacgggtacgttaaccgggtacgtaccgggggttacggggtacggtacgggaccgggtaacggtaacggttaccggttaccgttaaccggtttcggtacggtaccctacggtaccccggtacggttccctaccccggggtcccgttaccgtacccttccggttcccggtacccccgg

SEQ ID NO: 89456 - DNA, 797 bp, Homo sapiens
  misc_feature: GYAE6OF01BOZGV.21.8.A08.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagcatactctacagggggctgtgggctcaggaggcagagctctgggaatctcaccatcggcctcggacccctctcctcgccctccccctcctctactttctgcacgtagttctcgtaggacggtccttcctagtggacgtccgtagaaccacacgtcccctaccggtcggtntacgtacgttccgtacccgaacggaaccgaaaccggtccaacggtactaccgtaccgttcgtaccgttccggtaggacgttacttacgtattacgaaacctaaaaggtacttacgttacgtttgttcgtaccgagtacgaacgtaaggtccgacgtcccgacgttcccgtagtccgtacggtactacgtccgagtcggaccgctaggtaccaacgaccgtccgaccggtctaccgtagtacggacgttcctacgtcgcgtaccctccgagtccgtaaccggaggtaccctagggcccgtaccttacgttacgtacgtacggacggtaccggggtccggtaaccgtggacggtaccgagtaacggtactacgtaacgtacgtttacgttaccgtacgtaaccacggtaactaagaacgggttacgtacgtacggtaaccgtacggttaacggggttacgttaagggtccggggaagtaccgggttaacgtacgttaccgggtacccttcggtacggaccgtaaccgggtcccgtaaccggtcccgttacccccgggtcccgttacgcccgtttccccgtccggtttacccccg

SEQ ID NO: 89457 - DNA, 912 bp, Homo sapiens
  misc_feature: GYAE6OF01ETPWH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcactagtctcgtgacgtccttcctatgacgtctagacacgacgccctacccgtcggtgtcgtacggtccgtaccccgaaggaaccgaaaccgggccgaaggtactccgaaccgtcgtccgttcggtagggtacgttactttaccgtaacgttacgaaaaccgtaaaaagttaactttaacgtttaccgttttgggttttaccggttacccgaagtaccggtaaagtaaccggtaccgaaccggggtacccgtaacccgggtcccccgtttaaggttccggttaccgggttacctaaccgtttaccgacggttacgggaccggtccgtaacggtacccggaaaccgtaccggtacccggtccgggtaccttcccggtaaggaacgttacgttacgtttcccgtacgtcccgtacccctaccggtacgtacccggtacgggaaccgggttaccgtaacggggttcccggtaacccttacggttaccgtaacgtaacggttcggtacccgggggtaccgggacccgttagggtacgggtaatacggaacggaccgtcgttaacgttacgtttactttacgttcgtaaccgccgtaacggtagtacggtacgggtttaggtaccggtacgtaggggtttacggggtaaggggtttccggtaccggggacggttaaaccgggtacgtttaaacgggtcccgttaacccgggttcggttaccggacgtacccggccggtacggtcccgttacccggcccgttaccggtactccgttcccggtaccccg

SEQ ID NO: 89458 - DNA, 690 bp, Homo sapiens
  misc_feature: GYAE6OF01AUVSL.21.8.A08.1.454.CMB.1.raw
  modified_base (182)..(182): a, c, t, g, unknown or other
  misc_feature (182)..(182): n is a, c, g, or t
  modified_base (231)..(231): a, c, t, g, unknown or other
  misc_feature (231)..(231): n is a, c, g, or t
tcagtcgtcgctcgcacgaccggtgctcgatttagcatactctacagggggctgtgggctcaggaggcagagctctgggaatctcaccatggcctggacccctctcctcgcctccccctcctcactttctgcacagtctctgacggcctctatgacgctagacacacgccctacccgtggtncagtccgtcccgaaggaacaacggcaggactccacctgctcgtggaatnttacagttacgaacaaaagtattacttagttggttcgtacagtacgaagtaacgtcgacggccgacggaccccttgtacgtcggtctaacgtccgagtcgacgtcgacggtcgaacgaccgtaccgtcccgggtaactccgagagtacgtacttcgtctcgcccgtacacggtcgtacggaacggtcgtacgtccgaacccttaccgtggtacctagtcggtcgggtaccgggtccgtagggtacgtacgtagtagtacggtactacgttaataacttcgttacgactccgaacgacggtaactagggttacggtcggtaacgtaggtaacggggttcgggttacggtacccggggaagggtaccggtaaccgtagggtacccgttcggttcccggttagggacctccgggaccgtacgtcccgtacggtcccttaccggttccgtactccggttcccg

SEQ ID NO: 89459 - DNA, 629 bp, Homo sapiens
  misc_feature: GYAE6OF01AJEN5.21.8.A08.1.454.CMB.1.raw
  modified_base (340)..(340): a, c, t, g, unknown or other
  misc_feature (340)..(340): n is a, c, g, or t
  modified_base (483)..(483): a, c, t, g, unknown or other
  misc_feature (483)..(483): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtcgccccaggaccaaacggccaggactcacctgctcgtggagtacttcgattcgaccaaaaagattattacgttgttcggttaccagccagaacgtcaggccaggtcccctgtacgtgtcatccatgacgccagtccgacgacacgtccgggacttcccgnggacgacgtactttccgtcgttcgcccttaccgagtcctaccggacgggtacaggtcggaccctacgttcgacttacgtcgaggtcggggccagggtcgggacgtagtacggaacgtctacgtacttacgttagttcgtaccnctacgagacgtagtacgtagctagtcggtaggggttacgtaccgggcgggtacggtaccgtaaggttcggtacccgttcggttcggacctacggaccccgtaggtccgtacccgtccccgtagtccctaccgttcccgtaccccgg

SEQ ID NO: 89460 - DNA, 776 bp, Homo sapiens
  misc_feature: GYAE6OF01BPC01.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctggacgcctctatgagctacgacacgacgccctacccgtcggtgtcgtacggtccgtaccccgaggaaccgaaaccggtccgaggtactccaccgtcgtcctacgtagggtaacttacttactaacttacgaaactaaaagtaattacgttacgtttaggtttcggtaccagtacgaacggtaagtccggacggacccgtacggtacccccttaggtaccgttacggtacctacgtaccgtaaggtacggtacggaccgtacggtaccggaccgtaaccgccgttacccgggactacccgtggaacgtcgtacttcgtacgtccgaccctacgacgtacgacggtaacgggtctacggcggtacctacgtacgtactacgtacgggtacgggtaccgggtaccgtaggggtacgtacgagtacgtacgtcgttaccgtagttaacgttcgtacgtaccgacgaccgtaggtacgtaggtacgttacggtacgtagggttcgggttacgggtacggtacgggacgggtacggtaaccgtacgggttacggtcgttccggtggtaacccggtccggaccggtaccggttcccgtaccccggttacccggttaccgtccttccggttcccgttccccgg

SEQ ID NO: 89461 - DNA, 840 bp, Homo sapiens
  misc_feature: GYAE6OF01AUMV7.21.8.A08.1.454.CMB.1.raw
  modified_base (593)..(593): a, c, t, g, unknown or other
  misc_feature (593)..(593): n is a, c, g, or t
  modified_base (691)..(691): a, c, t, g, unknown or other
  misc_feature (691)..(691): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctagacacacgccctacccgtcggtgtaccgtagtccgtccccgaaggaaccgaaaacccgggccgaaggtactcctaaccgttcgtctaccggtaggtagttactttaccgtaacgttacggaaaccctaaaaaaggtaactttaacgtttaaccgttttcggtttacgggttacccaacggtaacaacgggttaacggtacggtaaccgggtacccaacgggtaccccccgtttagttaccggttacggttaccgtaacgttccgaacgtacggaaccggtacccgtaccggtaaccgggaacccggtaaccgtaccgggttaaccccggggtaccttaccccggtagggtacgtaacgttacttcccggttacctccgtacccgtaccgtcgtaccgtccgaaggggtacctacgggtcgacccttacgttacncgtagcggtaaggtccgggacagggtgactgtacgaagtcacgtacgtacgttacgttacggtacaaccgacgtacgtacgtacgtagtaccggttanacggttacgggttaggggtccggttacgggacgggtaaccgggtaactacgggttacccggtaccgtttccggttagggaccctacggaccggtaaccggtccgtacccccgggtcccttccgggtacctccgtttcccgggttccccg

SEQ ID NO: 89462 - DNA, 954 bp, Homo sapiens
  misc_feature: GYAE6OF01B6JCH.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctcgcctcccccctctctacgtttctgccacacgttctcgtagacggtccctacctaagtcggacgcgtacggaaccaaccgacggaccccctacccggttcgggtgttccgtaacggttcccggtaacccccgaagggaaacccaaccgggtacccgaagggaccttccgacccgtggtaccttcggagggtaacttacttactaacgttaaccgaaaccgaaaaagttaacttacggtttacgtttcggtttaccggtaaccgaggtaacgtaacggtaaccggtccgaaccgggacccgtaacccggtcccttacggtaccgttacggtactaccgtccggaaggttcggaaccggtacccgtaacgtaacccggaaccttaccggaaccggttacccgggaccctttcccggaaaggtaacctacgttaccgtttcctaaccggtccgtaaccctacccggtaacgtcccggtaaggaccggggttaacaccgggttaccgacccttaggtacaccgttacgtaaccggtcgggtacgggtaccggtacgggtacggtaacggtaacgtaggtaaccggtacgtacgttaaccgttaacgttacggttaccgttacccgaaccgaacgtaacggaacggttaagtaccgggttacgtaccgggttaacggtccggggttaacgggttacgggtaccggggtaaccgggtaacgggtaaccgttacgggtacccggttaccgggttacccggttaggtaaccggtacccggtacccggtaaccggttcccgtaccccgggtacccctaccgggttacccttcccggtttccccgttacccccgg

SEQ ID NO: 89463 - DNA, 844 bp, Homo sapiens
  misc_feature: GYAE6OF01DQ2UI.21.8.A08.1.454.CMB.1.raw
  modified_base (110)..(110): a, c, t, g, unknown or other
  misc_feature (110)..(110): n is a, c, g, or t
  modified_base (136)..(136): a, c, t, g, unknown or other
  misc_feature (136)..(136): n is a, c, g, or t
tcagtcgtcgctcgcacgaccggtgctcgatttagcatactctacagggggctgtgggctcaggaggcagagctctgggaatctcaccatggcctcggacccctctcctncctccccctcctctactttctgcacngtctctggagcctcctatgacgcgtacacacacgcccacccgtggtgtacgtagttccgaccccgaggaaccaaaccggcaggactccgacgtcgcctgtacggatcttacgtacgttaacaaaccgaaaagttaacttactttacgtttggtttaccggttaccaacgtacgtaagtaaccggtacgaccggaccgtaccggtacccccgttgtaccgtacggttacctaaccgtaccgtagtccggaaccggtaccgtaccgtaccggaacctaccgtaccggtacccggtactccggtagacgtacgtacctttccgtctccgtaccgtaccgtacgtccggtaaccggccgggtaaactccgggttaccgtaccccttaacggttaccggtaacgttaccggtaccggtaccgggggtacccgggtaccggtaacggggtaacggtaacggttaagacggtaaccgtacgttacgttaacgttaacgttacgttacgttacccgacgtaaccggtaacaggttaacggttcgtacggtagtcgggtaaccgggttcggggttaccgcggggtaaaccggtacgggtaccgtacggttacccggtaccgtttcgggtacccttaacggccccggttacgtaccggtcccccggttaacccggttccccgtacggttaccctaccccgggttcccttaacccccgg

SEQ ID NO: 89464 - DNA, 689 bp, Homo sapiens
  misc_feature: GYAE6OF01BXFIK.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtntcagtcgtccccaggaccaaacggccaggatcacctgctcgtggagtattcattgaccaaaagatatacttgttggttccagcagagtcaggccaggcccctgactggtcatccatcgaggccagtcgacgactacgtccgggatccctagagagtattcctacttcgcccttccgacgtccgtaccggggactacggtcggcccgtacgtttcgacttacgtacgtacgggtccggggacccgaggggttacggacgtagtacggaaacgtcttacggtaacctttacgttagtttacgttaacccgctaacccgaggtaaccgtaggttaaggtcggtacgtagtccgggttaagggggtttacttccggggacggggtaacggtaacccggttaaggtttacggtaccccggtttaccgttcgggtacccaaccgggtaccccgtaagggtcccttacccgggtccccccgttacgggtaccctcgtttcccgttcccggttaccccccg

SEQ ID NO: 89465 - DNA, 943 bp, Homo sapiens
  misc_feature: GYAE6OF01A6W2A.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctggacgcctcctagtgagctgaacacacgtcccacccgtggtctcgtacgttccgtaccccgaagggaaccgtaaaccggccgaaggactcctacctgtacctcgttaggagtacttactagttacgaaccaaaaagtattaacgttacgtttcggtttacgttaccgaagtacgaaaggtaaacgttccggaacggtacccggtacggtaccccttacggttacgtacggtacctaacctaccggtaaggtaccggacggttaccgaacggttacccggaaccgtaacccgaccgggtacccggttaaccgttccccggtaaggtaacgtaccgttagtttacccggttacgttacccggtaccccttacccggttaacggtaccccgttaaacgggtaaccggggtaaccgtaacccgggggtttaccgaacccccgtttaaccgtttaaccggtaaccgggttacgttaaccggggtaaccggggttacccggggacccgggttaacggggtaccggttaaacgggtaagttaaccggggtaacgttacgttaaccggttaagtttaaccggtttaagtacccggtttaacgaacccgtaccggtaaatacgggttaacggttaggttacggtacggtaacggttacccgggtaaggggtttacggtacgggaaccggggtagggtaaacccgtgggtacccggtaacggtttccggttagtacccggaccgggtaacccgtacgggtaccccgtcccggttaccccgtaacggtcccgtacctttccccgggttaaccccg

SEQ ID NO: 89466 - DNA, 971 bp, Homo sapiens
  misc_feature: GYAE6OF01A33JH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagttcctcgtcggacggcccttacctatggagctcgaaccaacgacgcccctacccgttcgggtagtccgacgttccgtaccccgaggaaaccgaaaaccgggccgaaggtacttcccaaccgttcggtccttacggtaggaatactttaccgtaattaccggaaaccaaaaagttaattaacgtttacggtttcggttttaccggttacccgaagggtacgtaaacggtaaaacgttcccggaacggggtacccgtaaccgggtacccccgtttaccggttaccggttcgggtaccctaacgttaccccgtacggtaccgggaaccggtcccggaacgggtttcccgaaacccggtaacccggtaacccgggttccccggggtaaaccgttccccggtagggtaaaacggtacggttttaaccgttccgttccgtcccgttacccgtaacccgtccggtaccggtaaccggcggggtaaaccgtcgggtaccccgtaccggttaacccgttacgtaaccgttacgtaccgggtacgggtacccgggggtccgtaaccggggtacggttaaacgacgggttaacgaaccggttacgtaaccggttaacttacgttacgttacgtacccgacctaacgacgttaacggacgttacggtagtaccgtacgggttacggggttacgggttaccgggtaccggggacgggaacgggttaaccgttcgggttaaacccgtcccgggtttcggtaccggttaccgtaacccgggacgtaacccggtccccggttacccggtaccccggtccggttacccttaccgtccccgtttaacccccgg

SEQ ID NO: 89467 - DNA, 941 bp, Homo sapiens
  misc_feature: GYAE6OF01CMQHF.21.8.A08.1.454.CMB.1.raw
tcagtcgtcgctcgcacgaccggtgctcgatttagcatactctacaggggggggagaggagcccagcactagaagtcggcggtgtttccattcggtgatcagcactgaacacagaggactcaccagtggtagtttcgggcgtgacgtcgtttcgggtttttccctccgtttgtctttacgtttttaaaggacgggttacgttacccgtaggttcgttccgacgggtaccgaccgtaaacggttggggtagggtaggtccgggttacgggggggaggtccgtaggttaccgggttcccgaacggtccgggttacgggggtaccggttccccgtaggcgtcccttccgttccgttggtccgaccggtcggtccggttcgtacggttacttacggtaacgtttaccgttcccgggttaccttttccggtttaccggccctaaggttccggacccggtcccgggttacccgggtccccggtaccggtacggtccgttaacccgggaaggggacccgggtaaggggggtccggtagggggtccggggttacgggtacgggttaccgtaaaggtttcgttcgggttaaggttagttacggtagggttaaggaaggttacgaaggtagttaactttaaacgttcgttaaacggaccggttacccggtaaccgggtacgggtaaccggtaccttacgttaacccgaccgtaacgtacccgtacgaaagaacccggtaacgtacgtaacccgaaacccaacgtaacctaacgttacgttaacttacgttaaccttaacgtaacgtacccggttcgaccgtaggtaaccaaccgggacccgtagggaccttcgtacttaacgtttagtaccggttaaccgtggtaacggttcgttcgggttacgttacggggcgttaccgggaccggttaccggacccggttgtaccccgg

SEQ ID NO: 89468 - DNA, 760 bp, Homo sapiens
  misc_feature: GYAE6OF01BZ91X.21.8.A08.1.454.CMB.1.raw
  modified_base (125)..(125): a, c, t, g, unknown or other
  misc_feature (125)..(125): n is a, c, g, or t
  modified_base (130)..(130): a, c, t, g, unknown or other
  misc_feature (130)..(130): n is a, c, g, or t
tcagtcgtcgctcgcacgaccggtgctcgatttagcatactctacgagggggtgggctcaggaggcagagctctgggaatctcaccatggcctcggaccctctcctgcctcccctctctacttcngcacngtctcgtgacgcctcgtatgacgtctagacacacgtcccgacccgtggtcgtacacggtccgaaccccgaggaaccgaaaccggcaaggactccacgtcgtcgtcgtaggatcttcacgttacgaacgaaaattatagttacgtttggttcgtacagtacgaagtacggtaccaacggcccgtaaccggtccctagtacggttcggtcctaacgtccgtagtcgggaaccggtaccgtacggaccgaacgaccggtaccggtaccgggtacttacccgaggtaacgtacttcgttcgtccgtcaaccgtcgaacggtccgaacggacgggtaaccgtgtacccggtaaccctacggtcttaacgtacgtcggaacggggtcggtacggagggtcggaacgtgtacgtaggtactacgtaacttacgtttcggtaacgtaccgaacgcgtaaacggtaggttacgggttacggtaggtaccgtacggggttacgggttacggggtaaccgggtcgggaacggtaaccggtacggtacggttaccgttccggttaacggtcgaaccgtaaggcccgtaggcccgtaccgtacccggtcgtacctccgttaccgtccgttaacccccgtcccg

SEQ ID NO: 89469 - DNA, 902 bp, Homo sapiens
  misc_feature: GYAE6OF01DEP9C.21.8.A08.1.454.CMB.1.raw
  modified_base (486)..(486): a, c, t, g, unknown or other
  misc_feature (486)..(486): n is a, c, g, or t
tcagtcgtcgctcgcacgaccggtgctcgatttagcatactctacagggggctgtgggctcaggaggcagagctctgggaatctcaccatggcctggacccctctcctcgccctcccccctctctactttctgccactagtctcgtgaggccctcctatgacgctgacacgacgcccacccgttcggtgtctacgttccgtaccccgaaggaaccgaaaccggcctaggactaccgacctcggcttcgtaggtactcttacagtacgaaaaccaaaataacgttacgtttaacgtttcggttacggttacccgagtaccgtaaagtaccgttaccgaccggaccggtaccggtaaccccgttggtaaccggttcgtacctacgttaccgaggttcggaaccggtcgtaacggtaccgacggtaccgtaccggtccccggtactcccggtaggaacgttagtaccttcgtacctcgtaccccgtacncggtaccacgggacggttaaccgtcgggttcccgaacccttacgttacgaaccgttaccggtacggtaccggggtaccgggtacccggttagggtcccggaaacgttggtacggtaacgtcggttaacgttaccgtttaactacggtttaaccgtaaccgtacggtaaacctacggtaacggttaacgtacgggttacggttacgtaacgggttacgggggtaacgggtttaaccgggggtaccggggtaaacgggtaacccggtttaaccgggtaaaccggtttacccggtaaccccgggttttccggtaaccggggtacctaccccggggtaccccgtacggtttcccccgttacccccggggtacccccgtttacggttccccgttacccggttttacccccgttccccccgg

SEQ ID NO: 89470 - DNA, 930 bp, Homo sapiens
  misc_feature: GYAE6OF01AWZEY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgccttccccctcctcactttctgcacagtctctgagccctctatgagctgacacacgccctacccgtcggtgtcacgttccgtaccccgaaggaaccaaacgggcctaggactccgacctgccttacgtggaacgtattcgtaacgttacggaaacctaaaagtaactttacgttaacgttttggtttaccggttaccgagtaccgtaaaggtacgtaccgaaccgggtacccgtaccggtcccccgtttaggttaccgttcggtccgtaacctccgtaagtaccgggaccggaccctaacgggtacccgaaaccggtaacccgtaccccggttaccccggggtaaccttccccggtaaggtaacggtaacgtttacctttacccgttccgtccccgtaccccgtaccgtaccgtaccggtaccgggaacgggtaccgtacggtccccggtaacccttaccggtttacgtaacccgttagtaccggtaccgggttacccggggcgtaacgggtcggaacggttaagacggtacgtcgttaacgtacttttaacggtacgtttaccggaaccgacccgtaaacgtcggtaacggttacgtttaagggtccggttaaccgtagggttttacgggaaccgggggttttacggtcccggggtaacgggttaaacccgggtaaacgttaccggggtttaaccgttccccggggtttacgtaacggggttaaacccgtcccgggaacccccgttaaccggttccccgttaccccgggtacccccggttaaccggttcccgttccccgtttaacccggtccccccccgg

SEQ ID NO: 89471 - DNA, 886 bp, Homo sapiens
  misc_feature: GYAE6OF01D7KV6.21.8.A08.1.454.CMB.1.raw
  modified_base (489)..(489): a, c, t, g, unknown or other
  misc_feature (489)..(489): n is a, c, g, or t
  modified_base (735)..(735): a, c, t, g, unknown or other
  misc_feature (735)..(735): n is a, c, g, or t
  modified_base (817)..(817): a, c, t, g, unknown or other
  misc_feature (817)..(817): n is a, c, g, or t
  modified_base (872)..(872): a, c, t, g, unknown or other
  misc_feature (872)..(872): n is a, c, g, or t
tcagtcgtcgctcgcacgaccggtgctcgatttagcatactctacagggggctgtgggctcaggaggcagagctctgggaatctcaccatggcctggacacctctcctgccctccccctcctacactttctgaccactgtcctctcggacggtcccttcctaatcgtacgcctaggaaccacgacggaccctacccgtcggtcctacgacggttccggtacccccgggaacgaaaccgggtccgacggtaaccttaccgtaccgttcgaccgttaccggtacgggaagtacgttacggtaacctacgtttaaaccggaaaaaccttttaaaaaaaggttttcgtttttacgggtttttaaccggaacccaaggtaaacgtaaagggtaacgttaccggaccggtaccccgtaaccggttacccggttggttacggtttaccggtaacccttacggtacccgtaaggtacgggtaaaccgggggtaaacncggggggtaacccgtacccggtaccccgggttacggggttaccctacggggtaaggttccggtaaaacgttcggtttcccttaccggggactaaccccgttaccggtaaccgtaacggggaccgggttaccggtaccggtaaccgtaaccggtttagtaacccgtttcggaccgggtacgggttaccgggtaccgggtaggagggtacgtaggtagaacgttcgtacgtaacttgtacctcgtacncgtacacgagtcacgcgaggtctacgagtaccgggtagagttacggtcgggaacggtcgtacggttacgccgagtttaccgngtacccgacggtaccggccgttcccgaccgtcccggttcgaaccctccgggtttnccccccggttaccg

SEQ ID NO: 89472 - DNA, 807 bp, Homo sapiens
  misc_feature: GYAE6OF01BPSB4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgacggcctcctatgacgtctacgacacacgcccacccgttcggtcgtacagttccgtaccccgaaggaaccgaaaccggccgtaaggtactccaccgttgtccttcgtagggtactacttctagttacgaaccaaaaagtattacttacgtttggttacggtaccaagactaaggtacgtaccgaggtacccgaccggtccccctagttaccgtcggtacctaacgttccagtcggaccgtccgtagtaccggtaccgaccgtaccgttccgggtacttcccggtagaacggtacttacctttaccgtctaccgtacccttccgaggtcccgtcgggaacggtacgtacggttaccgcccttaaccgtttggaaccttacggttacggtacgggggtaccggggacccgtaaggggttaccgaacgggttaacgtacgggtaacggtaccgttagtaaaccgtttacgttaacggtttaccgtacccgacgtaacccggtaaagtacgttaggttacggtaccgtacgtaacggttaccggggttaaggggttcctacgggggaccggtaacggtaacttacgggttaccgcccgtttcggtacggacctacgggacccgacgggtcctaccccggtccccgttagtcccttcgtcccgttcccccgg

SEQ ID NO: 89473 - DNA, 810 bp, Homo sapiens
  misc_feature: GYAE6OF01CFTDS.21.8.A08.1.454.CMB.1.raw
  modified_base (135)..(135): a, c, t, g, unknown or other
  misc_feature (135)..(135): n is a, c, g, or t
  modified_base (167)..(167): a, c, t, g, unknown or other
  misc_feature (167)..(167): n is a, c, g, or t
tcagtcgtcgctcgcacgaccggtgctcgatttagcatactctacagggggctgtgggctcaggaggcagagctctgggaatctcaccatcggcctacggacccctctcctgcctccccctctcactttctgcanagtctctgacggccttctatgacgctgacacncgacccaccgtcggtctcgtacggttaccgaccccggaggaaaccaaacgggccaaggtactcctaccgtgtccgtgtaaggacttattccaagttacgaaactaaaagattacttaacggttgttacggttaccagtacgaagaacgtacgacggaccgaccgtaccccgttaggtactaggtccaacgtccgaagtcggacgacccgaagtaccggaaccgtactaccggtaccggtactacccgtaggaacgtagttaacttctccgtacgtacccgacgacggtacttagggaaccggtacacgggttcccgaaaccctttacggtaacgtaactacgtacgggtacggtacccggggaccggtacgggtaaacgacggtaagtaacggtaaacgtcgtaacgtaacggttaacctttaggttaaccgttaaccggaacctaacgtacgaacgttaacgggtcgttacggtacgtaagttaccggggttaacggggttacgttaccggggaacgggtaaccggtaaacgttaccggttaacggtaccccggttagtaaccgggtactacccggaaccggtaaccgggttcccgtaccgtacccccggttagtacccccttcgtcccgtttaacccccgg

SEQ ID NO: 89474 - DNA, 857 bp, Homo sapiens
  misc_feature: GYAE6OF01A5DQH.21.8.A08.1.454.CMB.1.raw
tcagtcgtcgctcgcacgaccggtgctcgatttagcatactctacagggggctgtgggctcaggaggcagagctctgggaatctcaccatggcctcggaccctctcctgcctcccctcctctactttctgcactacgtctcgtgacggtcctcctatgacgctagaccacgaccgcccgtaccgttcggtcgtctacggtaccgtaccccgaagggaaccgaaaccgggccgtaaggtactacctaccgtcgtccgttccgtagggactacttacctacgttacgaaaccaaaaagtaattaacgtttacgttacggttacggttacctaaggacgtaacgtaacggtcgaacggtccgaccggtacccttaggtaccgtacggtactacgttaccgagttacgggaccggtaccggtacggtaccgtaaccggaccggaacccggttcccgggtaacctaccggtaacggtagtacgttacttaccgtcgttacccgtaccgtaccgacgtcccggtacgaacgggtacgtacggtacccgttaccgtaccgttacgtacgttaccgtcggtaccgggtaccgggtacgtacggggtacgtacgtacggacggtacgtacgtacgttaacgttcgttacgttccgtaaccacgtaacgtaagtacgtaacggtttacggtaacggtacgtaacgggttcggggtaacggggttaaccgggtacgggtaccgggttaacggtacggttaacgggttaccggtaaccgttccgggttacggtaccggtaccgtaccggggtaccgtcccggttacccgttccccggtacggtcccgtacgtttccccggtacccccgg

SEQ ID NO: 89475 - DNA, 918 bp, Homo sapiens
  misc_feature: GYAE6OF01AXTFD.21.8.A08.1.454.CMB.1.raw
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
  modified_base (526)..(526): a, c, t, g, unknown or other
  misc_feature (526)..(526): n is a, c, g, or t
  modified_base (562)..(562): a, c, t, g, unknown or other
  misc_feature (562)..(562): n is a, c, g, or t
tcagtcgtcgctcgcacgaccggtgctcgatttagcatactctacagggggctggtgggcgtcgaggaggcgagagctcgtgggaatcgtcaccagtggcctcggaccccgtcttccacgtcctccccctcctccctacttttccgtgtccacgtactccgtcgtacggaaggtcccttccgttactcggtacgccgttcgaactaccncgtaccccaccccggttcgggttcgtcgaacgttccgtaccccggaaggaccgaaaccgggtccgaagggtacctcccgaccgttacgccgttccgtaggggtaanctttacctacggggttacgtaaacccaaaaaggtaaaactttaggtaaacctttttttcggtttacggttaccgtaaccgttagacggttaaacggtaccgtaaccggggccgtaaccggccgttaacgttacggtcggttacaccgtacgtactacggccggtaaccgaggtcccgtaagtaaccgtaccgaaccgggtcttaaccccgngacggtacgttaccggtacccttcggtccgtaaacnccccgtaagggtccccgtagggtaacgtaccgtaacgggttaccggtcccggttacctaaaccggggtacttacgttccggtaacggtccggggtaccgggtaacgggtaccgggtaaggaccgtaggacggtacctagggtacgtaaccgttagtttaaccgtctaaccggtacgaacggttaccgaagtaccgggtatacgtcggtttaacgggaacgggtttggtaacccggtaacggggttcgggaaccggttacgtacggttacccggtacgggtaccggttcgaaccgggtttaccgaccgggaccggtacccggttcccgacccggtttaccggccctacgttacccgg

SEQ ID NO: 89476 - DNA, 785 bp, Homo sapiens
  misc_feature: GYAE6OF01AMJCQ.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttcngcactgtctctgacggccttcctagtgacgcgtagaccacacgcccgacccgtggtcgtcgacgtccgtaccccgaggaccgaaacggccgaggactccgacctcgctcgagtagtacttcgagttacgaacaaaagttactagttacgtttcggtcggtaccgagtacgtagtaacgtcgaacggtccgtaaccggtccccgtagtacgtcggtacaccgttaccgtagtacggaccggacgtaggtaccgaaccgtaccggtaccgtccgggtaaccttccgaggaacgtacgttacgttcccgttacgccgttaccccgacggagtcccgtcgggaaggtacccgtaacgggtccgggtaaccctaccggttacgtaccgttacgtccgggtaacgggtacccgggaccggtagggaccgtaacggtaacggtacggaacgtcggttaacgtacgtttaaacgtcgtttaccggacctacggaactacggtacggtcggttaagccggtacgtaggttaaccgggtaggggtcctacgggggaacggtagtaacgtaccgggttaccggtaccgttaccggtggacccggtaccggacgtacccggtccggttacccccgacggtttacgacccttccgtacccgttccccg

SEQ ID NO: 89477 - DNA, 778 bp, Homo sapiens
  misc_feature: GYAE6OF01B2AG9.21.8.A08.1.454.CMB.1.raw
  modified_base (180)..(180): a, c, t, g, unknown or other
  misc_feature (180)..(180): n is a, c, g, or t
  modified_base (327)..(327): a, c, t, g, unknown or other
  misc_feature (327)..(327): n is a, c, g, or t
  modified_base (455)..(455): a, c, t, g, unknown or other
  misc_feature (455)..(455): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (520)..(520): a, c, t, g, unknown or other
  misc_feature (520)..(520): n is a, c, g, or t
  modified_base (592)..(592): a, c, t, g, unknown or other
  misc_feature (592)..(592): n is a, c, g, or t
  modified_base (599)..(599): a, c, t, g, unknown or other
  misc_feature (599)..(599): n is a, c, g, or t
  modified_base (622)..(622): a, c, t, g, unknown or other
  misc_feature (622)..(622): n is a, c, g, or t
  modified_base (673)..(673): a, c, t, g, unknown or other
  misc_feature (673)..(673): n is a, c, g, or t
  modified_base (696)..(696): a, c, t, g, unknown or other
  misc_feature (696)..(696): n is a, c, g, or t
  modified_base (738)..(738): a, c, t, g, unknown or other
  misc_feature (738)..(738): n is a, c, g, or t
tcagtcgtcgctcgcacgaccggtgctcgatttagcatactctacgagggggggagaggagcccagcactagaagtcggcggtgtttccattcggtgatcagcactgaacacagaggactcacagtggtaggttgggctgagtcgttcgggtttccctcttcgtcttacgttttaaaggnggttcgtaccctaggtcgtaccgacggtccgacgtaacggtggggtgggtaacggtcgggtaggggggacgcgtacggttgggtcccagggccggttagggggtacgtccccgtaggtacgtccccttctaccggtgtggtacccgnggtcgtcggttaggtacttaccgagtaccggttcggtccctttcgttcgccctagtcggtacccgtcgggtccggggtacccctcggacggttcccaccggtaaggacccgggtagggcctaaggggnggttcgggacggtactttagtcggttcgaaggttgnggttaaagngggtaaaccgtgaacggttntaacgttaccgtttgaaccgtaacgtcccggagggttaacgacggtctactaccgtacgtactacccggtanacgtaanaccgtaaacgaccgaaccgtaanacctacgtacctttagtaactacgtaccgtaacgccggtaccgtaccggancggacgtaccggagaccggtacnggttacctagtaaccgttggtactacggttgtacgggtttancgggtacggttccggaacgtaccggtaccggtgtaccccg

SEQ ID NO: 89478 - DNA, 739 bp, Homo sapiens
  misc_feature: GYAE6OF01A5OTH.21.8.A08.1.454.CMB.1.raw
  modified_base (127)..(127): a, c, t, g, unknown or other
  misc_feature (127)..(127): n is a, c, g, or t
  modified_base (155)..(155): a, c, t, g, unknown or other
  misc_feature (155)..(155): n is a, c, g, or t
  modified_base (180)..(180): a, c, t, g, unknown or other
  misc_feature (180)..(180): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagtcgtcgctcgcacgaccggtgctcgatttagcatactctacgagggggtggctcaggaggcagagctctgggaatctcaccatggcctcggacccctctcctgcctccccctcctcactttcngcacagtcctctgacggcctcctatganctgacacgacgcccacccgtcggtntccagtcgcccaggaacgaaccggccgagactcacctgcctgngatntcattnaacaaaatntactacttgttcggtaccnacgagtagtcgngccacggtcccgtgtacgngtacnctcgagtcggacgcgtagaccgtacggaccctaccggtccggctccgtaggacgtagtacttccgtctaccgtccctcgactccgtaaggaccgggtactacgggtccgtaccctaccgttagtacctaggtccggtacgggcccgggtacccgtagggtccgtaacgacgtaacgtacggtactaacgttaccttacggttagtttacccgtaccgaacgtacccggtaagtacggttaggtaccggttaggtaacggttaccggtacggggggttaacggggtttaccggtacgggggtaaccgggtacgggttaacccgtacgggtttaccgggttacccggttcgttaacgggtcctaaacccggcggtaaccgtccggtccccgtacccgttacgggttcccacccgtttccgtttccccggtaacccccttccccg

SEQ ID NO: 89479 - DNA, 887 bp, Homo sapiens
  misc_feature: GYAE6OF01CSPSH.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttcngcacagtctctgacgcctctatgagctgacacacgccctaccgtcggtctcgacgttccgaccccgaagggaaccgaaaccgggcctaagggacttaccaacccgttggccctttcggtagggaactattttaccaagtttacggaaaacccaaaaaaaggtatttacgtttaaccggttttggttttacggttaacccgaaggtaccgaaggtaaaacggttccgaacggggtaccccacggggtaccccctttaggttaaaccgttcgggtacccttaaccgacccgtaaaggttccggaaccggacccgtaagggttacccggaaaaccgaacccgtaacccggtttaccccgggggaacctttccccggtaagggaacgaaacggttttacctttccggtcctttaaccggccccgttacccgtaaacgggcccttaaccggggtaacggggacctaacggggtccccggtaaccccgttaacgtttacgggaactttaccggtacgggtacggggttacccggggaccccggttaaggggttacgaaccggtaagttacggaaaccgtcgtacgtaacgttacgttagttacgtaccacgtacgaacgtactaaggtacgttacggactaggtacggggtaagggttaccgtacgggaacgggtacgtaaccgtacggttcggtaaccgttcggtaggaccgacgtacccgacgtcccgtccgcccggttagccctaccgttcgttacccccgg

SEQ ID NO: 89480 - DNA, 974 bp, Homo sapiens
  misc_feature: GYAE6OF01DQXBE.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctcgtgacgtcctcctaagtgaagtctagacctacaccggtccctacccgttcgggtgtaccgtacggttccgtacccccgaagggaaaccgtaaaaccgggccaaaggtaccttcccaaccgttcggcccttaccgttaggggaacttactttaccgtaacggttttaaccggaaaccgtaaaaaaaggtaacttttacttaaccggttttacgggttttaccggttacccaaaggtaccgtaaaacggtaaccggttaccgaaccgggaccgtacccgggtacccccctttaggtaaccggtcggtaacctaacgttacccgaaggttcggaaccggtcgtaaccggtaccggaaccgtaaccgtaccggtccgggtactcccggtaagaccgttacgtacgttcctaccgcgtaccctacgacgtccgtaacggacggtacgtccgggttcgaaccccgttacgttaccgtaaacttcggtaaccggtaccggggtaccggggaacccgtaaggggtaccggtaacgtgttaacgaacggtttccgaacggtttaacctttaaccggtttaggtttacccgggtaaccttacccgaacggtagtaaacggttgttacgggttaaccgtacgttaccgggtaggggttaaccgggggtttaacgaccggggtaaccggggtaaaaccgggttaccgttacggggtttaaccccgtccggggttttaacccgtaagggaccccgttaaacgggggacccccgttaacgggttcccccgacccccggttacccccgggttccgttaccccgttcccggttaaccccgtttaccccccgg

SEQ ID NO: 89481 - DNA, 754 bp, Homo sapiens
  misc_feature: GYAE6OF02HMO9S.21.8.A08.1.454.CMB.1.raw
tcagtcgtcgctcgcacgaccggtgctcgatttagcatactctacaggggctgtgggctcaggaggcagagctctgggaatctcaccatggcctggacccctctcctgctccccctcctcactttctgcacaggctctgaggcccctctagtgacgcgtacgacacgacgacccctacccgtcggtcgtacgaggttcccgtacccgaaggaacgacgggacccggaccgaaggtactaccctaccgtcgtccttcgtcgacgaagtacggtacggtactaccgaaaccgaaaaagtaaaattagtcgttacttttaaggttaccggtaaaccaacgaaggaaccgaccggacggacccgaccggtccccgttggttacggtttacggagtaattaagttaaagtaaaacggacctaacgtaggaacgggacccggtcccctacgaaggaacgtacccttacccgtaggacgtacgttactttccgtacggtcggtaccctacgacgtcctaacgggaacgggacacgacgtacgtaccgtacggttacgtaacttacgtacgtaggtacgtaacgtaccgacggacgaagggaacgggaacggacggtacgtagtaactttaacgttacgttagaaacccaaagtggtaacgaacgtaaggtaagtaacgtactagttaggttgggttacgtcgggacgggacggacaggtcgtaccgtaccgtcgtaggtacgaccgaccgtcgctccccgg

SEQ ID NO: 89482 - DNA, 538 bp, Homo sapiens
  misc_feature: GYAE6OF02JTAN5.21.8.A08.1.454.CMB.1.raw
  modified_base (218)..(218): a, c, t, g, unknown or other
  misc_feature (218)..(218): n is a, c, g, or t
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgatgcctcctatgagctgacacagccaccctcggtgtcagtcgtccccaggacaaacggccaggatcacctgctctgganattcattgaccaaaagaatatacttgttggttccagcagaagtcaggccaggcccctgtactggtcatccatgaggccagtcgacgacacgtccgggatcccgtagagagattcnctgacccttccagcctacgagggacagtcggccacgtttgactactcgagtcgggcccaggtggaacgagtgaagctagactactattgtaacgcaccgagacagtagtggtacagttcgaggggttatcggacgggacggactaggtcgaaccggttcgttggtccagtcccgaaggtcctacgccccgtcggttccacttccg

SEQ ID NO: 89483 - DNA, 563 bp, Homo sapiens
  misc_feature: GYAE6OF02HSCXC.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctagagagtattctctgccctccagctcgagggacaggtcggacccacttgacttatcgaggtcggggcccgaggtggacgagtagaagctgacttacttattgttacgacaccagacagtagtgtacagtcgaggggtattcgggacggtagggaccgtaaggttcggacccggttccgtttacggacacggaccccgaaggtcctccggcccccgttcgggtcccaccgttccgttcccg

SEQ ID NO: 89484 - DNA, 528 bp, Homo sapiens
  misc_feature: GYAE6OF02GEUP1.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctcgctcccctcctcactttctgcacagtcgtctgaggcctcctagtgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacactccgggatcccgtgagagacttctctcgcctccagctcagggacagtcggccctacttgactatcaggtcgggcccaggtggacgatgaagctgactactattgttacgcaccagacagtagtggtcagtcgaggggttattcgggcggagggaccagttcgaccggttcgttggtcacggcccaaggctcggcccccgtcggtccacctcgtccg

SEQ ID NO: 89485 - DNA, 555 bp, Homo sapiens
  misc_feature: GYAE6OF02ILRU5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggccccctgtactggtcatccatgaggccagtcgacgacacgtccgggatcccgtgagagtattctctgccctccagctcgagggacagtcggcccacttgactatcgaggtcggggcccagggtggacgatgaagctagacttactattgttacgcaccagacagtagtggtcagtcgaggggttatcgggacgggtagggaccgtaggttcgaccggttccgttcggtcacggccccgtaagggccctcggccccccgttcgggtacctaccgtccgttcccgg

SEQ ID NO: 89486 - DNA, 533 bp, Homo sapiens
  misc_feature: GYAE6OF02IMDY6.21.8.A08.1.454.CMB.1.raw
  modified_base (524)..(524): a, c, t, g, unknown or other
  misc_feature (524)..(524): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcgagggacaggtcggccaccgttgactatcgaggtcgggcccaggtggacgagtgaagctgacttactattcgttacgctacagacagtagtggtcagtcgaggggttagttcgggacgggagggaccgtaggttcgaccggttccgttggtcacgcccgaaggcctcggccccctcggtccnccgtctccg

SEQ ID NO: 89487 - DNA, 520 bp, Homo sapiens
  misc_feature: GYAE6OF02HHHPP.21.8.A08.1.454.CMB.1.raw
  modified_base (451)..(451): a, c, t, g, unknown or other
  misc_feature (451)..(451): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatcccgtgagagattctctgcctccagctcgagggacagtggccacttgactatcgaggtcgggcccaggtggacgatgaagctagactactattgttacgcaccagacagtagtggtcagtcgaggggtattcggngggaggaccgaggttgaccggtcgttggtcgacgcccgaaggcgtcgccccgttcggctacgtctcccg

SEQ ID NO: 89488 - DNA, 502 bp, Homo sapiens
  misc_feature: GYAE6OF02GEV9R.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtcggccacttgactatcagtgggccaggtggacgatgaagctgactactattgttacgcaccagacagtagtggtcagtcgaggggtatcggcggagggaccagttcgaccgtcttggtcagcccgaaggctcgcccctcggtcacgtctcg

SEQ ID NO: 89489 - DNA, 501 bp, Homo sapiens
  misc_feature: GYAE6OF02H0G7I.21.8.A08.1.454.CMB.1.raw
tcagtcgtcgctcgcacgaccggtgctcgatttagcatactctacagggggagaggagcccagcactagaagtcggcggtgttccattcggtgatcagcactgaacacagaggactcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggctcctttgccatgcactgggtccgcaggctccaggcaaggggctggagtgggtggcgattatctggtatgatggaagtgagagatatatcagactcgtgaaggcgatcacatctcagagacaatagaccaacaacacactgtatcttacaaatagaccgcctagagagccgaggacacgctatgtatactgtacgagtcttggtctagttcgggacgacgggacccgtggtaccg

SEQ ID NO: 89490 - DNA, 489 bp, Homo sapiens
  misc_feature: GYAE6OF02F766H.21.8.A08.1.454.CMB.1.raw
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (486)..(486): a, c, t, g, unknown or other
  misc_feature (486)..(486): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacacgtccgggatcccgtgagagattctctgcctccagctcagggacagtggccacttgactatcagtcgggccaggtggacgagtgaagctgacttactattgtacgcacagacagtagnggtcagtcgaggggtatcggnggaggacagtgacgtctggtcagccgagctcgccctgcactntcg

SEQ ID NO: 89491 - DNA, 567 bp, Homo sapiens
  misc_feature: GYAE6OF02IML16.21.8.A08.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagcatactctacagggggtgggctcaggaggcagagctcgtgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgccaaaagactaatacttgttggtccagcagaagtcaggccaggcccctgtacctggtcatccatgaggcagtcgacgacgaccgtccgggatcccgtgacgacgattcnctgccctccagcctcgagggacaggtcggccacgttgacttatcgaggtcgggccctagggtcggacgagtgaagctgactactagttgtacgccaccagacagtagtggtacagtgaggggttagtcggcggagggtaaccgtaaggttcggaccgttcggttacggtcgtacgccgtaacggcgtacggcccccgttcgggtccaccgtccgttccgttcccctaccccg

SEQ ID NO: 89492 - DNA, 517 bp, Homo sapiens
  misc_feature: GYAE6OF02GTWDB.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgccaaaagatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgacttactattgttacgcaccagacagtagtggtcagtcgagggggtattcggcgggagggaccagttcgaccggttcgttggtcacgcccgaaggctcggccccgtcggtcaccgtcgttccg

SEQ ID NO: 89493 - DNA, 504 bp, Homo sapiens
  misc_feature: GYAE6OF02F9RQC.21.8.A08.1.454.CMB.1.raw
tcagtcgtcgctcgcacgaccggtgctcgatttagcatactctacaggggcgtgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatccctgagagattctctgcctccagctcgagggacagtggccacttgactatcagtcgggccaggtggacgagtgaagctgactactattgttacgcaccagacagtagtggtcagtcgaggggtattcggcgagggacagttgaccgtcgttggtcgagccaaggctcgccccgtcggtcacgtctccg

SEQ ID NO: 89494 - DNA, 583 bp, Homo sapiens
  misc_feature: GYAE6OF02IYR0Z.21.8.A08.1.454.CMB.1.raw
  modified_base (221)..(221): a, c, t, g, unknown or other
  misc_feature (221)..(221): n is a, c, g, or t
  modified_base (324)..(324): a, c, t, g, unknown or other
  misc_feature (324)..(324): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatcccgngagagattctctgccctcagctcgagggacagtcggccctaccgttgaacctagtcgaggtcggggacccgagggtcggacgagtaggaagcgtagtaaccttacttagtttcgttaaccgcctaaccgagactaggttaggtacggtactagtacggtagggggttatcgggacgggaagggaccgtaggttcgaccggttcgtacggtacgacgacccgaaggcctccggcccccgtcggtacctacgtcgtacccg

SEQ ID NO: 89495 - DNA, 511 bp, Homo sapiens
  misc_feature: GYAE6OF02IMASY.21.8.A08.1.454.CMB.1.raw
  modified_base (504)..(504): a, c, t, g, unknown or other
  misc_feature (504)..(504): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacactccgggatccctgagagattctctgcctccagctcagggacagtcgccaccttgacctatcaggtcgggcccagggtcggacgagtgaagctgacttactattgttacgcacagacagttagtgtacagtcgaggggtattcggcggagggacagttgaccgtcgttggcagcccaaggctcgccccgtcggtcnctctccg

SEQ ID NO: 89496 - DNA, 508 bp, Homo sapiens
  misc_feature: GYAE6OF02JTAF4.21.8.A08.1.454.CMB.1.raw
  modified_base (386)..(386): a, c, t, g, unknown or other
  misc_feature (386)..(386): n is a, c, g, or t
  modified_base (442)..(442): a, c, t, g, unknown or other
  misc_feature (442)..(442): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgccaaaagatatacttgttggttccagcagaagtcaggccaggcccctgtactggtcatccatgagccagtcgacgacactccgggatcccgtgagagattctctgcctcagctcgagggacagtcggccaccttgactatcagtgggccaggtggacgngtgaagcgtgacttactattgttacgctaccagacagtagtgtcagtcgaggggtntcggcgaggacgagtgaccgtcgtgtcgacgcccgaagccgtcgccccgtacggtcacgtctccgg

SEQ ID NO: 89497 - DNA, 502 bp, Homo sapiens
  misc_feature: GYAE6OF02I04LL.21.8.A08.1.454.CMB.1.raw
  modified_base (405)..(405): a, c, t, g, unknown or other
  misc_feature (405)..(405): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatccctgagagattctctgcctccagctcagggacagtggccacttgactatcagtcgggcccaggtggacgatgaagctgactatattgtacncaccagacagtagtgtcagtcgaggggtattcgggcggagggaccagttgaccgtcgttggtcagcccgaaggcctcgccccgtcggtcactctccg

SEQ ID NO: 89498 - DNA, 503 bp, Homo sapiens
  misc_feature: GYAE6OF02HJH65.21.8.A08.1.454.CMB.1.raw
  modified_base (444)..(444): a, c, t, g, unknown or other
  misc_feature (444)..(444): n is a, c, g, or t
tcagtcgtcgctcgcacgaccggtgctcgatttagcatactctacaggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatccctgagagattctctgcctccagctcgagggacaggtgccaccttgactatcagtgggcccagggtgacgatgaagctgactactattgttacgcaccagacagtagtggtcagtcgaggggtatcggnggaggaccagttgaccgtcgttggtcagcccgaaggcctcgcccctcggtcactctccg

SEQ ID NO: 89499 - DNA, 510 bp, Homo sapiens
  misc_feature: GYAE6OF02H5CRO.21.8.A08.1.454.CMB.1.raw
  modified_base (218)..(218): a, c, t, g, unknown or other
  misc_feature (218)..(218): n is a, c, g, or t
  modified_base (502)..(502): a, c, t, g, unknown or other
  misc_feature (502)..(502): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctcctatgagctgacacagccaccctcggtgtcagtcgtcccaggacaaacggccaggatcacctgctctgganattcattgaccaaaagatatacttgttggttccagcagaagtcaggccaggcccctgtactggtcatccatgagccagtcgacgacactccgggatccctgagagattctctgcctcagctcgagggcagtcggccaccttgactatcgagtcggggcccagggtcggacgatgaagctgactactattgttacgcaccagacagtagtggtcagtcgaggggtattcggcggagggacctagttcgaccgtcgttggtcgagccgaggctcgcccctcggtcnctctcccg

SEQ ID NO: 89500 - DNA, 534 bp, Homo sapiens
  misc_feature: GYAE6OF02HWT03.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctctgganattcattgaccaaaaagatatacttgttggttccagcagaagtcaggccaggcccctgtactggtcatccatgagccagtcgacgacacgtccgggatccctgagagattctctgcctcagctcagggacaggtcggccctaccttgacttatcgaggtcggggcccagggtggacgatgaagctgacttactattgttacgcacagacagtagtggtcagtcgaggggttatcgggcggagggacctaaggttcggaccgtccgttggtcacggacccgaaggcctcggcccccgtcggtccaccgtcgttccgg

SEQ ID NO: 89501 - DNA, 523 bp, Homo sapiens
  misc_feature: GYAE6OF02GSNYA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacactccgggatccctgagagattctctgcctccagctcagggacagtcggccaccttgactatcagtcggggcccaggtggacgatgaagctgactactattgtacgcaccagacagtagtgtcagtcgaggggtacttcggcggagggaccaggttcgaccggttcgttggtcacgcccgaaggcctcggcccccgttcggtcctacctcgtcccgg

SEQ ID NO: 89502 - DNA, 497 bp, Homo sapiens
  misc_feature: GYAE6OF02IZCSY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtgtcccaggacaaacggccaggatcacctgctctggagattcattgaccaaaaagatatacttgttggttccagcagaagtcaggccaggcccctgtactggtcatccatgagccagtcgacgacactccgggatccctgacgagattctctgcctcagctcagggacagtgccacttgactatcagtgggccaggtgacgatgaagctgactactattgtacgcaccagacagtagtggtacagtcgaggggtattcggacgagggaccagtgaccgtcgtggtcacgccgaaggctcgccccgtggtcacgtctccg

SEQ ID NO: 89503 - DNA, 520 bp, Homo sapiens
  misc_feature: GYAE6OF02GZ861.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatcccgtgagagacttctctcgcctccagtctcgagggacagtcggcctaccttgactatcgaggtcgggcccaggtcggacgatgagctgactactattgtacgctacagacagtagtgtcagtcgaggggtcttcggcggaggactagttcgaccgtcgttggacgacgaccgtagctcgtccccgtggtccacgtctccgg

SEQ ID NO: 89504 - DNA, 830 bp, Homo sapiens
  misc_feature: GYAE6OF02I9NT0.21.8.A08.1.454.CMB.1.raw
tcagtcgtcgctcgcacgaccggtgctcgatttagcatactctacaggggctgtgggctcaggaggcagagctctgggaatctcaccatggcctggacccctctcctgctcccctcctcactttctgcacagtctctgaggcctcctatgagcctagacacacgacccaccgtggtcgtacgtagtccgtacccgaggaaccgaaaccggccgaaggtactacctaccgtcgtccttcggtagggatacttactagttccgaaaccaaaaagtaattaacttacgtttggtttaccggttaccgaacgtacgaaggtaacgtaccgaacggaccgacccggtcccccgttaggttaaccgttcggtacctaaccttacctagtacggaccggaccgtacggtaccggaaccgtaaccgtacccggtaccgggtaaccttcccgtaggaacgtaacgttacctttccgtcgtccgtccccttaccgacgtccgtacggaacgggtaaccgtacgggtaccggtaccccttaacggttacgtaaccttacgtaccggtacggggtcccggggacccgtaggggtacgggaacgtaggtaacggaacgtcggtaacgtaaccttaacgtttagtttcggttaaccacctaaccgagtaacgtaagggttacgtcggtacaacggttacgggaaggggtttccgtccggggaacgggtaacggtaaccgttaggtttaccggaccccgtttacgggttcgtaacgacccggtaacccggtagggttcccgtccccggtaccccgttcggtaccctacccgtttccgttccccgg

SEQ ID NO: 89505 - DNA, 500 bp, Homo sapiens
  misc_feature: GYAE6OF02F1YX0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgacttactattgttacgcaccagacagtagtggtcatcgaggggtatcgggcggagggaccagttgaccgtctggtcagcccaaggctcgcccctggcactctcg

SEQ ID NO: 89506 - DNA, 511 bp, Homo sapiens
  misc_feature: GYAE6OF02H3BWN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtcccaggacaaacggccaggatcacctgctctggagattcattgaccaaaagatatacttgttggttccagcagagtcaggccaggcccctgtactggtcatccatgagcagtcgacgacactcgggatccctgagagattctctgcctcagctcgagggacagtcggccaccttgacttatcgaggtcggggcccagggtcggacgatgaagctgacttactattgttacgcaccagacagtagtggtcagtcgaggggtattcggcggagggaccagttgaccgtcttggtcacgcccgaaggctcggcccctcggtcacctctccg

SEQ ID NO: 89507 - DNA, 509 bp, Homo sapiens
  misc_feature: GYAE6OF02GFBAP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgcctccagctcagggacagtggccaccttgactatcagtgggcccaggtggacgatgaagctgactactattgttacgcaccagacagtagtgtcagtcgaggggtattcggcggagggaccaggttcgaccgtccgttggtcagcccgaaggctcggcccctcggtccactctccg

SEQ ID NO: 89508 - DNA, 502 bp, Homo sapiens
  misc_feature: GYAE6OF02F7T8R.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacacgtccgggatccctgagagattctctgcctccagctcgagggacagtcggccacttgactatcagtgggccaggtgacgatgaagctgactactattgttacgcaccagacagtagtggtcagtcgaggggtattcggcggaggacagttgaccggtcttggtcacgccaaggctcgccccgtggtctactcgtccg

SEQ ID NO: 89509 - DNA, 508 bp, Homo sapiens
  misc_feature: GYAE6OF02JDI1T.21.8.A08.1.454.CMB.1.raw
  modified_base (331)..(331): a, c, t, g, unknown or other
  misc_feature (331)..(331): n is a, c, g, or t
  modified_base (454)..(454): a, c, t, g, unknown or other
  misc_feature (454)..(454): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattcnctgcctccagctacgagggacagtcggccaccttgactatcaggtcgggcccagggtgacgatgaagctagactactattgttacgctaccagacagtagtgtacagtcgaggggtatcgggnggagggaccagttcgaccgtcttggcagccgagctcgcccctggtcactgtccg

SEQ ID NO: 89510 - DNA, 526 bp, Homo sapiens
  misc_feature: GYAE6OF02F1RJ0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagattctctgccctccagctcgagggacagtggcccactttgactatcaggtcgggcccagggtggacgagtagaagctgacttactattgttacgcaccagacagtagtggtcatcgaggggtatcgggcggagggacgagttcgaccgttcgttggtcacgcccgaaggcctcggcccctcggtcctaccgtcttcccg

SEQ ID NO: 89511 - DNA, 708 bp, Homo sapiens
  misc_feature: GYAE6OF02J19R8.21.8.A08.1.454.CMB.1.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
tcagtcgtcgctcgcacgaccggtgctcgatttagcatactctacaggggcgtggtgggcgtcgaggaggcgagagcgtcgtgggaatcgtcaccatggcctggacccctcgtcctcgctccccctcctccactttcctgtccacacgtctctgaggcctcctactgagctgacacagccaccctcggtgtcagtcgtccccaggaccaaacgggccaggactcaccctgctcctggagattcattgacctaaaaggaactatacttgttgttccagtcaggaatcaagccaggcccctgtaccnggtcagtccatcgaggccgatccgagacgacnccggggatccccgtagagagcttacnctgaccttccaaggctccaggggacaggttggacccgactttggacttatcgagtcgggcccagggtacggacggacgttgggaagccgtaggtactaacgttactttacgtttaacggccttacccgaaggtaaccgtacggttaacgtacgggttcctaaggtccgtaaagggggtttgtttaacccggggcgggttaaccggggtaacccgggtaaagggtttccggtaaacccggtccccgggtttacgggtaccggttaacggtaacccccggaagggttaccccgtccgggaacccccccgtttccggggtacccctaaccgggttccccttacccggg

SEQ ID NO: 89512 - DNA, 524 bp, Homo sapiens
  misc_feature: GYAE6OF02FSXVU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgcctccagctcgagggacaggtcggccaccttgactatcgagtcggggcccagggtggacgagtggaagctagacttactattgttacgcaccagacagtagtgtcagtcgaggggttatcgggcggagggaccgaggttcgaccggttcctggtcacgcccgaaggcctcgccccgtcggtccactctccg

SEQ ID NO: 89513 - DNA, 514 bp, Homo sapiens
  misc_feature: GYAE6OF02H7BD6.21.8.A08.1.454.CMB.1.raw
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacactccgggatcccngagagattcnctgcctccagctcgagggacagtggccaccttgactatcaggtggggcccagggtggacgatgaagctgactacttatgttacgcaccagacagtagtggtacagtcgaggggttatcgggcggagggaccaggttcgaccgtcttggcacgcccaaggctcggcccctggtcacctctccg

SEQ ID NO: 89514 - DNA, 513 bp, Homo sapiens
  misc_feature: GYAE6OF02H6U1L.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgtgttccagcagaagtcaggccaggcccctgtactggtcatccatgaggccagtcgacgacacgtccgggatccctgagagattctctgcctccagctcgagggacagtggccacttgactatcgaggtcgggcccaggtggacgagtgaagctagacttactattgttacgcacagacagtagtggtacagtcgaggggtatcggacggagggacagttgaccgtcgttggcacgcccaaggctcggcccccttcggtcctacgtctccgg

SEQ ID NO: 89515 - DNA, 781 bp, Homo sapiens
  misc_feature: GYAE6OF02HSWR9.21.8.A08.1.454.CMB.1.raw
tcagtcgtcgctcgcacgaccggtgctcgatttagcatactctacagggggctgtgggcgtcaggaggcgagagctcctgggaatctcaaccatgggccttggtacccctctcctgctccccctcctcactttctgcacagtctctgaggtcctcctatgaggtctgacacagtccacccgtcggtcgtcagtcgtcccgaggacaaacggcgaggatcgacctgctctggagagttcacttgacaaaagatatacttgtgttccagcagaagtcacggccaggtcccctgtactggtcatccatcgaggccaggtcgacggacacgtccgggactccctgtacgagattcgctgcctaccgagtctcaagggactacgggtcggaccgaccgtttgaccttaactccgtacggttcgggggaccccgtagggtacgggaaccgtacgtaggaaacggtccgttacgtaaccgtttaacgttaactttacggtttaaccgacctaacccgtaacggtaacgtaagggttaacggttcgggttaaccgtaagttaccgggttaacgggggggtttaacgtttaccgggggtaaccggggttaacgggggttaacccgtaaaggggttttacccgggtaaacccgggggtttcccggttttaccggggtttaacccgtaaaccggttacccccgggtaaaagggttccccggtttacccggggttacccccccccgtttacggggtttacccttaaccccgtttcccggttttaaccccccgg

SEQ ID NO: 89516 - DNA, 522 bp, Homo sapiens
  misc_feature: GYAE6OF02FMXIJ.21.8.A08.1.454.CMB.1.raw
tcagtcgtcgctcgcacgaccggtgctcgatttagcatactctacagggggtgggctcaggaggcagagctctgggaatctcaccatggcctggaccctctcctgctcccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggccccctgtactggtcatccatgaggccagtcgacgacactccgggatccctgagagattctctgcctccagctcagggacagtcggccaccttgactatcagtcggggcccaggtggacgatgaagctgactactattgttacgcaccagacagtagtggtcatcgagggggtattcgggcggagggaccaagttcgaccgtccgttggtcagcccgaaggcctccgccccgtcggtccacgtctcgttccccgtcccc

SEQ ID NO: 89517 - DNA, 558 bp, Homo sapiens
  misc_feature: GYAE6OF02IFJHX.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaaagatatacttgttggttccagcagagtcaggccaggcccctgtactggtcatccatgaggccagtcgacgacacgtcccgggatccctgagagattctctgcctccagctcgagggacagtcggcctaccttgactatcgaggtcggggcccagggtcggacgagtggaagcgtagaaccttacgttattgttaccgctaccagacaggtagtggtcagtcgaggggttatcgggcggagggaccaggttcggacccggttccgttaggtccgacggacccgtaagggcctccggcccccgttcggtcctaccgtcgttcccgg

SEQ ID NO: 89518 - DNA, 509 bp, Homo sapiens
  misc_feature: GYAE6OF02IKQK7.21.8.A08.1.454.CMB.1.raw
  modified_base (413)..(413): a, c, t, g, unknown or other
  misc_feature (413)..(413): n is a, c, g, or t
  modified_base (505)..(505): a, c, t, g, unknown or other
  misc_feature (505)..(505): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacactccgggatccctgacgagattctctcgcctccagctcgagggacagtcggccaccttgactatcagtgggccaggtggacgatgagctgacttactattgtacncacagacagtagtggtcagtcgaggggtatcggcggaggacctagttgaccgtcgttggtcagcccgaaggctcggcccctcggtcaccgtntccg

SEQ ID NO: 89519 - DNA, 552 bp, Homo sapiens
  misc_feature: GYAE6OF02G8SK9.21.8.A08.1.454.CMB.1.raw
  modified_base (218)..(218): a, c, t, g, unknown or other
  misc_feature (218)..(218): n is a, c, g, or t
  modified_base (450)..(450): a, c, t, g, unknown or other
  misc_feature (450)..(450): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaaagatatacttgttggttccagcagaagtcaggccaggcccctgtactggtcatccatgaggccagtcgacgacacgtccgggatcccgtgagagattctctgcctccagctcgagggacaggtcggcctacgttgacttatcgaggtcggggcccagggtcggacgagtggaagcgtagacttactagttgttaacgcaaccagacagtagtcgtanagtcgaggggttattcgggacgggagggacctaggttcgaccggttcgttaggcacggcccgaaggccgtccggcccccgttcggtcctaccgttcctaccg

SEQ ID NO: 89520 - DNA, 520 bp, Homo sapiens
  misc_feature: GYAE6OF02FZR3M.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagaatatacttgttgttccagcagaagtcaggccaggcccctgtactggtcatccatgaggccagtcgacgacactccgggatccctgagagattctctgcctccagctcagggacagtcggccacttgactatcagtgggccaggtggacgatgaagctgactactattgttacgcaccagacagtagtggtcagtcgaggggtattcgggcggagggaccgtaggtgaccgtccgttggtcacgcccgaaggcctcggcccccgtcggtcctaccgtcgttcccgg

SEQ ID NO: 89521 - DNA, 578 bp, Homo sapiens
  misc_feature: GYAE6OF02IDEL8.21.8.A08.1.454.CMB.1.raw
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
tcagtcgtcgctcgcacgaccggtgctcgatttagcatactctacaggggcgtgtgggcgtcaggaggcagagctctgggaatctcaccatggcctggacccctctcctgctcccctcctcactttctgcacagtctctgaggcctcctatgagctgacacagccacccttcggtgtcagtcgtccccaggaccaaacggccaggatcacctgctcgtggagattcattgaccaaaaagatatacttgttggttccagcagaagtcaggccaggccccctgtactggtcatcatgagccagtcgagacactccgggatccctgagagattcnctgcctcagctcgaggacagtgcctaccgttgactactcagtcggggcccgaggtgggacgaagtgaagctagactacttatgttacgcaccacgtanagtagtcggtanacgtacgaggggtaattcgggcggaacggggtaccaaagggttcgtacccgggttaccgttgggttccgaacggacccccgaaggtaccggttccggccccccgtttaccgggtcctaacccgttccgttacccgg

SEQ ID NO: 89522 - DNA, 518 bp, Homo sapiens
  misc_feature: GYAE6OF02HLDQK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctgcctcagctcagggacagtcggccacttgactatcgagtcgggcccagggtggacgatgaagctagactactattgttacgcacagacagtagtggtcagtcgaggggtatcggcggacgggaccagttcgaccggtcgttcggtcacgcccgaaggcctcgccccgtcggtcctaccgtcgtccgg

SEQ ID NO: 89523 - DNA, 504 bp, Homo sapiens
  misc_feature: GYAE6OF02JCN2P.21.8.A08.1.454.CMB.1.raw
  modified_base (451)..(451): a, c, t, g, unknown or other
  misc_feature (451)..(451): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatcccgtgagagattctctgcctccagctcgagggacagtcggccacttgactatcgaggtcgggcccagggtggacgatgaagctgacttactattgtacgcaccagacagtagtgtcagtcgaggggttatcggngagggaccagttgaccgtcttggcagccaaggctcgcccctggtcactctccg

SEQ ID NO: 89524 - DNA, 503 bp, Homo sapiens
  misc_feature: GYAE6OF02HDD7C.21.8.A08.1.454.CMB.1.raw
  modified_base (443)..(443): a, c, t, g, unknown or other
  misc_feature (443)..(443): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcactgtctctgaggcctcctatgagctgacacagccaccctcggtgtcagtgtccccaggacaaacggccaggatcacctgctctggagattcattgccaaaagatatacttgtggttccagcagaagtcaggccaggcccctgtactggtcatccatgaggccagtcgacgacactccgggatccctgagagattctctgcctccagctcgagggacagtggccaccttgactatcagtcggggcccaggtggacgagtgaagctgactactattcgttacgcaccagacagtagtggtcagtcgaggggttntcggcggaggaccagttgaccgtcgttggtcagccaaggctcgcccctggtcactctccg

SEQ ID NO: 89525 - DNA, 515 bp, Homo sapiens
  misc_feature: GYAE6OF02F0FQU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagattctctgcctccagctcgagggacagtcggccacttgactatcagtcgggcccagggtggacgatgaagctgactacgtattgttacgcaccagacagtagtggtcagtcgaggggtattcgggcggagggacaggttcgaccgtcgttggtcagcccgaaggctcggccccgtggtccacgtctccg

SEQ ID NO: 89526 - DNA, 542 bp, Homo sapiens
  misc_feature: GYAE6OF02H8ZKK.21.8.A08.1.454.CMB.1.raw
  modified_base (332)..(332): a, c, t, g, unknown or other
  misc_feature (332)..(332): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaaagatatacttgttggttccagcagaagtcaggccaggcccctgtactgtcatccatgaggccagtcgacgacacgtccgggatccctgacgagattcnctgcctccagctcgagggacagtcggcccacttgacttatcaggtcggggccccagggtggacgagtgaagctagaacttacttattgttaccgcaccagacagtagtggtcagtcgtagggggttattcgggacggagggaccaggttcggacccgttcgttggtccacgacccaggcctcggcccccgttggtcctaccgtcttccgg

SEQ ID NO: 89527 - DNA, 544 bp, Homo sapiens
  misc_feature: GYAE6OF02IWCN8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccgtgagagatttctctcgcctccagctcgagggacaggtcggacccaccgtttgaacctatcgacggtcggggcccagggtcggacgagtggaagcgtagacttactattgttacgcaccagacagtagtggtacagtcgtaggggtatcggacgggagggaccgaggttcgaccgtcgttggcacgcccgaaggtcctcgtcccccgtggtcctacgtcgtccg

SEQ ID NO: 89528 - DNA, 513 bp, Homo sapiens
  misc_feature: GYAE6OF02IQ5HV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctgcctccagctcagggacagtgccacttgactatcagtcgggcccaggtggacgatgaagctgacttactattgttacgcaccagacagtagtgtcagtcgaggggttatcggcggagggaccaggttcgaccggttcttggtcacgcccgaaggtctcgcccccgtggtcctactcctccg

SEQ ID NO: 89529 - DNA, 508 bp, Homo sapiens
  misc_feature: GYAE6OF02IDDH8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacactccgggatccctgagagattctctgcctcagctcgagggacagtggccacttgactatcgagtcgggcccaggtggacgagtgaagctgactactattgtacgcacagacagtagtgtcagtcgaggggtatcggcggaggaccgtagttcgaccgtcgttggtcacgcccgaaggctcgccccgtcggtcacctctccg

SEQ ID NO: 89530 - DNA, 610 bp, Homo sapiens
  misc_feature: GYAE6OF02G0RY0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaaagaatatacttgttggttccagcagaagtcaggccaggcccctgtactggtcatccatgaggccagtcgacgacactccgggactcctgagagtattctctcgcctacagtcctacgaacgggacaggtcggaccctaaccgttcgaacttactacgaagggtccggggaccctagggtacggaacgtagtaggaaacgcgtagaaccttaacttaagtttacggttaacgaccaacccgaagaacaaggttagtacgggtactaacgtacggtaagggggttaacgttcgggacggggaagggaacctaaggttacgaccggttccgttaggtacacgtaccgaaggcgtccgccccgtcggtactacctcttccgg

SEQ ID NO: 89531 - DNA, 633 bp, Homo sapiens
  misc_feature: GYAE6OF02G7GJM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagtattctctcgccctccagctcgagggacaggtcggccctaccgttgaacttatcgacggtcggggaccccgtagggtcggaacgagtaggaagtcgtagacttaacgttagtttacggttaaccgactaacccgagaacgtaggtacgttcggtactaagtacggtaagggggttacttcgggacgggtaacgggaccgtaagggttcggtacccggttccgttacgggtaccgtaaccggtaccccgaagggtcccgttacccggtccccccggttaccggtccctaccgttcccgttaccccgg

SEQ ID NO: 89532 - DNA, 635 bp, Homo sapiens
  misc_feature: GYAE6OF02HXIV0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagattcattgaccaaaagatatacttgttggttccagcagaagtcaggccaggcccctgtactggtcatccatgaggccagtcgacgacactccgggaatcccctagacgagtattctctgcctcagctcgagggacaggtcgcctaccttgactatcgacggtcggggcccctagggtcggaacgataggaacgtcgtagaaccttaacgttattggttaaccgcaaccgagtaacaggtaagtcggtacctagtcgtaagggggtacttacgggacgggtaacgggaccgtaacggtttcggaacccggtttcccgtttacgggtaccgtaacgggtacccccggtaaacgggtcccttacccgggacccccccgtttacccgggttaccgtaccccgttaccgtttcccccggg

SEQ ID NO: 89533 - DNA, 848 bp, Homo sapiens
  misc_feature: GYAE6OF02JJ57J.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtcgtccccaggacaaacggccaggatcacctgctctggagattcattgaccaaaagatatacttgttgttccagcagaagtcaggccaggcccctgtactggtcatccatcgagccagtcgacgcacgtccgggatcccgtagacgagtacttcgtctcgtccctaccgagtcctaccgaaggggactacgggtcggaccccgtaccgtttacggaaccttacgtaccggtaaacggggttcgggggtacccccgtaagggggttacgggaaccggtaacgttaaccggggaaacggtcccgttacgggtaacctttaaccggtttaaacgtttaccggtttaacccggaccgttaacccgaacgggtaaaccgtaacgggtttaaccgggttacgggtttaccgtaaacggtttaccggggttaaacgggggggtttaaccgtttaccggggtaacccgggggaacgggggttaaaccccggttaaacgggttttacccgggggttaacccccgggtttacccgggttttaacggggttaccccgggttaaacccggggtaaccccccggttaaacggggttcccccggtttacccccgggtcccccccgggtttaccccgggggttaccctttaacccccgggtttccccggttttaaccccccgggg

SEQ ID NO: 89534 - DNA, 529 bp, Homo sapiens
  misc_feature: GYAE6OF02JZ40G.21.8.A08.1.454.CMB.1.raw
  modified_base (456)..(456): a, c, t, g, unknown or other
  misc_feature (456)..(456): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagattctctgccctaccagctcgagggacaggtcggacccacttgactagtcaggtcgggcccagggtcggaacgagtagaagctagacttactattagtacgcacagacagtagtgtcagtcgaggggtntacgggacggaggacgtagtacgaccgtcgttggcgacgccgaggcctcggccccgttgtcctacgtcgtccg

SEQ ID NO: 89535 - DNA, 566 bp, Homo sapiens
  misc_feature: GYAE6OF02G6BYS.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagaatatacttgttggttccagcagaagtcaggccaggcccctgtactggtcatccatgaggccagtcgacgacacgtccgggatccctgagagattctctcgccctccgagctcgagggacagtcggccacttgactatcgaggtcggggacccagggtggacgagtaggaagcgtagacttacgttagttacgttacgacacagactagtagtcggtcagtcgaagggggttgtcggacgggagggacctaggttcggaccgttccgttggtaccgacggacccgtaaggccgtccggtacccccgtcgggtaccctaccgtcgttcccgg

SEQ ID NO: 89536 - DNA, 510 bp, Homo sapiens
  misc_feature: GYAE6OF02F4FQC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagattctctgcctccagctcgagggacagtcggccaccttgactatcagtcgggcccaggtggacgatgaagctgactactattgttacgcaccagacagtagtgtacatcgaggggtattcggcggagggaccagtgaccgtcgtggtcgagcccgaaggcctcgccccgtcggtctactctccg

SEQ ID NO: 89537 - DNA, 507 bp, Homo sapiens
  misc_feature: GYAE6OF02HJU90.21.8.A08.1.454.CMB.1.raw
  modified_base (218)..(218): a, c, t, g, unknown or other
  misc_feature (218)..(218): n is a, c, g, or t
  modified_base (448)..(448): a, c, t, g, unknown or other
  misc_feature (448)..(448): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacactccgggatccctgagagattctctgcctccagctcagggacagtcggccaccttgactatcagtggggcccaggtggacgatgaagctgacttactattgttacgcaccagacagtagtggtcagtcgaggggtatcgggnggaggaccagttgaccgtcgttggtcagcccgaaggctcgccccgtggtccactctccg

SEQ ID NO: 89538 - DNA, 566 bp, Homo sapiens
  misc_feature: GYAE6OF02JV0FL.21.8.A08.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagcatactctacagggggtgggctcaggaggcagagctctgggaatctcaccatggcctggaccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttgtccagcagaagtcaggccaggcccatgtactggtcatccatgagccagtcgacgacacgtccgggatcccgtagagagtattccnctcgccctcagctcgagggacaggtcggccctacgttgactatcgaggtcgggccagggtggacgagtgaagcgtagacttacttagttgttacgacaccagactagtagtggtacagtcggtaggggttatcgggacgggtacggaccgtaaggttcgaccggttccgttggtaccgacgacccgtaaggtccgtccgtacccccgtcggtaccgtaccgttccgttccgttccccg

SEQ ID NO: 89539 - DNA, 578 bp, Homo sapiens
  misc_feature: GYAE6OF02IUSJK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgagccagtcgacgacacgtccgggatccctgagagattcgtctgcctccagctcagggacagtcggccactgactatcaggtgggcccaggtcggagagtagaagctaggaaccttacgtattcggttaacgctaaccgagaacgtagtagtcggtacagtcgtaagggggtattacgggacggtaaggggacctagggttacgtacccggttccgttagggtccaacggtccccgtaagggcccgttccggtacccccgttcgggttaccctacgttcccttacccgg

SEQ ID NO: 89540 - DNA, 573 bp, Homo sapiens
  misc_feature: GYAE6OF02HGLP3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgacggccagtcgacgacacgtccgggatcccgtgagagtacttctctcgcctccagtcctcgagggacaggtcggccctaccgttgactatcgaggtcggggcccgagggtcggacgagtagaacgcgtacgaacttacttagttcgttacgactaccgagacaggtagtggtacagtcgaggggttagtcgggacggacgggaccgtaggttcgtaccggttcgttcggtacgacggtacccgaggccgtccggcccccgtcggtcctaccgttccgtccgg

SEQ ID NO: 89541 - DNA, 552 bp, Homo sapiens
  misc_feature: GYAE6OF02GI78T.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgacggccagtcgacgacacgtccgggatccccgtgagagattctctcgcctccagctcgagggacaggtcggcctacttgactatcgagtcgggcccgagggtcggacgagtgaagctagacttactattgttacgcaccagacagtagtggtacagtcgaggggttagtcggacgggagggaccgtagtcggaccggttccgttggtccgacggcccgaaggccgtccggcccccgttcggtcctaccgtccgttcccgg

SEQ ID NO: 89542 - DNA, 507 bp, Homo sapiens
  misc_feature: GYAE6OF02FZI5M.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatccctgagagattctctgcctccagctcagggacagtggccaccttgactatcagtgggcccaggtggacgatgaagctgacttactattgttacgcaccagacagtagtggtcagtcgaggggtattcgggcggaggaccagttgaccgtcttggtcagcccaaggtcctcgcccccgtcggtcacctctccg

SEQ ID NO: 89543 - DNA, 521 bp, Homo sapiens
  misc_feature: GYAE6OF02INEDV.21.8.A08.1.454.CMB.1.raw
  modified_base (216)..(216): a, c, t, g, unknown or other
  misc_feature (216)..(216): n is a, c, g, or t
  modified_base (446)..(446): a, c, t, g, unknown or other
  misc_feature (446)..(446): n is a, c, g, or t
tcagtcgtcgctcgcacgaccggtgctcgatttagcatactctacagggggtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacactccgggatccctgagagattctctgccctccagcctcgagggacaggtcggccctacttgaactatcgaggtcggggcccagggtggacgatgaagctgactactattgtacgcacagacagtgtgtacatcgaggggttntcgggcggaggaccagtcgaccgtcgttggcacgccgaaggctcgccccgtggtccactcttccgtcccctaccc

SEQ ID NO: 89544 - DNA, 543 bp, Homo sapiens
  misc_feature: GYAE6OF02GDB6O.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctcgcctccagctcgagggacaggtcggccactttgacttatcgaggtcgggacccagggtcggacgatgaagctgactatattgtacgcacagacaggtagtggtacagtcgagggggttattcgggacggaggaccgtaagttcggaccgttccgtggtcacgtacccgaaggcctcgcccctcggtacctacgtcgttccgtccccgtcccc

SEQ ID NO: 89545 - DNA, 536 bp, Homo sapiens
  misc_feature: GYAE6OF02HMXRI.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggccccctgtactggtcatccatgagccagtcgacgacactccgggatcccctgagagattctctgccctccagcctcgagggacagtcggcctaccttgacttatcgaggtcgggcccaggtggacgatggaagctgactactattgttacgcaccagacagtagtggtcagtcgaggggtattcgggcggagggaccaagttcgaccgttccgttggtcacgcccgaaggcctcgcccccgtcggtccactccttcgttcccctacccg

SEQ ID NO: 89546 - DNA, 527 bp, Homo sapiens
  misc_feature: GYAE6OF02FT54A.21.8.A08.1.454.CMB.1.raw
  modified_base (460)..(460): a, c, t, g, unknown or other
  misc_feature (460)..(460): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatccctgagagattctctgccctccagctcgagggacagtcggcccaccgttgaactatcgaggtcgggcccagggtggacgagtgaagctagacttactattgttacgcaccagacagtagtggtcagtcgaggggtatcgggnggagggaccagttcgaccgtcgttggtcacgcccgaaggccgtcgccccgtcggtccacctcgtccg

SEQ ID NO: 89547 - DNA, 675 bp, Homo sapiens
  misc_feature: GYAE6OF02J0UNE.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctctgganattcattgaccaaaagatatacttgttggttccagcagaacgtcaggccaggcccctgtactggtcatccatcgaggccagtcgacgacacgtccgggatcccgtgagacgtattcctcgtcgcctccagcctcgacgggactacggtcggaccctacttaggaccttagtaccgaggtcggggcccagggtcggacggtagtacggaacgtcgtacggtaaccttacgttagtttcggttaccgaccgtaaccgaacggtacgtaacggttacgggttacggttacctaacgggttccgggtaaacggggggttacgttaccggggaacgggtacgggaaccgttaacgggttcggtaacccgggttccggttacggtaccgaaccgggtaccccggaagggtcccgttacccggccccccgttacgggtcccgtacccgttccttaccccggg

SEQ ID NO: 89548 - DNA, 503 bp, Homo sapiens
  misc_feature: GYAE6OF02HZ3NL.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcactgtctctgaggcctcctatgagctgacacagcccaccctcggtgtcagtgtccccaggacaaacggccaggatcacctgctctgganattcattgaccaaaaagatatacttgttggttccagcagagtcaggccaggcccctgtactggtcatccatgaggccagtcgacgacactccgggatccctgagagatttctctgcctcagctcgagggacagtcggccacttgactatcagtgggcccaggtggacgatgaagctgactatattgttacgcacagacagtagtgtcagtcgaggggttatcggcggaggacctagttgaccgtcttggcagcccgaaggctcgccccgtggtcacctcgtccg

SEQ ID NO: 89549 - DNA, 539 bp, Homo sapiens
  misc_feature: GYAE6OF02ISRQD.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaaagatatacttgttggttccagcagaagtcaggccaggcccctgtactggtcatccatgacgccagtcgacgacacgtccgggatcccgtgagagtacttctcgtcgccctcagctcgagggacagtcggcccacttgactatcgaggtcgggcccaggtggacgatgaagctagactactagttgtacgctacagtacgagtagtgtacagtcgaggggttctcgggacggaggaccaggttcgaccgttcgttggtacgacgacccgaaggtcctcggccccgtggtcctaccgtcttcccgg

SEQ ID NO: 89550 - DNA, 672 bp, Homo sapiens
  misc_feature: GYAE6OF02HGYIY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatggacggccaggtcgaacgacaccgtccgggactcccgtagacggagtatttcctcgtcgtccctccgagtcctacgaagggtacaggtcggccctaccgtttgaacctagtcgacgggtcggggacccgtaggggtcgggaacgtagtaggaacgcgtaggtaaccttaacgttagtttacggtttaaccgccgtaaccgaaggaaccgtaaggttaaggttcggtactaacggttacggtaaggggggttacgttccgggacggggtaggggtaacccgtaaggtttacggtaccccggttcgttacgggtaccgaaccggtacccgaagggtccttacccggtccccccgttacgggtcctaccgttcccgtttaccccgg

SEQ ID NO: 89551 - DNA, 526 bp, Homo sapiens
  misc_feature: GYAE6OF02FWOD3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggccccctgtactggtcatccatgaggccagtcgacgacacgtccgggatccctgagagattctctgcctccagctcgagggacagtggcccacttgactatcaggtcgggcccgagggtggacgagtgaagctgacttactattgttacgcaccagacagtagtggtcagtcgaggggtattcggcggagggaccgagttcgaccggtcgttcggtcgacggcccgaaggcgtcggccccgtcggtcaccgtctccg

SEQ ID NO: 89552 - DNA, 637 bp, Homo sapiens
  misc_feature: GYAE6OF02H5IJ4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctctggagattcattgaccaaaagatatacttgttggttccagcagaagtcaggccaggcccctgtactggtcatccatggagccagtcgacgacacgtccgggatcccgtgagagtattcctctgcctccgagctcgagggacagtcggccctaccttgactatcgaggtcgggcccgaggtgggacgtagtaggaacgtcgtagaccgttaacgttagtttcggttaaccgacgaaccgaacggactaaggtacggtaggtacagttacggtaagggggttaacgttcgggaccgggtaacgggtacccgtaaaggtttccggtaacccggttccgtttacgggttacccgaaccggtaccccggaagggtcccgttaccggcccccccgtttacggggtaccctacccgttcccgttaccccgg

SEQ ID NO: 89553 - DNA, 545 bp, Homo sapiens
  misc_feature: GYAE6OF02IK5IH.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcactgtctctgaggcctcctatgagctgacacagcccaccctcggtgtcagtgtccccaggacaaacggccaggatcacctgctctgganattcattgaccaaaaagatatacttgttggttccagcagaagtcaggccaggcccctgtactggtcatccatgaggccagtcgacgacactccgggatcccgtgagagattctctcgcctccagctcgagggcagtcggccaccttgactatcgaggtcggggccagggtcggacgatgaagctagacttactattgtacgcaccagacagtagtgtcagtcgaggggttatcggacggtagggaccgtaggttcgacccggtccgttcggtaccgacggacccgaaggtcctccggcccccgttcggtacctaccgtccgtcccg

SEQ ID NO: 89554 - DNA, 538 bp, Homo sapiens
  misc_feature: GYAE6OF02HSBCD.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaaacggccaggatcacctgctctggagattcattgaccaaaagaatatacttgttggttccagcagaagtcaggccaggcccctgtactggtcatccatgaggccagtcgacgacacgtccgggatccctgacgagattctctcgcctccgagtcctcgagggacaggtcgccaccttgactatcgaggtcgggccagggtggacgatgagctagacttatattgtacgcacagactaggtagtggtcagtcgagggggttatcggacgggagggacctaggttcgaccggttcttaggtcacgcccgaaggcctccggcccccgttcggtcctacgttcttcccg

SEQ ID NO: 89555 - DNA, 515 bp, Homo sapiens
  misc_feature: GYAE6OF02I9MW3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagattcattgccaaaagatatacttgttggttccagcagaagtcaggccaggcccctgtactggtcatccatgaggccagtcgacgacactccgggatcccgtgacgagattctctcgcctccagctcagggacaggtggcccaccgttgactatcgagtcgggccaggtggacgatagagctgactatattgtacgcacagacagtagtggtcagtcgaggggtattcggacggtagggacctaggtcgacggttccgttggcacggcccgaaggcctcgcccctggtccacgtctccg

SEQ ID NO: 89556 - DNA, 560 bp, Homo sapiens
  misc_feature: GYAE6OF02JGEVB.21.8.A08.1.454.CMB.1.raw
  modified_base (389)..(389): a, c, t, g, unknown or other
  misc_feature (389)..(389): n is a, c, g, or t
tcagtcgtcgctcgcacgaccggtgctcgatttagcatactctacagggggcgtgtgggctcaggaggcagagctctgggaatctcaccatggcctggacccctctcctgctccccctcctcactttctgcacagtctctgaggcctcctatgagctgactacagccaccctcggtgtcagtgtccccaggacaaacggccagggatcacctgctcgtggagattcattcgaccaaaagaatatacttgttgttccagcagaagtcaggccaggcccctgtactggtcatccatcggaggccagtcgacgacacgtccgggatcccgtagagagattcactcgcctccagctacgagggacaggtcggccctacgttcgactttttacnctaggtcgggccgagggtacggacgtagtagaacgctagtaccttactattgttacgcaccagacagtagtcggtcagtcgaggggtatacggacgggtaggactaggttcgaccgtcgttcggtacgcgtaccgaggcctccgccccgtcggtcctaccgtccgttaccg

SEQ ID NO: 89557 - DNA, 701 bp, Homo sapiens
  misc_feature: GYAE6OF02INRG1.21.8.A08.1.454.CMB.1.raw
tcagtcgtcgctcgcacgaccggtgctcgatttagcatactctacagggggcgtgtgggctacaggaggcagagctactgggaactcgtcaccatggcctggacccctctcctgctccccctcctcactttctgctacagtctctgacggcctcctatggagcctgaccacacgccctacccgtcggtgtccagtcgtccccaggacaaacggccaggactcgacctgctcgtggactattcattcgaccaaaagatatacttgtgtccagcagtaagtcaggccaggcccctgtactggtcatccagtgacgccagtcgacgacaccgtccgggatcccgagaagacgtaacttctctcgacctcagctacgacggacagtcgaccctaaccgttgaacttagtacgacggtcgggaccctagggtcggacgaagtaggaacgcgtacggtaaccttaacgttagttacggttaacccgacgaaacccgaacggaaaccgtaggtttaaacggtcggttaccaacggttaccgggaaggggggttactttaccggggaaccgggtaacgggttaacccttagggttaccggttaacccggttccgttttacgggtaacccgtaaccgtacccccgtaaagggtcccgttcccggaccccccggtttacgggtaccctacccggttaccgtttacccccgg

SEQ ID NO: 89558 - DNA, 527 bp, Homo sapiens
  misc_feature: GYAE6OF02F623R.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggccccctgtactggtcatccatgaggccagtcgacgacactccgggatccctgagagattctctgcctccagctcgagggacagtggcccaccttgactatcaggtcgggcccaggtggacgatgaagctgactactattgttacgcaccagacagtagtggtcagtcgaggggtattcgggcggagggaccaggttcgaccggttccttggtccacgcccgaaggccgtcggccccccgtcggtcctacctcgtccgg

SEQ ID NO: 89559 - DNA, 580 bp, Homo sapiens
  misc_feature: GYAE6OF02F8FZB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactggtcatccatgacggccaggtcgacgacaccgtccgggactcccgtgagacgtattcctctcgccctccgagtcctcgagggactaggtcggacccaccgtttcgacttagtcgtaggtccggggcccgagggtcggacgagtgaagtctagacttactattcgtacgcaccagacagtagtgtacagtcgaggggtactcggcgggaggaccgtaggttcggacccggttcgttcggtacgtacgacccgaaggtcccgtccggtcccccgttcggtccctaccgttccgttcccgg

SEQ ID NO: 89560 - DNA, 537 bp, Homo sapiens
  misc_feature: GYAE6OF02IVUVP.21.8.A08.1.454.CMB.1.raw
  modified_base (356)..(356): a, c, t, g, unknown or other
  misc_feature (356)..(356): n is a, c, g, or t
  modified_base (398)..(398): a, c, t, g, unknown or other
  misc_feature (398)..(398): n is a, c, g, or t
  modified_base (444)..(444): a, c, t, g, unknown or other
  misc_feature (444)..(444): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgacccaaaaagaatatacttgttggttccagcagaagtcaggccaggcccctgtactggtcatccatgaggccagtcgacgacactccgggatcccgtgagagtattctctgccctccagctcgagggacngtcggccaccttgactatcagtcggggcccagggtggacganaggaagctagacttactattgttacgcaccagacagtagtcggtanagtcgagggggttactcgggacggagggtaccaggttgacccggttcgttggtcacgccgaaggcctcggcccctggtacctacgtccgtccg

SEQ ID NO: 89561 - DNA, 535 bp, Homo sapiens
  misc_feature: GYAE6OF02IVL3E.21.8.A08.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgtggttccagcagagtcaggccaggcccctgtactggtcatccatgacggccagtcgacgacacgtccgggatccctggacgagtacttctctcgccctccgagcctcgagggacagtcggcctacttgactatcgacggtcgggccctagggtcggacgagtggaacgtcgtgtaactacttagttgttacgcaccgagaccgagtagtgtacagtcgtaggggtctcgggcggaggactaggttcgaccgttcgtggtcacgccgagctcgcccgtgtcactctcgtcctcccg

SEQ ID NO: 89562 - DNA, 638 bp, Homo sapiens
  misc_feature: GYAE6OF02ICPYH.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtcccaggacaaacggcaggatcacctgctcgtgganattcattgaccaaaaagattatacttgttggttccagcagaagtcaggccaggcccctgtactggtcatccatgaggccagtcgacgacacgtccgggatcccgtagagagtattctctcgccctcagcctcgacgggacagtcggccctaccgttgactatcaggtacgggaccccgtagggtacggaacgtagtaggaacgtcgtagaaccttaacgttacgtttacggttaccgacaaccgagaacgtaggttaaggttacggtacgtaagttacgggtagggggttacgttacgggacgggtacgggtaaccgtaggttcggtacccggttacggttcggtaccgaacggtacccgaacgggtcccgtccggtaccccccgttaccgggtcctacccgttcgtttacccccgg

SEQ ID NO: 89563 - DNA, 686 bp, Homo sapiens
  misc_feature: GYAE6OF02HHTTS.21.8.A08.1.454.CMB.1.raw
  modified_base (218)..(218): a, c, t, g, unknown or other
  misc_feature (218)..(218): n is a, c, g, or t
  modified_base (330)..(330): a, c, t, g, unknown or other
  misc_feature (330)..(330): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgaaacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattcnctgcctcagctacgacgggacacggtcggaccctaccgttggaaccttagtccgaagggttcgggggaccccgaaggggttcgggaaccggtagttaggaaacggtctacggaaccttaacgttaagttttcggtttaaccgacctaacccgtaaggtaaccgtagggttaacggttacgggtacctaagttcggtaaggggggtttacttaccggggacgggtaacgggtaaccgtaagggtttcggtaacccggttccggtttaacgggtacccgtaacggtaccccggaaagggtcccgtaccggtccccccgttccgggttacccaaccgtttccgtccgtttcccccccgg

SEQ ID NO: 89564 - DNA, 497 bp, Homo sapiens
  misc_feature: GYAE6OF02FY8LT.21.8.A08.1.454.CMB.1.raw
  modified_base (218)..(218): a, c, t, g, unknown or other
  misc_feature (218)..(218): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (491)..(491): a, c, t, g, unknown or other
  misc_feature (491)..(491): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgccaaaagatatacttgttggttccagcagaagtcaggccaggcccctgtactggtcatccatgaggccagtcgacgacacgtccgggatccctgagagattctctgcctccagctcgagggacaggtcggcccacttgactatcgaggtcgggccagggtggacgatgaagctgactactattgttacgcaccagacagtagtgtcagtcgaggggtntcggnggaggacagtgaccgtctggtcagccaggctcgccctcgtcnctctcg

SEQ ID NO: 89565 - DNA, 521 bp, Homo sapiens
  misc_feature: GYAE6OF02IKKFZ.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaaagatatacttgttggttccagcagaagtcaggccaggcccctgtactggtcatccatgaggccagtcgacgacactccgggatcccgtgagagattctctgccctccagctcgagggacaggtcggcccactttgactatcgaggtcgggcccagggtggacgatgaagcgtgacttactattgttacgcaccagacagtagtggtcagtcgaggggtatcgggacggagggaccgagttcgaccgtcgttggcacgccgaaggctcgcccctcggtcactctccg

SEQ ID NO: 89566 - DNA, 503 bp, Homo sapiens
  misc_feature: GYAE6OF02I38GR.21.8.A08.1.454.CMB.1.raw
  modified_base (219)..(219): a, c, t, g, unknown or other
  misc_feature (219)..(219): n is a, c, g, or t
  modified_base (322)..(322): a, c, t, g, unknown or other
  misc_feature (322)..(322): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtcccgggatcccngagagattctctgccctccagctcgagggacaggtcggcctaccttgacttatcgaggtcggggcccagggtggacgagtgaagctgacttatattgtacgcacagacagtagtgcagtcgaggggtntcggnggaggaccagtgaccgtcttgcagccaggctcgccctggtcactctcg

SEQ ID NO: 89567 - DNA, 563 bp, Homo sapiens
  misc_feature: GYAE6OF02IHRD9.21.8.A08.1.454.CMB.1.raw
  modified_base (222)..(222): a, c, t, g, unknown or other
  misc_feature (222)..(222): n is a, c, g, or t
  modified_base (336)..(336): a, c, t, g, unknown or other
  misc_feature (336)..(336): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcgggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatcccgtgagagatttcnctgccctccagctcgagggcagtcggccacttgactatcgaggtcgggcccgagggtcggacgagtgaagctagacttactattgttacgcaccagacagtagtgtacagtcgaggggttagtcgggacgggagggaccgtaggttacgtaccggttccgttggtacgacggtcccgaagggtcccgtaccggtcccccgttcgggtacctaccgttccgttcccgg

SEQ ID NO: 89568 - DNA, 526 bp, Homo sapiens
  misc_feature: GYAE6OF02FH7TF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggccccctgtactggtcatccatgaggccagtcgacgacactccgggatcccctgagagattctctgcctccagctcagggacagtggccaccttgactatcagtcggggcccaggtggacgatgaagctgacttactattgttacgcaccagacagtagtgtacatcgagggggtattcgggcggagggacctaggtcgaccggtccttggtccagcccgaagggcctcggcccccgtcggtccaccttcgtcccg

SEQ ID NO: 89569 - DNA, 651 bp, Homo sapiens
  misc_feature: GYAE6OF02J2KLZ.21.8.A08.1.454.CMB.1.raw
  modified_base (522)..(522): a, c, t, g, unknown or other
  misc_feature (522)..(522): n is a, c, g, or t
tcagtcgtcgctcgcacgaccggtgctcgatttagcatactctacagggggcgtggtgggcgtcaggaggcagagctctgggaatctcaccatggcctcggacccctctcctgcctccccctcctcactttctgcacagtctctgaggcctcctatgagctgacacagccaccctcggtgtcagtcgtccccaggacaaaccggcaggactcacctgctctggatattccattcgaccaaaagatacttactttgttggttccagcagagtcacggccacggccctgtacctggcactccatgacgtccgagtccggacgaccacgtcccgggactcccgtaggacgagtacttccgtctccgacccttccgagtccgtacggacggggactagggttccggaccctaacgtttcgacttactcgtacgggtccggggtacccgagggtggaacgagtcggtaaacgcttaggacttacgtttagttcgttaccgacacctagaacgtcggtagtccggtanacgtacgggttaggggtacttcgggacgtaacggggtacctaggttcggtaccggtccgtttacggctaccggtaccccgaaggtccccgttccggcccccgttccgggtcttaccgtcccgttcccgg

SEQ ID NO: 89570 - DNA, 576 bp, Homo sapiens
  misc_feature: GYAE6OF02F1XHF.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagaatatacttgttggttcaagcagaagtcaggccaggcccctgtactggtcatccatgacggccagtcgacgacacgtccgggatccctgagagattctctgccctccagctacgagggacaggtcggcctaccgttgaactatcgaggtcggggcccagggtcggacgagtaggaagcgtagacttaacgtattcgtacgcaccagacagtagtgtacagtcgtaggggttatcgggacgggacgggtaccgtaggttcggacccggttcgttacggtacgaaccggacccgaacgggtccgttccggcccccgttcggtacctaccgttccgttcccgg

SEQ ID NO: 89571 - DNA, 512 bp, Homo sapiens
  misc_feature: GYAE6OF02J24UL.21.8.A08.1.454.CMB.1.raw
  modified_base (326)..(326): a, c, t, g, unknown or other
  misc_feature (326)..(326): n is a, c, g, or t
  modified_base (454)..(454): a, c, t, g, unknown or other
  misc_feature (454)..(454): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgtggttccagcagaagtcaggccaggcccctgactggtcatccatgagccagtcgacgacactccgggatccctgagagattcnctgcctcagctcgagggacagtcggccaccgttgactagtcgaggtcggggcccagggtcggacgagtggaagctgactactagttgtacgcaccagacagtagtggtcagttcgaggggtattcggnggaggacctagtcgaccgtcgttggcacgccgagctcgccccgtggctactcgtccgg

SEQ ID NO: 89572 - DNA, 563 bp, Homo sapiens
  misc_feature: GYAE6OF02HY51F.21.8.A08.1.454.CMB.1.raw
  modified_base (338)..(338): a, c, t, g, unknown or other
  misc_feature (338)..(338): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaaagatatacttgttggttccagcagaagtcaggccaggcccctgtactggtcatccatggaggccagtccgacgacacctccgggactccctgagagatttccnctgccctccagtcctacgagggacaggttcggcccctaactttgaccttatcgacggtcggggccccgagggtcggacgagtagaagctagacttactattcgttacgcacagactagtagtggtcagtcggaggggtagtcggcgggagggaccgtaggttcgaccgtccgttggtacgacggacccgaggccgtcggcccccgttcggtccgtctccgtcccg

SEQ ID NO: 89573 - DNA, 513 bp, Homo sapiens
  misc_feature: GYAE6OF02I7OG3.21.8.A08.1.454.CMB.1.raw
  modified_base (457)..(457): a, c, t, g, unknown or other
  misc_feature (457)..(457): n is a, c, g, or t
  modified_base (506)..(506): a, c, t, g, unknown or other
  misc_feature (506)..(506): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtcccccaggacaaacggccaggatcacctgctctggagattcattgaccaaaagaatatacttgttggttccagcagaagtcaggccaggcccctgtactggtcatccatgaggccagtcgacgacacgtccgggatcccctgagagattcctctgcctccagctcgaggacagtggcccacgttgactatcgaggtcggggcccaggtcggacgatggaagctgacttactattgttacgcaccagacagtagtggtcagtgaggggttatcggngggacggactagtgaccgtcgttgcgacgccgaaggctcgcccctggcnctctccg

SEQ ID NO: 89574 - DNA, 547 bp, Homo sapiens
  misc_feature: GYAE6OF02GT5Y4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacacgtccgggatcccctgagagatttctctgccctccagctcgagggacagtcggcccaccttgactatcgaggtcggggcccagggtcggacggatggaagctagactactattgttacgcacgagacagtagtggtacagtcggagggggttactcgggacggacgggaccgtaggttcgaccgttcgttggtcgacggacccgaggcctcggccccgtcggtcctacgtccttcccgg

SEQ ID NO: 89575 - DNA, 582 bp, Homo sapiens
  misc_feature: GYAE6OF02JBASP.21.8.A08.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcaggtcgtccccaggacaaacggccaggactcacctgctcgtgganattcattcgaccaaaagatatacttgttgtccagcagaagtcaggccaggccctgtactggtacatccatgacgccagtccgacgacacgtccgggatcccgtagacgagtacttcgtctcgccctccagctacgaggtacagtcgcctaccgtgactagtcgaggtcgggcctagggtggaaccgtagtacggaacgtccgtagaaccttaacgtacgttacgttaccgacctacgagtacgagttacgtcgtacagtcggaggggttactacggacggacggactaggttcgaccgttccgtaggtcgacgtaccgaggtaccgtccggccccgttggcccgtactcgtacccgg

SEQ ID NO: 89576 - DNA, 512 bp, Homo sapiens
  misc_feature: GYAE6OF02GZCIS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacactccgggatccctgagagattctctgcctccagctcagggacagtgccaccttgactatcaggtcgggcccagggtggacgatagaagctgactactattgtacgcaccagacagtagtggtcagtcgaggggttatcggcggagggaccagttcgaccgtcgttggtcagacccgaggctcgccccgtcggtccactctccg

SEQ ID NO: 89577 - DNA, 550 bp, Homo sapiens
  misc_feature: GYAE6OF02JF9Z0.21.8.A08.1.454.CMB.1.raw
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
  modified_base (463)..(463): a, c, t, g, unknown or other
  misc_feature (463)..(463): n is a, c, g, or t
tcagtcgtcgctcggggcacgaccggtgctcgatttagcatactctacagggggtgggcgtcaggaggcagagctctgggaatctcaccatggcctggacccctctcctgctccccctcctcactttctgcacagtctctgaggcctcctatgagctgacacagccaccctcggtgtcagtgtccccaggacaaacggccaggatccacctgctctggagattcattgaccaaaaagatatacttgttggttccagcagaagtcaggccaggcccctgactggtcatccatgagccagtcgacgacacgtccgggatccccgtgagagatttcnctcgccctccagcctcgagggacaggtcggcccaccttgaccttntcgaggtcgggcccagggtgacgatgaagctgactatattgtacgcacagacagtagtgtacagtcgaagggggttattcgggnggacggacgtagttcgccgtcgttcggctacggacccgaaggtccgtccgcccccgttcggtccacgttccgtccgttccccacccg

SEQ ID NO: 89578 - DNA, 536 bp, Homo sapiens
  misc_feature: GYAE6OF02GQI7R.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacactccgggatcccgtgagagattctctcgcctccagctcgagggacaggtcgccaccttgaactatcaggtcggggcccgaggtggacgagtgaagctgacttactattgttacgcaccagacagtagtggtacagtcgaggggtagttcggcgggagggaccgaggttcgaccggtccgttggtccgacgcccgaaggctcggcccccgtcgggcctaccgtcgttcccg

SEQ ID NO: 89579 - DNA, 606 bp, Homo sapiens
  misc_feature: GYAE6OF02IIB3P.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggcaggatcacctgctctggatattcattcgaccaaaaagatatacttgttggttccagcagaagtcacggccaggcccctgtactggtcatccagtcgagccagtcgacgacacgtcggatcccgtagagagtattctctcgccctcgagcctcggaacgggacaggtcggaccctaccgtttgaccttacgtcgacgggtcggggacccgagggtcggacgagtacggaagtcgtagacttacttagttcgttacgactacagactaggtagtcgtacagtacggtaggggttacgttacgggcgggaagggtaccgtaggttcggacccggttccgttcggtacgaccggtacccgaagggtcccgtaccggtcccccgttcgggtacctaccgttcgttaccccgg

SEQ ID NO: 89580 - DNA, 807 bp, Homo sapiens
  misc_feature: GYAE6OF02GTN36.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgtcacagtctctgaggcctcctatgagctgacacagccaccctcggtgtcagtgtccccaggacaaacggccaggatcacgtgctctgganattcattgaccaaaagatatacttgttgttccagcagaagtcaggccaggcccctgtacgtcggtcaatccagtcgaggccaggtcgacgacacgtccgggattcccgtgacgagtacttctcgtcgtccctacaggtctcgaagggtaccaggtcggaccctaaccggtttggaaccttacgtaccgtaacggttcggggacccccgtaaggggttacgggaaccgtaacgttacgggaaacggtaccgttaacggtaaaccgtttaaccgtttaacgttttaccgggttaaacccggtaccgtaaacccgtaaacgggtaaacccgtaagggttaaccggttacgggttaaccgttaaacggttaaccgggttaaacggggggggtttaaaccttttacccgggggaaccggggttaaacgggggtaaaccccgttaaagggggtttaccgggtaaccccgggtttacccggtttacggggttaacccggtaaaccgggttaaccccggtaaacggggttcccgttacccgggtaccccccggttaccggggttcccgttaacccggttcccggtttacccccggg

SEQ ID NO: 89581 - DNA, 550 bp, Homo sapiens
  misc_feature: GYAE6OF02GXKZH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcatagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatccctgagagattctctgcctccagctcgagggacaggtcggcctaccgttgacttagtcgaggtcggggccccagggtcggacgagtggaagtctagaacttacgtagttcgttacgcaccagacagtagtggtacagtcgaggggttatcgggaggagggaccaggttcggaccggttcgttcggtcacggtcccgaaggtctccggcccccgtcggtcctacctcgtcccg

SEQ ID NO: 89582 - DNA, 518 bp, Homo sapiens
  misc_feature: GYAE6OF02JA2ZF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttgttccagcagaagtcaggccaggcccctgtactggtcatccatgaggccagtcgacgacactccgggatccctgagagattctctgcctccagctcgagggacagtcggccacttgactatcaggtcgggccagggtggacgagtgaagctgactactattagtacgcaccagacgagtagtgtacagtcgaggggttatcgggcggagggaccgagttggaccgtcgttcggtcgacgccgaaggctcggcccccgtggtccacgtctccg

SEQ ID NO: 89583 - DNA, 516 bp, Homo sapiens
  misc_feature: GYAE6OF02I7TN7.21.8.A08.1.454.CMB.1.raw
  modified_base (333)..(333): a, c, t, g, unknown or other
  misc_feature (333)..(333): n is a, c, g, or t
  modified_base (465)..(465): a, c, t, g, unknown or other
  misc_feature (465)..(465): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagattcnctgcctcagctcgagggacaggtcggccctacgttgactactcgaggtcggggccctagggtcggacgagtggaagctagacttactattcgttacgcaccagacagtagtgtacagtcgaggggtatcggnggaggacagtcgacgtcgtggcagccgaggctcgccctggtcactcgtccg

SEQ ID NO: 89584 - DNA, 605 bp, Homo sapiens
  misc_feature: GYAE6OF02JTJ36.21.8.A08.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcactgctcnggagattcattcgacaaaagatatacttgttggtccagcagaagtcacggccacggccctgtactggtcatccatcggacggccaggtcgacgacaccgtccgggactcccgtgagagtcttctctcgcctacgacgctacggagggacaggtccggacctacgttacgacttagcgtacgggtcgggcccgtagggtcgacgtagagacgctagtacttacgttagttacgtacgacaacgaggactaggtagtggtactaggtacgggtaaggggttcgtcgggacgggtaacggtacgtacggttcggtacccggttcgttacggacgtaacggcccgtaacgggtccttcccgggcccctcgggtacctacccggttccttccccg

SEQ ID NO: 89585 - DNA, 536 bp, Homo sapiens
  misc_feature: GYAE6OF02I905J.21.8.A08.1.454.CMB.1.raw
  modified_base (220)..(220): a, c, t, g, unknown or other
  misc_feature (220)..(220): n is a, c, g, or t
  modified_base (352)..(352): a, c, t, g, unknown or other
  misc_feature (352)..(352): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgcctcagctcgagggacngtcggcccacgttgactatcgaggtcgggcccgagggtcggacgagtgaagcgtgactatattgtacgcaccagacagtagtggtcagtcgagggggttatcgggacggaggaccgtagttcgaccgtcgttacggtcacggcccgaaggtcctacgcccccgtcggtcctaccgtcgttcccg

SEQ ID NO: 89586 - DNA, 526 bp, Homo sapiens
  misc_feature: GYAE6OF02GUIZ5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggccccctgtactggtcatccatgaggccagtcgacgacactccgggatccctgagagattctctgcctccagctcagggacagtggccaccttgacctatcgagtggggcccaggtggacgatgaagctgacttactattgttacgcaccagacagtagtgtcagtcgagggggttatcgggcggagggaccaggttcgaccggttccttggtcacgcccgaaggcctcggcccccgtcggtccctactccttccgg

SEQ ID NO: 89587 - DNA, 548 bp, Homo sapiens
  misc_feature: GYAE6OF02GOCZM.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatataccttgttggttccagcagaagtcaggccaggcccctgtactggtcatccatgaggccagtcgacgacactccgggatcccgtgagagattctctgcctcagctcgaggacagtcgcctacttgactatcgagtcgggcccaggtggacgagtgaagctagacttactattcgttacgcaccagacgagtagtgtcagtcgaggggttatcgggacgggacgggaccgtaggttcgacccggttcgttggtccacggacccgaaggtccgttaccggcccccgttcggtacctaccgttccgttccccg

SEQ ID NO: 89588 - DNA, 520 bp, Homo sapiens
  misc_feature: GYAE6OF02JJ32O.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgtggttccagcagaagtcaggccaggcccctgtactggtcatccatgagccagtcgacgacactccgggatccctgagagattctctgcctccagctcgagggacagtggccaccttgactatcgaggtcggggccccagggtcggacgagtgaagctgactactattgttacgcaccagacagtagtggtcagtcgaggggttatcggcggaggaccagttcggaccgttcgttggtcacggcccgaaggcctcgcccccgtggtccacttcgtccg

SEQ ID NO: 89589 - DNA, 554 bp, Homo sapiens
  misc_feature: GYAE6OF02HZECH.21.8.A08.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctcctatgagctgacacagcccaccctcggtgccagtcgtccccaggacaaacggccaggatcacctgctctggagattcattgccaaaagatatacttgttgttccagcagagtcaggccaggcccctgtactggtcatccatgagccagtcgacgacactccgggatcccgtgagagacttctctgcctccagctcgagggacngtcggccctaccttgactagtcgacggtcgggcccgagggtcggacgagtagagctagacttactattgtacgcaccagacagtagtggtcagtcggaggggttatcgggacggtagggaccgtagttcggaccggttccgttcggtacacggtacccgaaggtccgtccggtcccccgttcggtcctaccgttccgttcccgg

SEQ ID NO: 89590 - DNA, 545 bp, Homo sapiens
  misc_feature: GYAE6OF02GM75X.21.8.A08.1.454.CMB.1.raw
  modified_base (329)..(329): a, c, t, g, unknown or other
  misc_feature (329)..(329): n is a, c, g, or t
  modified_base (420)..(420): a, c, t, g, unknown or other
  misc_feature (420)..(420): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattcnctgcctccagctcgagggacagtcggccacttgactatcgaggtcggggcccagggtcggacgagtaggaagctgactactagttgttacncaccagacagtagtggtcatcgtaggggtattcgggcggagggacctaggttcgaccggttccgttaggtaccgacggacccgaaggcctccggtcccccgtcgggtacctaccgtcgttcccgg

SEQ ID NO: 89591 - DNA, 668 bp, Homo sapiens
  misc_feature: GYAE6OF02HCZAT.21.8.A08.1.454.CMB.1.raw
  modified_base (221)..(221): a, c, t, g, unknown or other
  misc_feature (221)..(221): n is a, c, g, or t
  modified_base (379)..(379): a, c, t, g, unknown or other
  misc_feature (379)..(379): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatcacctgctctgganattcattgaccaaaaagatatacttgttggttccagcagaagtcaggccaggcccctgtactggtcatccatgaggccagtcgacgacaccgtccgggactcccgtgaagagtattctctcgccctcagctcgagggacagtcgaccaccgttgactntcgaggtcgggcccagggtggacgagtagaacgtcgtagaacttacgttagttcgttaaccgacgtaaccgaagaccgtaaggttaacggttcggtaacctagttaccgggtaaaggggggtttaccgttacggggaaccggggtaacgggtaaccccggtaagggtttaccggtaaccccgggtttcccgtttaggggtacccgtaaccgggacccccgtaagggtccccggttacccggtaccccccccggttacgggttaccctacccgttcccgtttacccccgg

SEQ ID NO: 89592 - DNA, 524 bp, Homo sapiens
  misc_feature: GYAE6OF02IDB35.21.8.A08.1.454.CMB.1.raw
  modified_base (316)..(316): a, c, t, g, unknown or other
  misc_feature (316)..(316): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacaggctctgaggcctcctatgagctgacacagcccaccctcggtgtcagtgtcccaggacagacggccaggatcacctgctctgcagatggactgaccaaaagaaatatgctttattaggtaaccaacgagaagccaggccaggcccctgtgttagtgaatataataaagacactgagaggccctnagagatcccgtgagcgtattctctggctaccagctcgagggacagacagtctacgttgactatcagtgaagtccaaggcagacggacgnggctagactatacgtgtacaaacagtaanacgagtagaggtactcgtagttggtgttcgggacggaagggaccaggctacggaccgttccgtaggtccacggacccgaggcctacccgg

SEQ ID NO: 89593 - DNA, 524 bp, Homo sapiens
  misc_feature: GYAE6OF02GAQQM.21.8.A08.1.454.CMB.1.raw
  modified_base (218)..(218): a, c, t, g, unknown or other
  misc_feature (218)..(218): n is a, c, g, or t
  modified_base (323)..(323): a, c, t, g, unknown or other
  misc_feature (323)..(323): n is a, c, g, or t
  modified_base (457)..(457): a, c, t, g, unknown or other
  misc_feature (457)..(457): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagaatatacttgttgttccagcagaagtcaggccaggcccctgtactggtcatccatgaggccagtcgacgacactccgggatccctgagngattctctgcctcagctcagggacagtggcccacttgacatcgaggtcggggcccagggtgggacgatggaagctgacttaactattaggttaccgcaccagaacagtagtggtcagtgagggggttatcgggngggaggaccagttgaccggtccttggtcacgccgaaggctccggcccccgtggtccactccgttccg

SEQ ID NO: 89594 - DNA, 522 bp, Homo sapiens
  misc_feature: GYAE6OF02HMOU6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggccccctgtactggtcatccatgaggccagtcgacgacactccgggatcccctgagagtacttctctcgccctccagcctcgagggacagtcggcctaccgttgactatcgaggtcggggcccgagggtggacgatgaagctgactactattgttacgcaccagacagtagtgtcagtcgaggggtatcggcggaggacgagtcgaccgttcgtggtcacgccgaagctcgccccgtcgtctactcctcg

SEQ ID NO: 89595 - DNA, 640 bp, Homo sapiens
  misc_feature: GYAE6OF02I67VM.21.8.A08.1.454.CMB.1.raw
  modified_base (218)..(218): a, c, t, g, unknown or other
  misc_feature (218)..(218): n is a, c, g, or t
  modified_base (319)..(319): a, c, t, g, unknown or other
  misc_feature (319)..(319): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtgtccccaggacaaacggccaggatcacctgctctgganattcattgaccaaaagatatacttgttgttccagcagaagtcaggccaggcccctgtactggtcagtccatgagccagtcgacgacacgtccgggatcccngagagattctctcgcctccagctacgacgggacacggtcggccctaacctttcggaaccttagtcgaagggtcggggacccgagggtacggacgtagtacggaacgcgtagaaccgttaacttacgtttacgttaaccgaccacccgaagacgtaaggttacgtggtacagtacggtaagggggttacgttacgggacggggtaacgggtaaccggtacggtttacggtacccggtttccggttacgggtaccgaccggtacccgaacgggtcccgtaccggtccccccgttacgggtcccgtaccgttccgttaccccgg

SEQ ID NO: 89596 - DNA, 512 bp, Homo sapiens
  misc_feature: GYAE6OF02H6TDY.21.8.A08.1.454.CMB.1.raw
  modified_base (332)..(332): a, c, t, g, unknown or other
  misc_feature (332)..(332): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagattcnctgcctccagctcgagggacaggtcggcctaccttgactatcgaggtcggggcccagggtcggacgagtagaagctgacttactattgtacgcaccagacagtagtgtcagtcgaggggtatcggcggaggacagtcgaccgtcttggcacgccaaggctcgccccgtcggtcactctcg

SEQ ID NO: 89597 - DNA, 619 bp, Homo sapiens
  misc_feature: GYAE6OF02J276L.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgtgtccagcagaagtcaggccaggcccctgtactggtcatccatgagccagtcgacgacacgtcgggatcccgtgagagtatcctctgcctcagctcgaggcagtcgcctacgttgactagcgaggtcgggcctagggtggacgagtacgaacgtctaggaaccttacgttacgttacgttaccgcctaaccgaggtaaccgtaggtaacgttggtaccaaggtccggtaaggggggtactttaccggggaccgggaagggtacccgtaagggttccggaacccggttccgtttacggacccgtaaccggtaccccgaagggtcccgttcccggtaccccccggttggtaccccgttacgttccccgtttccccgg

SEQ ID NO: 89598 - DNA, 514 bp, Homo sapiens
  misc_feature: GYAE6OF02F0QXC.21.8.A08.1.454.CMB.1.raw
  modified_base (461)..(461): a, c, t, g, unknown or other
  misc_feature (461)..(461): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatcccgtgagagattctctcgcctccagctcgagggacaggtggccagttgacttctcgaggtcggggcccgagggtggaggatagaagctgacttactacttgttacgcaccagacagtagtgtcagtcgaggggtatcggnggaggactagtcgacgtctggtcacgccgagctcgcccctggctacgtctccg

SEQ ID NO: 89599 - DNA, 595 bp, Homo sapiens
  misc_feature: GYAE6OF02GRKPA.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccacggcccctgtactggtcatccatgaggccagtcgacgacacgtccgggatcccgtgagagtacttctcgtcgccctccgagtctacgacgggacacggtcggaccctaccgttgaactatcgaggtcggggacccgtagggtcggacgagtaggaacgtcgtagaacttacgtatttacgtaccgcaaccagacgtaggtagtcggtacagtacggtaggggttattcgggacggtacgggacgtaggttcggtaccggttccgttaggtaccgaccgtacccgaggtcctccggtcccccgtcggtccgtaccttccgttcccg

SEQ ID NO: 89600 - DNA, 559 bp, Homo sapiens
  misc_feature: GYAE6OF02GIV4Q.21.8.A08.1.454.CMB.1.raw
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctaggagagattctcngcctcagctgagggacnggtcgcctactgactatcgaggtcgggccaggtggacgagtagaagctagacttactattacgtacgcacagactaggtagtggtacagtcgaggggttattcgggacgggacggaccgtaggttcggaccggttccgttacggtaccgtacggacccgtaaggtccgttccggcccccgttcgggtccctaccgtccgttacccg

SEQ ID NO: 89601 - DNA, 514 bp, Homo sapiens
  misc_feature: GYAE6OF02GCW52.21.8.A08.1.454.CMB.1.raw
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagattctctcgcctccagctcgagggacagtcggccacttgactatcgaggtcgggcccaggtcggacgagtgaagctagactactagttcgtacgcaccgagacagtagtgtacagtcgaggggtattcgggcggaggacagttgaccgtcgtggcagccgaagctcgccctggtccncgtctcgtcccncc

SEQ ID NO: 89602 - DNA, 511 bp, Homo sapiens
  misc_feature: GYAE6OF02FW7M2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggccccctgtactggtcatccatgaggccagtcgacgacactccgggatcccctgagagattctctgcctccagctcagggacaggtcggccaccttgactatcgaggtggggcccagggtggacgagtgaagcgtgactactattgttaccgcaccagacagtagtggtcagttcgaggggtatcgggcggagggaccagttgaccgttctggtcagccaggctcgcccctggtcactctccg

SEQ ID NO: 89603 - DNA, 519 bp, Homo sapiens
  misc_feature: GYAE6OF02HUO9Q.21.8.A08.1.454.CMB.1.raw
  modified_base (330)..(330): a, c, t, g, unknown or other
  misc_feature (330)..(330): n is a, c, g, or t
  modified_base (409)..(409): a, c, t, g, unknown or other
  misc_feature (409)..(409): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacactccgggatccctgagagattcnctgcctccagctcagggcagtggcccacttgactatcagtgggcccaggtggacgatgaagctgactactattgttacncaccagacagtagtggtacagtcgaggggtattcggacggagggaccagttcgaccggtccgttggtcgacgacccgaaggctcgcccccgtacggtccaccgtcttccg

SEQ ID NO: 89604 - DNA, 576 bp, Homo sapiens
  misc_feature: GYAE6OF02GLAHP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatccctgagagattctctgcctccagcctcgagggacagtcggccaccgttgaactatcgaggtcggggcccagggtcggacgagtagaagcgtagacttactagttgttacgcaccagacagtaggtggtacagtcggtaggggtagttcgggacggacgggaccgtaggttcgacccggttccgtttagggtaccgtacggaccccgtaaggtccgttccggaccccccgttcgggtcccgtacccgttcgttaccccgg

SEQ ID NO: 89605 - DNA, 576 bp, Homo sapiens
  misc_feature: GYAE6OF02ILPDT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggccaggatcacctgctctggagattcattgaccaaaagaatatacttgttgttccagcagagtcaggccaggccctgtactggtcatccatgaggccagtcgacgacactccgggatcccgtgagagattctctcgccctccgagctcgacgggacaggtcggcccaccgtttgacctagtacgaggtcggggacccgtagggtcgggacgaagtggaagcgtaggaaccttacttattcgttaccgccaaccgagaacgaggtagtcggtacagtcgaggggttactcgggcgggaagggacctaaggttcggtacccggttcgttggtccgacgcccgaaggccctcccgtcccgtaccgtctccgtcgttccccg

SEQ ID NO: 89606 - DNA, 511 bp, Homo sapiens
  misc_feature: GYAE6OF02GALM1.21.8.A08.1.454.CMB.1.raw
  modified_base (422)..(422): a, c, t, g, unknown or other
  misc_feature (422)..(422): n is a, c, g, or t
  modified_base (459)..(459): a, c, t, g, unknown or other
  misc_feature (459)..(459): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacactccgggatccctgagagattctctgccctccagcctcgagggacagtcgggcccaccttgactatcaggtcggggcccagggtcggacgatgaagctgactactattgtacncaccagacagtagtggtcagtcgaggggtattcgggnggagggacagtgaccgtctggcagcccaaggctcgcccctggtcactctccg

SEQ ID NO: 89607 - DNA, 565 bp, Homo sapiens
  misc_feature: GYAE6OF02HYSGE.21.8.A08.1.454.CMB.1.raw
  modified_base (219)..(219): a, c, t, g, unknown or other
  misc_feature (219)..(219): n is a, c, g, or t
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccacctcggtgtcagtcgtccccaggacaaacggccaggatcacctgctctgganattcattgacaaaaagatatacttgttggttccagcagagtcaggccaggcccctgtactggtcatccatgaggccagtcgacgacacgtccgggatcccgtgacgagatttcnctcgcctcagctcgagggacaggtcgcctacttgactagtcgaggtcggggccctagggtggacgagtagaacgctagaccttaacgttagtttgtaccgcaccaggacaggtaagtgtacagtacggagggggttacgtcgggacggagggacctaggttcgtacccggtcgttacggtcacgcccgaaggtccgtccggcccccgttcggtactaccgtcgttaccccgg

SEQ ID NO: 89608 - DNA, 566 bp, Homo sapiens
  misc_feature: GYAE6OF02IZ7D7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttgttccagcagaagtcaggccacggcccctgtactggtcatccatgaggccagtcgacgacacgtccggatcccgtgagagattctctcgcctccagcctacgacggacgaggtcggccctaccttcgactagtccgagggtcgggggcccgggtggacggtagtaggacgtcgtacgacttactatttcgttacgcaaccagacgagtagtgtcagtcggtaggggtcttcgggacggacgggacctaggttcgtaccggttcgtggtaccaggtcccgaggtcctccgtccccgtcggtccaccgttctcgttcccccg

SEQ ID NO: 89609 - DNA, 521 bp, Homo sapiens
  misc_feature: GYAE6OF02FJ32E.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggtcagcagaagtcaggccaggcccctgtactggtcatccatgagccagtcgacgacacgtccgggatccctgagagacttctctgcctccagctcgagggatagtggccacttgactatcgaggtcgggcccgagggtggacgagtggaacgcgtgactacgtattgtacgcacagacagtagtgtcagtcgaggggtatcgggcggagggaccgtagtcgaccgtcgttggtacacgcccaaggcctcgcccccgtggtcctacgtcgtcccgg

SEQ ID NO: 89610 - DNA, 571 bp, Homo sapiens
  misc_feature: GYAE6OF02F1N07.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagtattctctcgcctccagtctcgaggggacaggtcggccctaccgttgaacctatcgaggtcggggcccgagggtgggacgagtggaagcgtgacttactattgtacgcaccagacgagtagtggtctagtcggaggggtattcgggacgggacgggaccgtaggttcggtaccggttccgttaggtaccgacgtacccgacggccgttccggtcccccgtcggtccgtaccgtccgttcccgg

SEQ ID NO: 89611 - DNA, 634 bp, Homo sapiens
  misc_feature: GYAE6OF02GE31X.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcactgctctgganattcattgaccaaaagatatacttgttggtcagcagaagtcaggccacggcccctgtactggtcatccagtgacggccaggtcgacgacacgtccgggactcccgtagacgagtacttctctcgccctccgagcctcgaggactaggtcgaccctacgttgactagtcgagggtcggggacccgtagggtcggaacgtagtaggaacgtcgtacgtacttaactagtttacggttaccgaccaacccaaggtaaccgtaggttacggttcggtacctagttacgggtaagggggttacgttcggggacggggtacggaaccgtacggttcggtacccggttcggttcgggtaccgacggtacccgaaggtccgtacccggtcccccgttcggtccctaccgttccgttaccccg

SEQ ID NO: 89612 - DNA, 656 bp, Homo sapiens
  misc_feature: GYAE6OF02H7ZE8.21.8.A08.1.454.CMB.1.raw
tcagtcgtcgctcgcacgaccggtgctcgatttagcatactctacaggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagattcattgaccaaaagatatacttgttgttccagcagaagtcaggccaggcccctgtactggtcatccatgaggccaagtcgacgacacgtccgggactcccgtgagagtattctctgcctcagctacgagggacagtcggcctaccgttgactagtcgacgggtcggggaccccgtagggtcggaacggtagtacggaacgtcgtagaaccttaacttaagtttacggttaccgtaccaaccgaacgaaccgtaggtaacggttcgtacgaagttaccggtaagggggttaacgttcggggacgggtaacggggaacccgtaaggtttcgggtaacccggttccggttacgggttaccgaaccgggttaccccgaacgggtcccgttacccgggccccccgtttcccgggtaccgttaccccgttccttaccccgg

SEQ ID NO: 89613 - DNA, 567 bp, Homo sapiens
  misc_feature: GYAE6OF02HG32G.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgacggccagtcgacgacacgtccgggactccctgagagattctctgccctccagcctacgagggacaggtcggccctaccgttgaccttatcgacggtcggggccctagggtcggacgagtaggaagctaggaaccttaacgttattacgttaccgacaaccaggaacaaggttagttcggtacagtcggaagggggttactcgggacgggagggaacctaggttcgaccgttcgttggtcacgccaggcctcggcccctggtacctaccgtctccg

SEQ ID NO: 89614 - DNA, 694 bp, Homo sapiens
  misc_feature: GYAE6OF02JIBL7.21.8.A08.1.454.CMB.1.raw
  modified_base (162)..(162): a, c, t, g, unknown or other
  misc_feature (162)..(162): n is a, c, g, or t
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgaaacngccaccctcggtgtcagtcgtccccaggacaaacggccaggatcacctgctctgganattcattgaccaaaagatatacttgttggttccagcagaagtcaggccaggcccctgtactggtcactccatggacgccagtccgacgacaccgtccgggactcccgtaggacgagtacttctctcgccctacaggtcctacggaagggtaccaggtcggaccctaaccgttgaacctatccgaggtacggggtccctaagggtcggaaccgtagttacggaacgtcgtagtaaccttacgtaacgtttacggttaccgacctaaccgtaacgacgtaacggttacggttcggtactacggttaccggtaagggggttacgttacggggacgggtaaacgggtaacccgtaagggtttccggtaacccggttccggttagggttaccgaaccgggtaccccggtaaggtcccgttaccgggtccccccgttaccgggttaacccgtacccgttccggttaccccgttccccccgg

SEQ ID NO: 89615 - DNA, 667 bp, Homo sapiens
  misc_feature: GYAE6OF02IVVU4.21.8.A08.1.454.CMB.1.raw
  modified_base (172)..(172): a, c, t, g, unknown or other
  misc_feature (172)..(172): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtntcagtcgtccccaggacaaacggccaggatcacctgctctggagtattcattgaccaaaagatatacttgttcggtccagcagaagtcaggccaggcccctgtactggtcatccatgacggccaggtccgacgacaccgtccgggactcccgtgagagtattcctcttcgccctccacgtcctcgagggactaggtcggccctaaccttgaacctacgtcggtacggggtcccgggacggtagggtacgggaacgtaggtaaggacgtacgtaacgttaaccttaacgttagtttaccggttaccgaccgtaaccgaagtacgtaggttacggtacgttacgtacggtacggggtacgggttacggtacggggaacgggtacggtaacgttaacggtcccggtaccgtttcggtacggtacgtacccggaaccggtacggtacccgtcccgtacccggtcgtaccctcgtcccgtttcccgtacccccttccccg

SEQ ID NO: 89616 - DNA, 515 bp, Homo sapiens
  misc_feature: GYAE6OF02G1CPE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggccccctgtactggtcatccatgaggccagtcgacgacactccgggatccctgagagattctctgcctccagctcgagggacagtggccaccttgactatcagtgggcccaggtggacgatgaagctgactactattgttacgcaccagacagtagtgtcatcgaggggtattcggcggagggaccagttgaccggtcgttggtcagcccgaaggccgtcgcccccgtggtcctacgtccgttccgg

SEQ ID NO: 89617 - DNA, 520 bp, Homo sapiens
  misc_feature: GYAE6OF02F91JB.21.8.A08.1.454.CMB.1.raw
  modified_base (220)..(220): a, c, t, g, unknown or other
  misc_feature (220)..(220): n is a, c, g, or t
  modified_base (452)..(452): a, c, t, g, unknown or other
  misc_feature (452)..(452): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggttcaagcagaagtcaggccaggcccctgtactggtcatccatgaggccagtcgacgacacgtccgggatcccgtgagagattctctcgcctccagctcgagggacagtcggcccacttgactatcgaggtcggggcccagggtcggacgatgaagctagacttactattgtacgcaccagacagtagtgtcagtcgaggggtntcggcggaggaccagtcgaccgttcgtggtcacgccgaaggcctcggccccgtcggtccacctctccg

SEQ ID NO: 89618 - DNA, 754 bp, Homo sapiens
  misc_feature: GYAE6OF02HGH04.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacacgtccgggatcccgtgagagtattctctcgcctccgagtctacgagggacaggtcggacctaccgttgacttactcgtacgggtcggggaccccgtagggtacgggaacggtagtacgggaaacggtcgtacggtaaccgtttaaccgtttaagttttaccggtttaaccggaccgtaaaccccgtaacggtaaccgtaagggtttaacggttacggggtacctaacggttaccgggtaacgggggggtttaacgtttaccgggggaaccggggtaacgggggtaaccccgggttaaagggttttaccgggtaaccccgggttttacccggtttacgggggttaacccgtaaccgggtaacccccggtaacggggtacccggttacccgggtccccccccggtttaccggggttacccttacccggtttccccggtttaccccggg

SEQ ID NO: 89619 - DNA, 542 bp, Homo sapiens
  misc_feature: GYAE6OF02HZQ1Q.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagcccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatcccgtgagagattcctctgccctcagctcgagggacaggtcggccctaccttgacttatcgaggtcggggcccagggtggacgagtggaagctagactactattgtacgcacagacagtagtgtacagtcgaggggttacttcggacggaggacctaggttcgaccgttcgttcggtcacggcccgaaggcctaccggccccctcggtcctaccgtcgttacccg

SEQ ID NO: 89620 - DNA, 693 bp, Homo sapiens
  misc_feature: GYAE6OF02H9YJD.21.8.A08.1.454.CMB.1.raw
  modified_base (220)..(220): a, c, t, g, unknown or other
  misc_feature (220)..(220): n is a, c, g, or t
  modified_base (336)..(336): a, c, t, g, unknown or other
  misc_feature (336)..(336): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggcaggactcacctgctctgganattcattgaccaaaaagaatatacttgttggttccagcagaagtcaggccaggcccctgtactggtcatccatgagccagtcgacgacacgtccgggatccctaggagagtattcncgtcgcctcagtctacgagggactagtcggccctaaccgttgaacccttagtccgtaagggtccgggggaccccgaggggtacgggaacgtagtaggaaaggtccgttacggtaaccttaaccgtttaagtttacgggtttaacccgaccgtaaacccgaacgtaacgtaacgggttaacgggttggttaccgtaaggtaccgggtaaggggggtttacgttaccggggacgggtaacggggaacctaacgggttacggtacccggttcccgtttacgggtacccgtaacggtaccccgtaacgggtccgttacccggtccccccgttcgggttaccctaccgttccgttaccccgg

SEQ ID NO: 89621 - DNA, 573 bp, Homo sapiens
  misc_feature: GYAE6OF02F9YBT.21.8.A08.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (371)..(371): a, c, t, g, unknown or other
  misc_feature (371)..(371): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaaaattntgttttttaggaccagcagaagtcaggccaggcccctgtgttggtcatccatgaggacaggagaccgaccctcgggactcccgtagagagacttctctggctccaactcgagggacgtggccacgttgattcncgaggtcgggcccgagggtcggaggtagtggaagcgtagactactacttgtactcgagacagacagcagtggtacagtcggagggggtctaggttcgggacggacgggaccgtagggttcgaccggtcgtacggtcgacggacccgaacggtccgtccgtccccgtcggtaccgtaccgttccgtccgttcccctacccccg

SEQ ID NO: 89622 - DNA, 532 bp, Homo sapiens
  misc_feature: GYAE6OF02IS3AX.21.8.A08.1.454.CMB.1.raw
  modified_base (455)..(455): a, c, t, g, unknown or other
  misc_feature (455)..(455): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgacggccagtcgacgacacgtccgggatcccgtgagagacttctctgccctccagctcgagggacaggtcgccctacttgacttatcgacggtcggggccgagggtggacgagtgagctagactatattgtacgcaccagacagtagtgtcagtcgaggggttntcggacggaggacgtagttcgaccgtcgttcggcgacgccgaaggcctcgtcccccgtcggtacctaccgtcgtccg

SEQ ID NO: 89623 - DNA, 683 bp, Homo sapiens
  misc_feature: GYAE6OF02GTP0G.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaaagatatacttgttggttccagcagaagtcaggccaggcccctgtactggtcatcatgaggccagtcgacgacacgtccgggatcccgtgagagtattcctctcgccctccgagtctacgagggacacggtcggcctaccgttgaactacgtcgaggtcggggcccagggtcggaacgtagtcggaagtcgtagtaacttacgttagtttacgttaccgaccaaccgagaacgtaaggttacggttagggtacctaaggttaccgggtaaggggggttaacgttaccggggtacgggaaccgggggtaacccgttaagggtttaccgggtaaccccgggtttaccggtttacgggtacccggtaaccgggtaacccccgtaacggggtcccttccccgggtaccccccggtttccgggtacccgttacccggttcccgtttaccccggg

SEQ ID NO: 89624 - DNA, 528 bp, Homo sapiens
  misc_feature: GYAE6OF02GWEER.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccgtgagagattctctgccctcgagctcgagggacaggtcggacctaccgttgaccttagtccgagggtcggggacccagggtcgggacgagtggaagccgtagacttactagttgttacgcaccagacagtagtgtcatcgaggggttactcggcggagggacagttcgaccgtcgtgcagccgagcgtccgcccgtcgtcactcgtccg

SEQ ID NO: 89625 - DNA, 606 bp, Homo sapiens
  misc_feature: GYAE6OF02HZEH6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacctcggtgtcagtgtccccaggacaaacggccaggactcacctgctcgtggagattcattgaccaaaaagatatacttgttggttccagcagagtcaggccaggccctgtactgtcatccatgagccagtcgacacacgtccgggatcccgtgagagtacttcctctcgccctcgagcctcgaagggacaggtcggaccctaccttgaccttatcgaggtcggggccccgagggtcgggacgagtaggaacgtcgtagtaaccttacgttagtttacgttaaccgtacaacccgagaacgtaaggttagtggttactagttacggtaggggttacgttacgggacgggacgggaccgtaggttcggacccgttcgttacggtaccgtacggtcccgaaggtccgtccggtcccccgttcggtcctaccgttcgttccg

SEQ ID NO: 89626 - DNA, 630 bp, Homo sapiens
  misc_feature: GYAE6OF02F7KJG.21.8.A08.1.454.CMB.1.raw
  modified_base (479)..(479): a, c, t, g, unknown or other
  misc_feature (479)..(479): n is a, c, g, or t
  modified_base (500)..(500): a, c, t, g, unknown or other
  misc_feature (500)..(500): n is a, c, g, or t
tcagtcgtcgctcgcacgaccggtgctcgatttagcatactctacagggggcgtgtgggctcgaggaggcacgagcctctgggaatcctcacctatggcctggacccctctcctgctcccctcctcactttctgcacagtctctgaggcctctatgtacgctgacactagccaccctcggtgtcagtgtccccaggacaacggccaggactcgacctgctctggacgtagttccagttcgaccaaaagtactatacttgttgttcaagcgaagtaagtctaggcctaggtccccctagtacctggtcactccatcggacggccgagtcggacgacgaccgtccgggacttccctaggacgagtacttcgcttcgcctccagtctcgacgggacaggtcggccctacgttggacctatcgaacggtcgggcccagggtcggaacgagtagaacgtccgtgaaccttacgtatttcgtacncaaccagactaggtagtgtanacgttcgggaagggggttaacttccgggcgggtaacgggtaccgtaggtttcgacccggttccgttaggtaccgaaggtacccgaaggtcgtccggtcccccgttacgggtcctaccgtcgttaccccgg

SEQ ID NO: 89627 - DNA, 639 bp, Homo sapiens
  misc_feature: GYAE6OF02IDVIB.21.8.A08.1.454.CMB.1.raw
  modified_base (221)..(221): a, c, t, g, unknown or other
  misc_feature (221)..(221): n is a, c, g, or t
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttaccagcagagtcaggccaggcccctgtactggtcatccatggacgccagtcgacgacacgtccgggactcccngagagtattctctcgcctcagctcgacgggcaggtcgacctaccttgactatcgaggtcgggacccgagggtggacgagtaggaacgcgtagaacttacgtttattgttaccgacctaaccgaagacgtaaggtacggtggtactaacgttacgggtaagggggttacgttaccggggacggggtaacggggaaccgtaaggggtttaccgtaaccccgggtttcggtttaacggttccggaaccggtaccccgtaagggtcccgtacccggtccccccggtaccggttaccgtacccgttcctttacccccgg

SEQ ID NO: 89628 - DNA, 728 bp, Homo sapiens
  misc_feature: GYAE6OF02G3P98.21.8.A08.1.454.CMB.1.raw
tcagtcgtcgctcgcacgaccggtgctcgatttagcatactctactagggggtcggtgtgggctccaggaggcagagcgtcgtgggtaactctcgaccatggcctggacccctctacctgctcccccgtcctcactttctgcgactaggtctcgtgaggtccgttcctattgagtcttagacgtacacgcctacccgttcggtgtctagtcgtaccccgagggaccgaaacgggccggaggactcgacctggccgtcgtcggagattcattcgacaaagatagtacgttgttcggttccagtcagtaagtcaggccaggccccgtgtaccgtggtcactccgatggacggccgaggtcggacggacaccgtcgggattcccgtggagagtaattctcgtcgtccttccgagctcgacgggtacaggtcgggaccctaccgttcgaaccttagtccgtacggtcggggacccgagggttcggacgtacgtaacgaacgtccttacgtaccttaacgtacgtttacgttaaccgacgtaaccgaacgtactaacggttacggtacggtaccgtacgttacggtaagggggtttacttaccgggacgggtaccggggaccgttaaggttaccggtaacccgggttccggttacgggtaccgtaccgggtaccccgtaagggcccgttaccggtacccccgttcgggtcccgtaccggtccgttaccccggg

SEQ ID NO: 89629 - DNA, 554 bp, Homo sapiens
  misc_feature: GYAE6OF02IX14R.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcaggccaggcccctgtactggtcatccatgaggccagtcgacgacacgtccgggatccctgagagattctctcgccctccagctcgagggacaggtcggcctacgttgactatcgaggtcggggcccagggtggacgagtgaagctagactacttattgttacgcaccagacagtagtggtcagtcgaggggtattcgggcggaagggaccgtaaggttcgaccgttcgttcggtacgacggacccgaaggtcctccggcccccgtcggtccaccgtcgtccgttccccgtcccc

SEQ ID NO: 89630 - DNA, 579 bp, Homo sapiens
  misc_feature: GYAE6OF02JBLWI.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctggtgtcagtcgtccccaggacaaacggccaggatcacctgctctgganattcattgaccaaaagatatacttgttgttccagcagaagtcaggccaggcccctgtactggtcatccatgacggccagtcgacgacacgtccgggatccctgagagtattcctctcgccctccagcctcgacgggactagtcggccctaccgttgactagtcgaggtcgggccagggtggacgtataggaagtctaggacttacgtattcgttacgctaccgagactagtagtcggtatacgtacggtaggggttacttcgggacgggtagggacccgtaggttcgaccggttccgttggtccgtacgacccgaaggtccttcccggcccccgttacggtccgtacccgttcgttacccg

SEQ ID NO: 89631 - DNA, 552 bp, Homo sapiens
  misc_feature: GYAE6OF02IZV9N.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgacggccaggtcgacgacacgtccgggatcccgtgagagtattctcgtcgccctccagtcctcgagggacaggtcggccctacttgactatcgaggtcggggcccgagggtcggacgagtagaacgtccttactacttacgttagttactcgagcagacagactagtgtcagtacgaggggctaggttcggcgggacggacgaggttcggaccgtcgtacggtcgacgaccgacggccgtccggccccgtcggtcctacg

SEQ ID NO: 89632 - DNA, 583 bp, Homo sapiens
  misc_feature: GYAE6OF02HM4W9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagtattctctcgccctccagcctcgacgggacaggtcggccctaccgttgaccttatcgaggtcggggcccctagggtcggacgagtaggaaggctagaacttacgttattcgttacgccaaccgagactaggtaggtgtacgagtcgtaagggggttactcgggacggacgggtaccgaggttcggacccgttccgttaggtaccgacgtaccccgaaggcctccggtcccccgtcggtccctaccgtcgtcccgg

SEQ ID NO: 89633 - DNA, 609 bp, Homo sapiens
  misc_feature: GYAE6OF02IHI84.21.8.A08.1.454.CMB.1.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
tcagtcgtcgctcgcacgaccggtgctcgatttagcatactctacaggggcgtgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcacctgctctggagattcattgaccaaaagatatacttgttggttccagcagagtcaggccaggcccctgtactggtcatccatgacggcagtcgacgacactcgggacttccngacgatacttcgtcngcctccagcctcaaggggtacagtcggaccctacgtttggaacctatacgaggtcggggacccgtagggtcgggaacgtacgtaggaaacgcgtaggaccttaacgttattcggttacacgtaccagactaggtagtcgtacgtagtacgaggggttacgttacggcgggtaaggacccgtagttccggtaaccgtccggttaggttccgaacggtacccgaacggtccggtacccgtcccccgttacgggtacccaccgtttcccgttacccgg

SEQ ID NO: 89634 - DNA, 530 bp, Homo sapiens
  misc_feature: GYAE6OF02HIKB1.21.8.A08.1.454.CMB.1.raw
  modified_base (218)..(218): a, c, t, g, unknown or other
  misc_feature (218)..(218): n is a, c, g, or t
  modified_base (520)..(520): a, c, t, g, unknown or other
  misc_feature (520)..(520): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgagccagtcgacgacactccgggatccctgagagattctctgcctccagctcgagggacagtcggccaccttgactatcgaggtcgggcccagggtggacgtagtggaagtcgtgaacttacttagttcgttacgcaccagacagtagtgtacagtcgaggggtatcgggacggagggaccgagttcgaccgtcgttggtcacgcccgaaggcctccgccccgtcggtccnccgtctcccg

SEQ ID NO: 89635 - DNA, 639 bp, Homo sapiens
  misc_feature: GYAE6OF02IKXPH.21.8.A08.1.454.CMB.1.raw
  modified_base (221)..(221): a, c, t, g, unknown or other
  misc_feature (221)..(221): n is a, c, g, or t
  modified_base (337)..(337): a, c, t, g, unknown or other
  misc_feature (337)..(337): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggaccaaacggccaggatcacctgcctctgganattcattgaccaaaagatatacttgttggttccagcagaagtcaggccaggcccctgtactggtcatccatgagccagtcgacgacacgtcccgggatcccgtagagagtacttcnctgccctccagctacgagggtacagtcgcctacttgacttatcgaggtcgggcccagggtcggacgtagtacggaagtcgtagacttacttagttacgttaaccgctaacccgaaggtactagggttacgtaggtacacgttaccgaaggggggtttacttccggggacgggtaacggggtaccctaagggttaccggtacccggttccggtttacgggtaccgtaaccggtaccccgtaagggtcccgttacccggtcccccccggtacgggttaccttaccccgttcggtttacccccgg

SEQ ID NO: 89636 - DNA, 649 bp, Homo sapiens
  misc_feature: GYAE6OF02G1NKW.21.8.A08.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctcgtggagattcattcgaaccaaaagatatacttgttggtccagcagaagtcaggccacggcccctgtactggtcatccagtggacggccagtccgaaccgacacgtccgggatcccgagagagtacttcncgtcgccctcgaagtcctacggaacgggcaggtccggacctacgttagaactagtcgacgggtcgggaccgagggtggacgtagtaggaacgtcgtacgaacttacgtacgtttacggttaccacgaaccgacgtaacgtacggtagttaggtacgtaagttcgggtaagggggtttacgtacgggacgggaacgggtaaccgtagggttcggtaccggttccggttacggtaccgtaaccgtacccggtaacggccgtccccggtcccccgttaccgggtacccttaccggtacctttccccgg

SEQ ID NO: 89637 - DNA, 559 bp, Homo sapiens
  misc_feature: GYAE6OF02GUEX7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacaccgtccgggatccccgtgagagattctctgcctccagctcgagggacaggtggacctaccgtttgactactcaggtcggggcccagggtcggacgagtgaagctgacttacgtagttacgttacgcaccagactagtagtggtctagtcgtaggggttacttcgggacggacgggaccgtagttcggtaaccgttccgttaggtaccacgacccgaaggcctcgcccccgtcggtacctaccgtcgttcccg

SEQ ID NO: 89638 - DNA, 619 bp, Homo sapiens
  misc_feature: GYAE6OF02I0MWH.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaacggccaggatcacctgctctgganattcattgaccaaaaagaatatacttgttggttccagcagaagtcaggccaggcccctgtactggtcatccatgacggccagtccgacgacacgtcccgggatcccgtgagagattcctctgccctccagcctacgagggacaggtcggacctaccttgactatcgagtcggggcccagggtcgggacagtgaagtctagacttactagttgttaacgaccaccaagacgaggttagtggtactagtcgggaagggggttagtccgggtacgggaacgggtaccgtaagggtttcgggtaacccgtttccggttacgggtaccgaaccgggtaccccgtaaagggtccccgttccgggtccccccggttaccgggtaccctacccggttcccttccccggg

SEQ ID NO: 89639 - DNA, 523 bp, Homo sapiens
  misc_feature: GYAE6OF02G0UH7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggccccctgtactggtcatccatgaggccagtcgacgacactccgggatcccctgagagattctctgcctccagctcagggacagtggcccaccttgactatcagtcggggcccagggtggacgagtgaagctgacttactattgttacgcaccagacagtagtggtcagtcgaggggttatcgggcggagggaccgagttgaccggttccgttggtcgagcccgaaggctcgccccgtggtcctacgtctcccg

SEQ ID NO: 89640 - DNA, 558 bp, Homo sapiens
  misc_feature: GYAE6OF02FSPFH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagtattcattgaccaaaagaatatacttgttggttccagcagaagtcaggccaggcccctgtactggtcatccatgaggccagtcgacgacactccgggatccctgagagattctctgcctccagctcgagggacagtcgccctacttgactatcgagtcgggcccagggtggacgagtaggaagcgtgtaacttactagttgttaccgcaccgagacagtagtggtctagtcgaggggtatcgggacgggacggacctaggttcgaccggtccgttaggtaccgacggacccgaaggtcccgtccggtcccccgtcggtccctaccgtccgttacccgg

SEQ ID NO: 89641 - DNA, 522 bp, Homo sapiens
  misc_feature: GYAE6OF02FJVGA.21.8.A08.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgcctccagctcgagggacagtcggccaccttgactatcgaggtcggggcccaggtggacgatgaagctgacttactattgttacgcaccagacaggtagtgtcatcgaggggtnttcgggacggaggaccagttgaccgttcgtggtcgagcccgaaggcctcggcccccgtcggtcctacgtctcccg

SEQ ID NO: 89642 - DNA, 666 bp, Homo sapiens
  misc_feature: GYAE6OF02JVXRR.21.8.A08.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggaccaaacggccaggactcacctgctctggagattcattgaccaaaagactntacttgttgtccagcagagtcaggccaggcccctgtactggtcatccagtgacggccagtccgacgacacgtccggatcccgagacgagtacttctcgtacgtccctccgaagtcctacgaacggggacctaggtcggccctaccgttgaccttacgtcgacggttcggggacccctagggtacggaccgtagtcggtaaacgtccgttacggaaccttaacgttacgtttacgttaaccggacccgtaaccgaaggtaaccgtaggttaacggttcggtacctaggtaccggtaggggggttacttccggggaacgggttacgggaaccgtacggttacggacccggttccggttagggtccgaacggtacccgaacggtcctacccggcccccgttaggtaccgttaccgttccgttaccccg

SEQ ID NO: 89643 - DNA, 506 bp, Homo sapiens
  misc_feature: GYAE6OF02JSLQZ.21.8.A08.1.454.CMB.1.raw
  modified_base (400)..(400): a, c, t, g, unknown or other
  misc_feature (400)..(400): n is a, c, g, or t
  modified_base (447)..(447): a, c, t, g, unknown or other
  misc_feature (447)..(447): n is a, c, g, or t
tcagtcgtcgctcgcacgaccggtgctcgatttagcatactctacaggggggaggaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggcttccttgccatgcactgggtccgccaggctccgaggcaaggggctggagtgggtggcgattatctggtatgatgggaagtggagagatattattcagactccgtgaacgggtcattcacatctaccaganacaatcgaccaacaacacactgtatcttacaatcgaccgctgacganccgagacacgatatgtatctagtagagtcttggtcagttcgggccagggtacctggtac

SEQ ID NO: 89644 - DNA, 569 bp, Homo sapiens
  misc_feature: GYAE6OF02G9VG6.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcactgctctgganattcattgaccaaaagatatacttgttggttccagcagaagtcaggccaggcccctgtactggtcatccatgagccagtcgacgacacgtccgggatcccgtgagagattctctcgcctcagctcgagggacagtcggcctacgttgactatcgaggtcgggcccagggtcggacgataggaagctagactacgtattcgtacgcacagacagtagtgtacagtacggtagggggttattcgggacgggtagggaccgtaggttcggacccggttccgttcggtaccgacggaccccgtaagggtcccttaccggtccccccgttcgggtccctaccgttccgttaccccgg

SEQ ID NO: 89645 - DNA, 515 bp, Homo sapiens
  misc_feature: GYAE6OF02IQSRW.21.8.A08.1.454.CMB.1.raw
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacactccgggatcccgtgagagattctctgcctccagctcgaggacagtggccaccttgactatcaggtcgggcccagggtggacgagtgaacgctcgactactattcgttacgcaccagacagtagtgtcagtcgaggggttntcggnggagggactaggtcgaccgtcttggtcacgccaaggctcgccccgtcggcctacgtctccg

SEQ ID NO: 89646 - DNA, 559 bp, Homo sapiens
  misc_feature: GYAE6OF02GTBVZ.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactggtcatccatgaggccaggtcgacgacacgtccgggatccctgacgagattctctcgcctccagctcgagggacaggtcggccctacttggaacttactcgagggtcgggcccagggtcggacgatggaagctgactacttagttcgtacgcaccagactagtacgtgtacagtcgaggggtattcggggcggacgggactaaggttcgaccgttcgtaggtcgacgacccgaacggtccgtccgccccgttcggtcctaccgtcgttccgtcccgtccccg

SEQ ID NO: 89647 - DNA, 555 bp, Homo sapiens
  misc_feature: GYAE6OF02IZ7U9.21.8.A08.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgagccagtcgacgacactccgggatccctgagagacttctactgccctccagctcgagggacaggtcggccaccgttgactatccgaggtcggggcccagggttggaacgtagtagaagcgtagacttactattcgtacgcaccagacagtagtggtnagtcgaggggctaggttcggacgggacgggacgaggttacgaccggttaccgttaggtccgacggacccgacggtcgtcccgcccccgttacggtcccgtacttccgg

SEQ ID NO: 89648 - DNA, 561 bp, Homo sapiens
  misc_feature: GYAE6OF02IF5FB.21.8.A08.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtcccaggacaaacggccaggatcacctgctctggagattcattgaccaaaaaaattnttgttttttggaccagcagaagtcaggccaggcccctgtgttggtcagtccagtgaggacaggacgaccgacccgtccgggactcccgtgagtagattctctcggctccaactcgaggggcggtggccgtacgttgattcacgtaggtcggggcccgagggtcggaggagtgaagctgactactactgttactcagcagacagcagtgcagtcgaggggcagttcggacgggacggaccgagggttcgaccggtcgtacggtcgacggccgaacggccgtccgcccccgtcggtcctaccgtcgttccgttacccctacccc

SEQ ID NO: 89649 - DNA, 504 bp, Homo sapiens
  misc_feature: GYAE6OF02JMYU7.21.8.A08.1.454.CMB.1.raw
  modified_base (240)..(240): a, c, t, g, unknown or other
  misc_feature (240)..(240): n is a, c, g, or t
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
  modified_base (376)..(376): a, c, t, g, unknown or other
  misc_feature (376)..(376): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagtcgtcgctcgcacgaccggtgctcgatttagcatactctacagggggctgtgggctcaggaggcagagctctgggaatctcaccatggcctggatccctctacttctccccctcctcactctctgcacaggctctgaggcctcctatgagcctaaacacagcccaccctcggtgtcagtgtccccaggacagacggccaggatcacctgctctgcagatggactgaccaaagaatntgcttattggtaaccaacagaagcaggccaggcccctgtgttagngatataataaagacactgagacggccctcagagactcccgtgacncgactttctctcggctccgagctacgagggacagcagtcacgttanactatcagtgaagtccaggcaggaggacgaggctacggactactacgtagtacaaacagtaagacgagtagagtacanagttgngtcggaggnggaccagctgaccgtcgaggtcagccaggctaccg

SEQ ID NO: 89650 - DNA, 576 bp, Homo sapiens
  misc_feature: GYAE6OF02III7R.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctggagattcattgaccaaaaagatatacttgttggttccagcagagtcaggccaggcccctgtactggtcatccatgaggccagtcgacgacacgtccgggatcccgtagagagactttctcgtcgccctccagtcctcgaagggacaggtcggccctaccttgaccttatcgaggtcggggcccgagggtcgggacgagtagaagcgtagaaccttacttagttcgttaccgcaccagacgagtagtgtcagtcggtaggggtagttcgggacggagggaccaggttcggtaccgtcgttcggcgacggacccgaaggtccgtccggtcccccgtcggtacctaccgttcgttcccgg

SEQ ID NO: 89651 - DNA, 534 bp, Homo sapiens
  misc_feature: GYAE6OF02IQR7A.21.8.A08.1.454.CMB.1.raw
  modified_base (489)..(489): a, c, t, g, unknown or other
  misc_feature (489)..(489): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctggggggaggcatggtccagcctgggaggtccctgagcctctcctgtgcagcgtctggattcagtatcggctcctttgccatgcacgtggggtcccgccaggcctccgaggcgaagggggctgggaggtggggtggcgattatcgtggtatggatgggaagtgagagatattatcagctcggtgaacgggccattcacatcctcagagacaatcgaccaacaacacactgtatcttacaatcgaccgtctagagacgccgaggacacggctagtgtattctagtacgngttcgtttggctaggttcgggaccgacgggtacccgtggtacccg

SEQ ID NO: 89652 - DNA, 653 bp, Homo sapiens
  misc_feature: GYAE6OF02GPB5T.21.8.A08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctcgtggagatgcattgaacctaaaaaatttnttgtttttacgaccagtcaagaagtcaggccacggcccctgtgttggtcatccatgagacgaggacgaccgaccgtccgggactccccgtagagacgtattcctcgtcggcctaccaactcgacggggtacggtcggcctacggttgtactttctcgtagggtcggggacccgtaggggtgggaagggtagtagggaagtcgtaggtaacgttacttaccgttgttacctacacggcaacggacagctaggtcggtacaagtcggaacgggggtctaggttcgggacggtacggaccgtagggttacgacccggttaccgtagggtccaaccgggtcccgaaacggtcccgttccggaccccccgttcgggtaccctacccgttccgttacccgttcccctaaccccccg

SEQ ID NO: 89653 - DNA, 582 bp, Homo sapiens
  misc_feature: GYAE6OF02FJN4M.21.8.A08.1.454.CMB.1.raw
tcagtcgtcgctcgcacgaccggtgctcgatttagcatactctacgaggggggctgtgggcctcaggaggcagagcttctgggaatctcaccatggcctggacccctctcctgctccccctcctcactttctgcacagtctcttgaggcctcctatgagctgacacagccaccctcggtgtcagtcgtccccaggacgaaacggccaggatcaccgtgctctggacgtattcattcgaccaaaaagaatatactttgttaggttccagcagaagtcaggccaggcccctgtactggtcagtccagtgaggccagtacgaacgacacgtccgggatcccgtagaagagtatttctctcgccctaccgagctacgacggacagtcgcctaccgttgactatacgaaggtcggggaccagggtcggacgagtagaagcgtagaacttaacgtattacgttaccgacaccagactagtagtgtacagtacgaggggtacttcggcgggacggaactaggttacgaccggttccgttaggtcacgtacccgaaggtcctcggtccccgtcggtccacgttccttccg

SEQ ID NO: 89654 - DNA, 559 bp, Homo sapiens
  misc_feature: GYAE6OF02HBJPK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagattctctcgcctccagtcctcgagggacagtcggcctaccgttgactatcgaggtcggggcccagggtcggacgagtgaagctagactactattgtacgcaccagacagtagtcggtcagtcgagggggttatcgggacgggacgggaccaggttcgacccggttcgttacgggtcacggtacccgaaggccgttccggcccccgtcgggtaccctaccgttccgttcccgg

SEQ ID NO: 89655 - DNA, 621 bp, Homo sapiens
  misc_feature: GYAE6OF02H4U0F.21.8.A08.1.454.CMB.1.raw
  modified_base (223)..(223): a, c, t, g, unknown or other
  misc_feature (223)..(223): n is a, c, g, or t
  modified_base (334)..(334): a, c, t, g, unknown or other
  misc_feature (334)..(334): n is a, c, g, or t
  modified_base (364)..(364): a, c, t, g, unknown or other
  misc_feature (364)..(364): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgacacagcccaccctcggtgtcagtcgtccccaggaccaaacggccaggatcacctgctcgtgganattcattgaccaaaagatatacttgttgttccagcagaagtcaggccaggccctgtactggtcatccatggagccaggtcgacgaccacgtcccgggatcccgtgagagtntttctctcgcctccgagcctacgagggacnggtcgccctacttgactagtcgacggtcggggaccgagggtgggacgagtacgaagcgtagtaacttacgttagttacgttaaccgactaaccgacgtacgtaaggtaggtacggttacgagtacgggtaagggggttacgtacgggacgggacggggtaaccgtaggttaccggtacccggttccgttacgggtaccgacggtacccgaacggtccgtaccggccccccgttacgggtcctaccgttccgtacccg

SEQ ID NO: 89656 - DNA, 536 bp, Homo sapiens
  misc_feature: GYAE6OF02HND98.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctctggagattcattgaccaaaaagatatacttgttggttccagcagaagtcaggccaggccccctgtactggtcatccatgaggccagtcgacgacactccgggatccctgagagattctctgcctcagtctcgagggacaggtcggcctaccttgactatcgacggtcggggcccgagggtggacgagtgaagctgacttactattgtacgcacagacagtagtgtcagtacgagggggtattcgggcgggagggaccgagttcggacccggtcgttggtcacggcccgaaggctcggccccctcggtcctacgtccttcccg

SEQ ID NO: 89657 - DNA, 703 bp, Homo sapiens
  misc_feature: GYAE6OF02IGNWO.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctctgganattcattcgaccaaaaagaattacttacgttgttcggttccagcagaagtcaggccaggcccctgtactggtcactccagtcgaggccagtcgacgacacgtccgggactcccgtagagacgtacttctcgtcgcccttacagtccctacggagggtaccaggtacggccctaaccgttggaacttacgtcgacgggtccggggacccgtaggggtacggaacggaacgttcggaaacggtcgtacgtaaccgttaaccgtttaagtttacggttaaccgccgaaaccgtaacggaacgtaacggttagggttacgtacgttaacgtaccggtaagggggttaccgttcgggaaccggggaacggggtaaccgtacggtttcgggtacccggttccggtttcgggtaccgtaaccggcccggtaagggtcccgttacccggtccccccggtttcggtaccctcccgttaccgttacccccggg

SEQ ID NO: 89658 - DNA, 572 bp, Homo sapiens
  misc_feature: GYAE6OF02H7WC6.21.8.A08.1.454.CMB.1.raw
  modified_base (220)..(220): a, c, t, g, unknown or other
  misc_feature (220)..(220): n is a, c, g, or t
  modified_base (410)..(410): a, c, t, g, unknown or other
  misc_feature (410)..(410): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaaagatatacttgttggttccagcagaagtcaggccaggcccctgtactggtcatccatggagccagtccgacgacacgtccgggatcccgtgagagtattctctgccctcagcctcgaagggcagtcggccctacttgactatcgaggtcggggccagggtcggacgatggaacgntagaactacttattgtacgcaacagacagtagtgtacatcgtaggggtattcgggacgggtagggaaccgtaggttacggtacccggttcgttacgggtcgacggtaccccgaagggtccgttacccggccccccgttcggtacctacccgtcgttccccgg

SEQ ID NO: 89659 - DNA, 569 bp, Homo sapiens
  misc_feature: GYAE6OF02IKO4L.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctctggagattcatgaccaaaagatatacttgttggttccagcagaagtcagccaggcccctgtactggtcatccatgagccagtcgacgacactccgggactcccgtagagagattcgtctgcctcagctcgaggacagtcggccacttgactatcaggtcgggaccgaggtggacgagtgaagctaggactactagttacgttacgcaccgagactagtagtggtcagtacgaggggttacgttcggacgggtaacgggaccgtaggttcggaacccggttccggtttcggtaccgtaacggccccgtaaaggccgtaccggtcccccccgttacgggtccctaccgttccttcccgg

SEQ ID NO: 89660 - DNA, 543 bp, Homo sapiens
  misc_feature: GYAE6OF02HFQO9.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatgaggccaggtcgacgacacgtccgggatccctgagagattctctgcctccagctcgagggacagtcggcctaccgttgactatcgaggtcgggcccgtaggtggaacgagtagaagctgacttactattgtacgcaccagacagtagtggtcagtcggaggggttatcgggacgggtagggaccgtaggttcgaccggttcgttggtcgacgacccgaaggcctcggccccgtcggtcctaccgtccgtccgg

SEQ ID NO: 89661 - DNA, 510 bp, Homo sapiens
  misc_feature: GYAE6OF02FKQAD.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcgagggacagtggccacttgactatcagtcggggcccagggtggacgatgaagctgactactattgttacgcaccagacagtagtgtcatcgaggggtatcggcggaggacctaggttcgaccgtcgttggtcacgcccgaaggctcggcccccgtggtccactctccg

SEQ ID NO: 89662 - DNA, 540 bp, Homo sapiens
  misc_feature: GYAE6OF02GPXZP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagtattccgtctcgccctccagtctcgagggacagtcggcctaccttgactatcgaggtcggggcccgagggtggacgagtaggaagtcgtagacttactagttgtaacgcacagacgagtagtgtacagtcgaggggttagtcggagggaggacgtagttgaccgttcgtcggtcacgtccgaggtctccggcccctcggtctacgtctacccg

SEQ ID NO: 89663 - DNA, 733 bp, Homo sapiens
  misc_feature: GYAE6OF02F1HS1.21.8.A08.1.454.CMB.1.raw
tcagtcgtcgctcgcacgaccggtgctcgatttagcatactctacagggggcgtgtgggctcaggaggccagagcctctgggaatctcaccatggcctggacccctctcctgctcccctctcactttctgcacagtctctgagcctcctatgagctgacacacgcccaccctcggtgtcagtcgtccccgaggaccgaaacggccgaagggactccgaacctcggcgtctggagtattcattcggaccaaaaaggaattattaccgttgttcggttccagcagaagtcagccaggcccctgtactggtcactccgagtcggacggccgagtcgacgaccgacgtccgggactcccgtaggaacgtagtacgtttccgtacgtcgtcccttaccgacgtacccgtacggaacggggtaactacgggtccgggaccctaccgtttacggaacctttacgtacgtacggggtccggggaccccgtacggggtccgggaacgtacggtacggaacggtaccgtacggtaaccgttacgttacgtttacggttaccgacgtacccgaaggtacgtaaggtacggttacggtacgtacggtacggtaacgggggttacgttccgggtacgggtacgggtaccgtaggttacggtaccgttccggttacggtaccgaacgtacccgtaacggtcccggttccggtacccccgttcggtacccgtaccgttccgttcccgg

SEQ ID NO: 89664 - DNA, 633 bp, Homo sapiens
  misc_feature: GYAE6OF02GYMK7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggccccctgtactggtcatccatggaggccaggtccgacgacacgtccgggatcccgtgagagtattcctctcgccctccagcctcgagggacaggtcggcctaccttgactatcgaggtcggggccctagggtcgggacgtagtacggaagccgtggaaccttaacttagtttacggttaaccgccaaccgaacgacgtaaggttacggtcgggtaccgaaggttacggtaaggggggttacttcggggaccggggacggggtaaccgtaggtttcggtacccggttccgttcgggtaccgaacggtacccgtaagggtcccgttccggtcccccgttcgggtccctaccgttccgttccccgg

SEQ ID NO: 89665 - DNA, 555 bp, Homo sapiens
  misc_feature: GYAE6OF02JENXF.21.8.A08.1.454.CMB.1.raw
  modified_base (218)..(218): a, c, t, g, unknown or other
  misc_feature (218)..(218): n is a, c, g, or t
  modified_base (319)..(319): a, c, t, g, unknown or other
  misc_feature (319)..(319): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgccaaaagatatacttgttggtccagcagaagtcaggccaggcccctgtactggtcatccatgaggccagtcgacgacacgtccgggatcccgngagagattctctgccctcagctcgagggacagtgcccaccgttgactatcaggtcggggcccagggtggacgatgaagctgactactagttcgttacgcaccagacagtagtggtctagtcgtaggggttagtcgggcgggacgggacgtacggttacggtaccggttccggttcggtacgtacggacccgtaaggccgttccggcccccgttcggtcctaccgttccgttcccgg

SEQ ID NO: 89666 - DNA, 561 bp, Homo sapiens
  misc_feature: GYAE6OF02IJOKO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaaagatatacttgttgttccagcagaagtcaggccaggcccctgtactggtcatccatggaggccagtcgacgacacgtccgggatccctgagagatttctctcgccctccagtctacgagggacaggtcggccctaccgtttgacttatcgagggtcggggcccgggtggacgtagtagaagcgtagactacttagttgtacgcaccagacagtagtggtcagtcgaggggttactcgggcggacgggactaggtcgaccgttcgttggtacgacggacccgtaaggtccgtccggccccgtcggtaccacgttccgtcgtcccccg

SEQ ID NO: 89667 - DNA, 527 bp, Homo sapiens
  misc_feature: GYAE6OF02IYYSS.21.8.A08.1.454.CMB.1.raw
  modified_base (223)..(223): a, c, t, g, unknown or other
  misc_feature (223)..(223): n is a, c, g, or t
  modified_base (455)..(455): a, c, t, g, unknown or other
  misc_feature (455)..(455): n is a, c, g, or t
tcagtcgtcgctcgcacgaccggtgctcgatttagcatactctacagggggctgtgggctcaggaggcagagctctgggaatctcaccatcggcctggacccctctccctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactgtcatccatgaggccaggtcgacgacactccgggatccctgagagacttcgtctcgcctccagctcgagggacagtcgcccacttgactatcgaggtcgggacccagggtggacgatgaagcgtagactacttattgttacgcacagacagtagtgtcagtcgtaggggtntcggcggaggaccgtaggttcgtaccggtcgttggacagcccgaggcctcgccccgtggtccacgtcctccg

SEQ ID NO: 89668 - DNA, 650 bp, Homo sapiens
  misc_feature: GYAE6OF02HMVD5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtcggtgtcagtcgtccccaggacaaacggccaggatcacctgctcgtggagtattcattgaccaaaagatatacttgttggttccagcagaagtcaggccacggcccctgtacgtggtcactccatggacggccagtccgacgacaccgtccgggactcccgtagaggagtacttcctctcgcctccagcctacgagggacagtcggcctaccgttgactatcgagggtcgggcccgtagggtcggacgagtaggaacgtcgtacgaccttaacgttattacggttaaccgacctaaccgaacggtaacgtaaggtaacggttcgggtactaacgttacgggtaaggggggtttacgttaccggggacgggtaacgggtaaccgtaacggttcggtacccggttccgttacgggtacctaacggtaccccgaaggtccgtacccggtcccccgttcggtaccctacgtcccgttcccgg

SEQ ID NO: 89669 - DNA, 521 bp, Homo sapiens
  misc_feature: GYAE6OF02IDSKO.21.8.A08.1.454.CMB.1.raw
  modified_base (220)..(220): a, c, t, g, unknown or other
  misc_feature (220)..(220): n is a, c, g, or t
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctcctatgagctgacacagcccaccctcggtgtcagtcgtccccaggacaaacggccaggatcacctgctctgganattcattgacaaaagatatacttgttggttccagcagaagtcaggccaggcccctgtactggtcatccatgaggccagtcgacgacacgtccgggatccctgagagattctctgccctcagctcagggcagtcggcctaccgttgacctatcgaggtcgggcccaggtcggacgtangaagctgacttactattgtacgcacagacagtagtgtnatcgagggtattcggcggagggacctagttcgtaccgtcgttggcgacgcccgaaggctcgccccgtcggtcctaccgtcttcccg

SEQ ID NO: 89670 - DNA, 523 bp, Homo sapiens
  misc_feature: GYAE6OF02I81D5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgagccagtcgacgacacgtccgggatccctgagagattctctcgccctccagctcgagggacagtcggcccaccgttgaactatcgaggtcggggcccagggtcggacgagtggaagctgactactattgttacgcacagacagtagtgtcagtcgaggggttatcggacggaggacagttcgaccgtcgttaggcacgccgaggccgtcgccccgtggtcctaccgtcgtccg

SEQ ID NO: 89671 - DNA, 583 bp, Homo sapiens
  misc_feature: GYAE6OF02G12P1.21.8.A08.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaaaatttnttgttttttaggaccagcagaagtcaggccaggcccctgtgttggtcatccatgaggacaggagacgacccgtccgggatccctgagagattctcgtggctccaactcgagggacggtggccacgttgattctcgaggtcggggcccgagggtggaggagtgaagcgtagactactactgttactcgagcagacagcaggtggtacagtacggagggggctagttcgggacgggacgggaccgtaggggttcgaccggttccgtacgggtccgacggacccgaagggtccgtccggcccccgttacgggtcctaccgttccgttccggttcccctacccccg

SEQ ID NO: 89672 - DNA, 629 bp, Homo sapiens
  misc_feature: GYAE6OF02JDRTJ.21.8.A08.1.454.CMB.1.raw
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggaacaaacggcaggactcacctgctctggagattcattgacaaaagatatacttgttggtccagcaagaagtcaaggccaggcccctgtactggtcatccagtgacgccgagtcgacgacacgtcggactcctgagagtacttctcacgcctacagctacgaggacngtcggccctaacgtcgaactntacgaggtcgggacagggtaggaacgagtacggaagtcgtacggtaacttacgttaagttcgttaaccgaccgaacaacggaactaaggtacggttacggtactagtacggtacgggggttaattaccgggacgggtaacggtaaccgtaacggttcggaccggttacggtttaccggacgtaacggaaccccgtaacgggtccgtacccggtaccccgttaccggtacccgtacctacccggttccccgg

SEQ ID NO: 89673 - DNA, 585 bp, Homo sapiens
  misc_feature: GYAE6OF02ISZ3I.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgagccagtcgacacacgtccggatccctgagagattctctcgcctccagcctcgagggacaggtcggaccctaccgttgaacttatcgtaggtcggggcccgagggtaggacgagtggaagcgtagacttactagttcgttacgcaccagacgtagtaggtggtactagtacggaggggttagttcgggacgggacgggtaccgtaaggttcggacccggttccggttcggacgtaccggacccgtaacgggtcctaccggtcccccgttccgggtactacccgttcgttccccgg

SEQ ID NO: 89674 - DNA, 719 bp, Homo sapiens
  misc_feature: GYAE6OF02IEEZL.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagcccaccctcggtgtcagtcgtccccaggacaaacggccaggatcacctgctctggngattcattgcaaaagatatacttgttggttccagcagaagtcaggccaggcccctgtactggtcatccatgaggccagtcgacgacacgtccgggatcccgtgagagtattctctgccctccagccttcgaagggcagtcgggcccaccttgacttatcgacggttcggggacccgaggggtcgggacgagtacggaaacgtcgttacggaactttaacgttaacgtttcggtttaaccgaccgtaaccgaacggtaaccgtaagggttaacgggtcgggtttaccgtaagttaccgggtaacgggggggtttaactttccgggggacggggtaacgggggtaacccgtaaacggggttttccgggtaaccccgggtttcccggttttacggggttacccggtaaccgggtaacccccggtaaacggggttccccgtacccggggttaccccccccggtttcccggggtaccttacccccggtttccggtttccccccggg

SEQ ID NO: 89675 - DNA, 552 bp, Homo sapiens
  misc_feature: GYAE6OF02F2NSB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttgttccagcagaagtcaggccaggcccctgtactggtcatccatgaggccagtcgacgacacgtccgggatccctgagagattctctgcctccagctcgagggacaggtcggccaccgttgactatcgaggtcggggcccagggtggacgagtgaagctgacttactattgtacgcaccagacagtagtggtcagtcgagggggttattcgggacggacgggaccgtaggttcgacccggttccgttggtaccgacgacccgaaggccgttcggccccccgttcggtaccctaccgttccgttacccg

SEQ ID NO: 89676 - DNA, 790 bp, Homo sapiens
  misc_feature: GYAE6OF02IKO8F.21.8.A08.1.454.CMB.1.raw
  modified_base (224)..(224): a, c, t, g, unknown or other
  misc_feature (224)..(224): n is a, c, g, or t
  modified_base (330)..(330): a, c, t, g, unknown or other
  misc_feature (330)..(330): n is a, c, g, or t
tcagtcgtcgctcgcacgaccggtgctcgatttagcatactctacagggggcgtgtgggcgtcgaggaggcgagagctctgggaatcgtcaccatggcctggacccctcgtcctgctccccctcctccactttctgcacagtctctgaggcctcctatgagctgacacagcccacctcggtgtcagtcgtcccaggacaaacggcaggatcacctgctctgganattcattgaccaaaagatagtacttgttgttccagcgagaagtcgaggccaggcccctgtactggtacatccatggagccagtccgagaccacgtcgggacttccnggagacgtaatttcctcgtccggccttaccgagccgtaccgaaggggtactaggttaacggggcccctaacgtttagaaccgtttagtaaccgtacgggttaccgggggtaccccgtaacgggggtacgggtaacccgggtaaagtaccgggtaaaacgggtcgttaacgggtaaacctttaacgtttacgtttaaccggtttaacccggacgtaaacccgaacggtaacgaaacggtttacggttacgggtaaccacgggtttacggtaacggggggtttaacgttacgggggtacggggtaacggggtaacccgggttaacggtttacggggtaaccccggtttccgggtttaccgggtaccggtaaacgggtacccccggtaaaggggttccccgttacccgggtaccccccggtttaccccgggtaacgttaccccgggttacctttacccccggg

SEQ ID NO: 89677 - DNA, 697 bp, Homo sapiens
  misc_feature: GYAE6OF02GS5G0.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagaatatacttgttggttccagcagaagtcaggccaggcccctgtactggtcatccatcgaggccagtcgacgacaccgtccgggatccccgtaggacgagactttctctcgccctccgagtcctacgacggggacaggtcggaccctaacgtttcgaaccttatacgtagggtcggggccccgtaagggtcgggacggtaagtacggaaacggtccgttacggtaacttaaccgtttaagtttacggttaaccgtaccgaacccgtaagaaccgtaaggttaaggttcggttaccgaagttaccgggtaaggggggttaacgttacggggacgggtaacggggtaaccgtaacggttacggtaacccggttccggtttacgggtaccgtaaccgggtaccccgtaaacgggtcctacccgggtccccccgttaccgggtacctacccgttccgttaccccgg

SEQ ID NO: 89678 - DNA, 542 bp, Homo sapiens
  misc_feature: GYAE6OF02G7LVR.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacactccgggatccctgagagattctctgcctccagctcgagggacagtggccaccttgactatcaggtcggggcccagggtggacgagtgaagctgactactattgttacgcaccagacagtagtggtacagtcgaggggtattcgggacggagggaccaggttcggaccggttccgttggttaccgagacccgtaaggcctaccggcccccgttcgggtcctaccgtcgttcccg

SEQ ID NO: 89679 - DNA, 566 bp, Homo sapiens
  misc_feature: GYAE6OF02ICJ1R.21.8.A08.1.454.CMB.1.raw
  modified_base (433)..(433): a, c, t, g, unknown or other
  misc_feature (433)..(433): n is a, c, g, or t
  modified_base (546)..(546): a, c, t, g, unknown or other
  misc_feature (546)..(546): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctctggagatgcattgacctaaaaaattattgttttttaggtaccagcagaagtcaggccaggcccctgtgttggtcatccatggaggacgaggagaccgacccgtccgggactccctgagagacttctctggcctccaacgtcgaggacggtcggaccgtagttcgattcgtcgagggtcgggcccgagggtggaggagtgaagctgactacgtactgttacncgacgcagacgagcgagttggacagtacggaggggctaggttcgggcggacgggacgtagggtcgaccgtcgtaggccacggacccgaagccgtaccggccccgtcggtaccnccgttccgtccgttcccccg

SEQ ID NO: 89680 - DNA, 578 bp, Homo sapiens
  misc_feature: GYAE6OF02HLQHZ.21.8.A08.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctggagattcattgaccaaaagatatacttgttggttccagcagagtcaggccaggcccctgtactggtcatccatgagccagtcgacgacacgtccgggactcccgtgagagtattcctctcgcctccgagctcgagggacnggtcggcctaccttgactatcaggtcggggcccagggtcggacgtagtaggaagtctagacttacgttagttcgttaccgcaccgagacaggtagtggtacagttacggaggggttagttcgggacgggtacgggaccgtaggttcggtaccggttccgttcggtccgacggtacccgaacggtccgtaccggcccccgttcggtacctccgttccgtcccg

SEQ ID NO: 89681 - DNA, 592 bp, Homo sapiens
  misc_feature: GYAE6OF02IKUP5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgagccagtcgacgacacctccgggatcccgtgagagattctctgccctccagctcgagggacagtcggccaccgttgactatcgaggtcggggcccgagggtggacgagtaggaagctaggacttaacttattacgttacgaccacagactaggtagtggtacagtacgtagggggttagttcgggacgggacgggaaccgtaggttcgtaacccggttcggtttacgggtccgtaaccggcccggtaacgggccgttaccggtcccccccgttacgggtcccgtaccttccgttaccccg

SEQ ID NO: 89682 - DNA, 544 bp, Homo sapiens
  misc_feature: GYAE6OF02IQG2Y.21.8.A08.1.454.CMB.1.raw
  modified_base (361)..(361): a, c, t, g, unknown or other
  misc_feature (361)..(361): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacaccgtccgggactcccgtagacgagacttctctcgccctcagctcgagggacnggtcgcctaccgttgaactagtcgacggtcggggacccagggtcggaacgagtaggaagtcgtagacttaacttagttcgttacgccacagacagtagtgtacagtggaggggttatcggaggacggaccgtagttcgaccgtcttggcacgaccgagctccggcccgtcggctactcgtccg

SEQ ID NO: 89683 - DNA, 641 bp, Homo sapiens
  misc_feature: GYAE6OF02JQEIP.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccacctggtgtcagtcgtcccaggacaaacggccaggatcacctgctctgganattcattgaccaaaagatatacttgttggttcagcagaagtcaggccaggccctgtactggtcatccatgacgcagtcgacgacacgtccggatcccgtgagagtattcgtctcgcctccagcctacgagggacagtcggacccaccgttgaactacgtcgacggtcggggacccaggggtcggacgaagtggaacgtcacggtacttaacgttagttcgttaaccgacgtaaccgaacggaacgtaaggttacggttcggtacgaacgttacgggtaacggggttacgttacgggaacgggtacggggtaaccgtagggttaccggtaacccgggttccgttacggtaccgtaacccggtacccggtaacggtccggttacccggtcccccgttaccgggtaccctaccgttcccgttacccgg

SEQ ID NO: 89684 - DNA, 585 bp, Homo sapiens
  misc_feature: GYAE6OF02IZR48.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggagcatggtccagcctgggaggtcccctgagcctctcctgtgcagcgtctggattcagtatcggctcctttgccatgcactgggtccgcaggctccaggcaaggggctgggagtggggtggcgattatcgtggtatggatggaagtgagatatattattcgagacgttccggtgaacggggcccgtatttcgaccatcctccagagtacaatcgaccaaacaacacctactagtactacttacgaaattcggaacccggccttacggaacgcgtaccggaggaccgacgactagttaggttaacttacttaggtaaccgtagttacgttttggttctacggtttcggggacccgtacggggtaccccgtgggttaccccg

SEQ ID NO: 89685 - DNA, 663 bp, Homo sapiens
  misc_feature: GYAE6OF02H0WM1.21.8.A08.1.454.CMB.1.raw
  modified_base (220)..(220): a, c, t, g, unknown or other
  misc_feature (220)..(220): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctctgganattcattgacaaaagatatacttgttggtacagcagagtcaggccaggccctgtactggtcatccagtgacgccagtcgacgacacgtccgggatcccgtagagagtacttctctcgcctcagctacgaggacngtcggcctacgtgactatcgnggtcgggccgagggtacggacgtagtacggaacgtcgtagtaaccttaacgttagtttacggttaccgaccaaccgaaggtacgtaaggttacggttacggtacctaaggttccgggtaaggggggtttacgttccggggaacggggtaacggggtaacccgttaagggtttccgggtaaccccggtttcggtttaccgggtaccgtaacccggaaccccgtaacggggtcccgttaccccggtccccccggttacgggtacccttacccgttcccgtttacccccgg

SEQ ID NO: 89686 - DNA, 554 bp, Homo sapiens
  misc_feature: GYAE6OF02HY5KT.21.8.A08.1.454.CMB.1.raw
  modified_base (238)..(238): a, c, t, g, unknown or other
  misc_feature (238)..(238): n is a, c, g, or t
  modified_base (465)..(465): a, c, t, g, unknown or other
  misc_feature (465)..(465): n is a, c, g, or t
tcagtcgtcgctcgcacgaccggtgctcgatttagcatactctacagggggctgtgggctcaggaggcagagctctgggaatctcaccatggcctggacccctctcctgctcccctcctcacttctgcacagtctctgaggcctcctatgagctgacacagccaccctcggtgtcagtgtccccaggacaaacggccaggactcacctgctctggagatgcattgaccaaaaaaattntgtttttggtaccaggcaagagtcaggccaggcccctgtgttggtcatcatgaggacaggacgacgaccctccggggactccctgagagattctcttaggctccaactcgacgggacggtggacctaacgttgacttctacgaggtgggggcccagggtcggaggatgaaggctgaactagtattgttacgcacgtagacagtagtgtcagtcgaggggtatcgggnggaggacagttcgacgtcttgtcgagcccgtaaggcctcgtacccccgtggtctaccgtccgttccggttacccaccccttccctcccg

SEQ ID NO: 89687 - DNA, 566 bp, Homo sapiens
  misc_feature: GYAE6OF02GXZZ2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgacggccagtcgacgacacgtccgggatccctgagagattctctcgcctccagtcctcgagggacagtcggccctaaccgttgaacttagtcaggtcggggaccccgagggtcggacgagtggaacgctacgaacttacttagttagttaccgacaccagactaggtagtcggtcagtcgagggggttactgggacgggagggacctaggttcggaccggttcgttacggtcacgaccgacggctccggtccccgtcggcctacgtccgtcccg

SEQ ID NO: 89688 - DNA, 668 bp, Homo sapiens
  misc_feature: GYAE6OF02HAS1M.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganattcattgaccaaaagatatacttgttgttccagcagaagtcaggccaggccctgtactggtcatccatgaggccagtcgacgacacgtccgggatcccgtgagagtacttctctcgccctcagcctacgagggacaggtcgccctacgttcgacttatcgaggtcggggcccgaagggtcggaacgagtaggaacgtcgtacgacttaacgttagtttacgttaaccgacctaaccgagtaaccgtaggttaacggttcgggtactaacgttaccgggtaaggggggtttaacgttaccggggaacgggtaacggggtaacccgtaagggtttccggtaaccccggtttcccggtttacgggtacccgaacgggtacccccgtaaagggtccccttacccgggtccccccggttaccgggtcccttacccggttccgtttaccccgg

SEQ ID NO: 89689 - DNA, 509 bp, Homo sapiens
  misc_feature: GYAE6OF02JD0YZ.21.8.A08.1.454.CMB.1.raw
  modified_base (220)..(220): a, c, t, g, unknown or other
  misc_feature (220)..(220): n is a, c, g, or t
  modified_base (355)..(355): a, c, t, g, unknown or other
  misc_feature (355)..(355): n is a, c, g, or t
  modified_base (433)..(433): a, c, t, g, unknown or other
  misc_feature (433)..(433): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggatcccgtgagagattcgtctgcctccagctcgagggacngtcgccaccttgacctatcgagtcggggcccaggtggacgatggaagctgacttatattgtacgcaccagacagtagngtcatcgaggggtatcggacggaggacctagttcgacgtcttggcacgcccaaggctcgccctggtcacgtctcgg

SEQ ID NO: 89690 - DNA, 612 bp, Homo sapiens
  misc_feature: GYAE6OF02F5JT9.21.8.A08.1.454.CMB.1.raw
  modified_base (219)..(219): a, c, t, g, unknown or other
  misc_feature (219)..(219): n is a, c, g, or t
  modified_base (328)..(328): a, c, t, g, unknown or other
  misc_feature (328)..(328): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactggtcatccatgaggccaggtcgacgacacgtccgggatcccgtgaganacttctctcgcctccagtcctacgacgggacaggtcgccctaccgttgacttatcgaggtcgggacccgtagggtcggacgtagtacggaacgtcctagtacttacttagtttcggtaccgacaccgtagacgtagtagtcggtactagtacggtaggggttactcgggacgggacgggtaccgtaggttccggaccggttccggttagggtaccgtaacggtacccgtaacgggtccgttacccggtcccccgttcgggtacctaccgttcccgttaccccgg

SEQ ID NO: 89691 - DNA, 513 bp, Homo sapiens
  misc_feature: GYAE6OF02GZYJT.21.8.A08.1.454.CMB.1.raw
  modified_base (219)..(219): a, c, t, g, unknown or other
  misc_feature (219)..(219): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (482)..(482): a, c, t, g, unknown or other
  misc_feature (482)..(482): n is a, c, g, or t
  modified_base (505)..(505): a, c, t, g, unknown or other
  misc_feature (505)..(505): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacactccgggatcccgtgagagattctctcgcctccagctcgagggacaggtggcccaccttgactatcgaggtcggggcccagggtcggacgagtgaagcgtgactactattcgttacgcaccagacagtagtggtcagtcgaggggtntcggnggaggacagtcgacgtctggtcngaccgaggctcgccccgtggtcncgtctccg

SEQ ID NO: 89692 - DNA, 516 bp, Homo sapiens
  misc_feature: GYAE6OF02FPU6Z.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgacttactattgttacgcaccagacagtagtggtcagtcgaggggtattcgggcggagggaccaggttgaccggttccgttggtcacgcccaaggcctcggccccctggtccactctccg

SEQ ID NO: 89693 - DNA, 638 bp, Homo sapiens
  misc_feature: GYAE6OF02JAWIG.21.8.A08.1.454.CMB.1.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
tcagtcgtcgctcgcacgaccggtgctcgatttagcatactctacagggggctagtgggcctcaggaggcagagctctgggaatctaaccatggcctggacccctctccctgctccccctcctctactttctgcacagtctctgaggcctcctatgagctgacacagccaccctcggtctcagtgtccccggganaaacggccaggatcacctgctctggagatgcattgaccaaaaaatttntgtttttggaccagcagaagtcaggccaggcccctgtgttggtcatccatgaggacagggagacgacccgtccgggactcccgtgacgagattctactggcctaccaactcgaacgggacggtcggaccacggttgacgtttcctacgacggtcggggacccgtagggtcgggaaggagtcggaaacgtcgtaggaaccttaccgttacttacggttaacctcgagtcaagacgagcgaggtggtacagtaccggaggggactaggttccgggcgggacgggaccgtagggttacgaccgttaccgtaggtaccgtacggtacccgacggtcccgtaccgtcccccgttcggttaccgtaccgttccgttaccgttcccccgtaccctttccccg

SEQ ID NO: 89694 - DNA, 638 bp, Homo sapiens
  misc_feature: GYAE6OF02F77CX.21.8.A08.1.454.CMB.1.raw
  modified_base (103)..(103): a, c, t, g, unknown or other
  misc_feature (103)..(103): n is a, c, g, or t
  modified_base (172)..(172): a, c, t, g, unknown or other
  misc_feature (172)..(172): n is a, c, g, or t
tcagtcgtcgctcgcacgaccggtgctcgatttagcatactctacaggggctgtgggctcaggaggcagagctctgggaatctcaccatggcctggacccctntcctgctccccgtctcactttctgcacagtctctgaggcctcctatgagctgacacagcccacctggtntcagtcgtccccaggtacaaacggccaaggactcgacctgctctggatattcaattcgaccaaaaggtatactacttggttcggttcagtccagaagtcgagccaggtcccctgtactggtcatccgatgacgtccaggtcgacgctacgtccggactcccgtagacgtcgtacttcgtcgtcgccctcgagtcctacggacggtactacggtccgacctacgtttgaaccttgtaccgacggtcgggtaccagggtcgacgtagtacggaacgtccgtacgtacgttacgttagtaccgttacgactaccgtagtacgacggtagtcggtacgtacgtacggtacggggttactcgggtacggtacggtaccgttacgttccggtaccgttccggttaggtaccgtaccggtacccgtaggtccgttccggtaccccgtaggtacccttacgtccgttaccccgg

SEQ ID NO: 89695 - DNA, 564 bp, Homo sapiens
  misc_feature: GYAE6OF02IWSDY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatccctgagagattcctctcgccctccagtctcgagggacaggtcggccctaccgttgaacttatcgaggtcggggcccgagggtcggacgagtgaagctagacttactagttcgttacgcaccagacagtagtgtacagtcggtaggggttagttcgggacgggacgggaccgtagttcggacccggttcgttacggtcaacgcccgaaggcctccggtcccccgtcggtcctaccgtccgttcccgg

SEQ ID NO: 89696 - DNA, 609 bp, Homo sapiens
  misc_feature: GYAE6OF02G4WUK.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaaagatatacttgttggttccagcagaagtcaggccaggcccctgtactggtcatccatgaggccagtcgacgacacgtccgggatcccgtgagagattctctgcctcagctcgagggacagtcggccctacgttgactagtcgaaggtcggggacccgagggtcggaccgagtacgaagctagactacttagtttcgttaccgcaaccgacgaacgtacggtagtacggtactagttcgagggggttactcgggtacgggtaacgggtaaccgtaaggttcgacccgttccgttacgggtccaacggtcccgaacggtcgtacccggtcccccgttacggtcccgtaacccgttccgttccgttacccccgtaccccg

SEQ ID NO: 89697 - DNA, 538 bp, Homo sapiens
  misc_feature: GYAE6OF02F9JMY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgccctccagctcgagggacaggtcggcccaccgtttgactatcaggtcggggcccaggtggacgagtgaagctgactactattgttacgcaccagacagtagtggtcagtcgaggggttatcgggcggagggaccgtaggttcgaccgttccgttaggtccgacggcccgaaggcctcggcccccgtcggtcctaccgtctcccg

SEQ ID NO: 89698 - DNA, 540 bp, Homo sapiens
  misc_feature: GYAE6OF02F8G4T.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccgtgacgagtattctctgccctccagctcgagggacagtcggccaccttgactatcgagtcgggcccaggtcggacgatggaagctagacttacgtatttgttacgcacagacgtagtagtgtcagtcgtaggggtattcggacggagggaccgagttcgaccgtcgttggtaccgagtcccgaaggtccgtccgccccgttcggtcctaccgtcgtcccg

SEQ ID NO: 89699 - DNA, 633 bp, Homo sapiens
  misc_feature: GYAE6OF02JZREF.21.8.A08.1.454.CMB.1.raw
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
tcagtcgtcgctcgcacgaccggtgctcgatttagcatactctacaggggcgtgtgggcgtcgaggaggcgagagctctgggaatcgtcaccatggcctggacccctctcctgctcccctcctcacctttctgcacagtctctgaggcctcctatgagctgacacagcccaccctcggtgtcagtcgtccccaggacaaacggccaggactcgacctgctctggatattcattgaccaaaagatatcttgttgttccagcagagtcagccacgcccctgtacgtggtcactcatgacgccgagtcgacgtacnccgtaccggactcccgtgacgngtacttctactgccgtcctagcgtacgaggactacggtacgcctaacccgtgaaccttacgtacgtaggtccggggacccctagggtacgacgtagtaggaacgtctagaccttagttaacttgtaccgtcgacctacgacgtagtacgtggtaccgagtccggttaagggggtcttccgggacgggtacgggtaacctaggttccggtaacccggttcggttaggtacctaccgggaccgtaacgggtcttaccccgggcccccgttacgggttccctacgttcccggttaccccgg

SEQ ID NO: 89700 - DNA, 529 bp, Homo sapiens
  misc_feature: GYAE6OF02FN1UD.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccgtgagagtattctctgcctccagctcgagggacagtcggccacttgactatcagtcgggccaggtggacgagtgaagctgactactattgtacgcacagacagtagtggtcagtcgaggggttagtcggacggagggaccgtagtcgtaccgtcgttcggtcgacgtcccgaaggtcctcggtcccccgtggtcctaccgtccgttcccg

SEQ ID NO: 89701 - DNA, 644 bp, Homo sapiens
  misc_feature: GYAE6OF02I4T7E.21.8.A08.1.454.CMB.1.raw
  modified_base (176)..(176): a, c, t, g, unknown or other
  misc_feature (176)..(176): n is a, c, g, or t
  modified_base (220)..(220): a, c, t, g, unknown or other
  misc_feature (220)..(220): n is a, c, g, or t
  modified_base (321)..(321): a, c, t, g, unknown or other
  misc_feature (321)..(321): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtntcagtgtccccaggacaaacggccaggatcacctgcctctgganattcattgaccaaaagatatacttgttgttccagcagaatcaggccaggcccctgtactggtcatccagtgaggccagtcgacgacacgtccgggatcccngagagatttcctactcgccctccagctacgagggacaggtcggaccacgttagactagtcaggtcgggccctagggtcggacgtacgtaggacgcgtacgtaactaacgttagtttacgttaacccgcgtaacccaaggaccgtaaggtaggttacggtacctaagttacggaaggggggtttacgttaccgggacggggtaacgggtaaccgtagggtttacgtacccgggttcccggtttacgggtcctaaccggtaccccgtaagggccccttacccgggtccccccgttacggtacccgtacccgttccgtttaccccg

SEQ ID NO: 89702 - DNA, 522 bp, Homo sapiens
  misc_feature: GYAE6OF02HLSAV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatccctgacgagattctcgtgcctccagcctcgagggacagtcggcctaccgttgactatcgaggtcgggcccgaggtcggacgatgaagctgactactattgttacgcacagacagtagtggtacagtcgaggggtatcgggacggagggacagttgaccgttcgttaggcacgccgaaggcctacgccccgtggtccactctcccg

SEQ ID NO: 89703 - DNA, 581 bp, Homo sapiens
  misc_feature: GYAE6OF02I4RW6.21.8.A08.1.454.CMB.1.raw
  modified_base (236)..(236): a, c, t, g, unknown or other
  misc_feature (236)..(236): n is a, c, g, or t
  modified_base (393)..(393): a, c, t, g, unknown or other
  misc_feature (393)..(393): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaattnttgtttttggaccagcagaagtcaggccaggccccctgtgttggtcatccatgaggacaggagacgaccctcgggactccccgtgagagattctctggctccaactcaggggacggtggccgacgttgattctcgagtcggggcccagggtggaggntagaagctagactactactgttactcagcagacagcagtggtcagtcgagggggctaggttcgggcgggacgggtaaccgtagggttacgacccggtccgtagggtccgacggcccgaaacgggtcgtaccggtcccccgtcgggttcccaccgttccgtaccgttcccctacccttccgttaccccg

SEQ ID NO: 89704 - DNA, 636 bp, Homo sapiens
  misc_feature: GYAE6OF02HVFLR.21.8.A08.1.454.CMB.1.raw
  modified_base (218)..(218): a, c, t, g, unknown or other
  misc_feature (218)..(218): n is a, c, g, or t
  modified_base (336)..(336): a, c, t, g, unknown or other
  misc_feature (336)..(336): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctcctatgagctgacacagcccacctcggtgtcagtcgtcccaggacaaacggccaggatcacctgctctgganattcattgaccaaaagatatacttgttggttccagcagaagtcaggccaggcccctgtactggtcatccatgaggccagtcgacgacacgtccgggactcccgtagagacgtatttcnctcgcctcagctcgagggacaggtcggacctaccgttgaccttaatcgaggtcggggaccccgagggtacggacgtagtacggaagtcgtacgtaaccttaacgttagtttacggttaaccgacctaaccgaacgtaacgtacggttaagttcgggtacgtacgtaccgggtaagggggttacgttcgggacgggtaacgggaccgtaggttacggacccggttcggttcggtacgaccggtacccgaacggtcccgtaccggtaccccccgttcgggtacctaccgttccgttaccccg

SEQ ID NO: 89705 - DNA, 549 bp, Homo sapiens
  misc_feature: GYAE6OF02JJREA.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaaagatatacttgttgttccagcagaagtcaggccaggcccctgtactggtcatccatgaggccagtcgacgacacgtccgggatcccgtgagagtattctctcgccctccagtcctacgagggacaggtcgccctacgttgactatcgaggtcgggcccgaggtggacgatgagctagactactattgtacgcaccgagacagtagtgtacagtcgaggggttatcgggcggacggaccgtaagttcgaccgttcgtggtcacgccgaacggtccgtccgtccccgtcggtacctccgttccgtccgttcccctacccg

SEQ ID NO: 89706 - DNA, 715 bp, Homo sapiens
  misc_feature: GYAE6OF02JPVXY.21.8.A08.1.454.CMB.1.raw
  modified_base (332)..(332): a, c, t, g, unknown or other
  misc_feature (332)..(332): n is a, c, g, or t
tcagtcgtcgctcgcacgaccggtgctcgatttagcatactctacaggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggcaggatccactgctctggatattcattcgaccaaaagatatacttgtggttcagcagagtcaggccaggcccctgtacgtggtcagtccatcgaggccagtcgacgacacgtccgggatccctgagagtacttcnctcgcctccagtctacgagggactagtcggaccctacttgaacttagaccgtagggtcggggacccctaggggtacgtacggtagtacggaacggtacgtacgtaacgttaacttaacgtttcgggttaaccgaccgttaaccgaacggtaccggtaagttacgggttacgggttactaacgggttaccggggttaaggggggttaacctttaccgggggaaccggggtaacggggtaacccggttaaggtttaccgggtacccggtttacccggtttagggttacccgggaaccggttaaccccggaaacggggttcccgtaccccgggtaccccccgggttaccgggtttaacccgtcccggttaaccggtttacccccgg

SEQ ID NO: 89707 - DNA, 746 bp, Homo sapiens
  misc_feature: GYAE6OF02G0OO5.21.8.A08.1.454.CMB.1.raw
  modified_base (238)..(238): a, c, t, g, unknown or other
  misc_feature (238)..(238): n is a, c, g, or t
tcagtcgtcgctcgcacgaccggtgctcgatttagcatactctacagggggctagtgggctcaggaggcagagctctgggaatctaaccatggcctggacccctctcctgctcccctcctctactttctgcacagtctctgaggcctcctatgagctgacacagccacctcggtctcagtcgtcccggacaaacggccaggactcactgctctggagatgctattgacctaaaaattntgttttgaccagcagagtcacgcacggccctgtgtggtcatccagtgaggacaggacgacgacccgtccgggactcccgtagacgagtacttcgtacgtcggctaccaacgtcgtaacgggacggtacggccctacggttacgtacttacgtacgtacggtcggggaccctagggtacgggaaggtagtacggaagtacgtacggtaaccttaaccgtaactttacggttaaccttacgaacggtaccgaacggtaacgtacgacgtaggttacggtacgtaacggtaccgggtaacgggggtacgtaacggtttaccgggaccggggtaacgggtaaccggtaacggggttaccgtaacccgggttacgggttaacgggtaacccggtaacggttaacccggtaaccgggtacccggtttacccccggttccccggttaccgggtacccggttaacccggttaccggtttaccccggtttacccccgtaacccccgtttccccccgg

SEQ ID NO: 89708 - DNA, 743 bp, Homo sapiens
  misc_feature: GYAE6OF02F87UV.21.8.A08.1.454.CMB.1.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctcngganattcattgaccaaaagatatacttgttggttccagcagagtcaggccaggcccctgtactggtcatccagtgacggccaggtcgacgacaccgtccgggactccccgtaggacgtagtactttcctcgtcgtcccttaccgagtccgtacggaaggggtacctagggttccggacccctaccgtttcgaaccttacgtaccgtaacggggtccgggggacccgtaaggggtacgggaacggtacggtaacggtaacggtccgtagtaaccgtttaacgttacgttttaccgggttaaccgaccgtaacccgtaacgtaacgtaagggttacggttcggtaacctaaggttaccgggttaaggggggtttaccgttaccggggaaccggggtaccgggtaacccggttaggtttaccgggtacccggtttcgggtttacgggtaccggaacccggtaccccggtaaggtccccggttaccggccccccggtttacgggtacccctaccgtttcccgttacccccgg

SEQ ID NO: 89709 - DNA, 592 bp, Homo sapiens
  misc_feature: GYAE6OF02FXPKD.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagaatatacttgttggttccagcagaagtcagccaggcccctgtactggtcatccatgaggccagtccgacgacacgtccgggactcccgtgagacgtactttctctcgccctccgacgctcgaggacagtcggaccctacttgactatcgaggtcgggcccgaggtcggacgataggaagctagacttacgtatttacgtaccgacaccgagaacgagtagtcggtacacgtcggaggggttacttcgggacgggacgggtaccgtaacggttcggacccggttccgttagggtaccgacggaccctaagggtccctccggtccccccgtcgggtaccctaccgttcccgttaccccg

SEQ ID NO: 89710 - DNA, 543 bp, Homo sapiens
  misc_feature: GYAE6OF02IT1W6.21.8.A08.1.454.CMB.1.raw
  modified_base (334)..(334): a, c, t, g, unknown or other
  misc_feature (334)..(334): n is a, c, g, or t
  modified_base (425)..(425): a, c, t, g, unknown or other
  misc_feature (425)..(425): n is a, c, g, or t
  modified_base (462)..(462): a, c, t, g, unknown or other
  misc_feature (462)..(462): n is a, c, g, or t
  modified_base (527)..(527): a, c, t, g, unknown or other
  misc_feature (527)..(527): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctcgtggagtattcattcgaccaaaaagtaatattacttgttggttccagcagaagtcaggccaggcccctgtactggtcatccatgaggcagtcgacgacactccgggatccctgagagattcnctgccctcgagctcgaggacagtcggccaccttgactatcgaggtcgggcccgaggtggaacgagtgaagctgaactacttagttcgtacncacagacagtagtgtacagtcgtaggggtattcgggnggacggaacgaaggttcgaccgttcgttcggtcgacgccgaagtccgtacgccccttcggtaccnctcttcgtcccctccc

SEQ ID NO: 89711 - DNA, 584 bp, Homo sapiens
  misc_feature: GYAE6OF02IEUKZ.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggactcacctgctctgganattcattgaccaaaaagatatacttgttggtccagcagaagtcaggccaggcccctgtactggtcatccatgaggccagtcgacgacaccgtccgggactcccgtgacgagtattcctctgccctcagctagacgggcagtcggaccctacgttgacttatcgaggtcgggcccagggtcggacgagtaggaacgcgtagacttacttagttcgttaccgcaccagacgagtagtgtcatacggaggggttagttcggacgggtacgggaccgtaggttcggtacccggtccgttcggtaccgaccgacccgtaacggtccgttaccggtcccccgttcgggtacctaccgttccgttccccg

SEQ ID NO: 89712 - DNA, 514 bp, Homo sapiens
  misc_feature: GYAE6OF02I17T9.21.8.A08.1.454.CMB.1.raw
  modified_base (319)..(319): a, c, t, g, unknown or other
  misc_feature (319)..(319): n is a, c, g, or t
  modified_base (371)..(371): a, c, t, g, unknown or other
  misc_feature (371)..(371): n is a, c, g, or t
  modified_base (411)..(411): a, c, t, g, unknown or other
  misc_feature (411)..(411): n is a, c, g, or t
  modified_base (507)..(507): a, c, t, g, unknown or other
  misc_feature (507)..(507): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatcccngagagattctctgccctccagctcgaagggacaggtcggccaccttgaactntcgaggtcggggcccagggtggacgagtgaagctgaactnttattgttaccgcaccagacagtagtggtcagtcgaggggtattcgggaggagggacagttcgaccgtcgttggcacgccaggctcgcccctggcnctctccg

SEQ ID NO: 89713 - DNA, 517 bp, Homo sapiens
  misc_feature: GYAE6OF02FMFT7.21.8.A08.1.454.CMB.1.raw
  modified_base (454)..(454): a, c, t, g, unknown or other
  misc_feature (454)..(454): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctgcctccagctcgagggacagtcggccaccgttgactatcaggtcggggccagggtggacgatgaagctgacttactattgtacgcaccagacagtagtggtacagtcgaggggttatcgggnggagggaccagtcgaccgttctggtccagcccgaaggcctcggccccgtggtccacgtctccg

SEQ ID NO: 89714 - DNA, 647 bp, Homo sapiens
  misc_feature: GYAE6OF02F2WXA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagtacttctctcgcctccagcctcgagggacaggtcggccctacgttgactatcgaggtcggggacccagggtggaacgtagtacggaagccgtagtaaccgttaacttacgtttacggttaaccgtccaacccgtaaggtaccgtaaggttaaggttacggtactaaggttacggtaggggggtttaacttcggggaccgggtaacggggtacccgtaaggttcggacccggttccggttacggtaccgaaccggtaccccgtaagggtcccgttacccggtccccccgttccgggtacccgtaccgttcccgttccccg

SEQ ID NO: 89715 - DNA, 621 bp, Homo sapiens
  misc_feature: GYAE6OF02IEFJP.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttggtccagcagagtcaggccaggcccctgtactggtcatccagtgacggccagtcgacgacaccgtccgggatcccgtgaagagtacttctcgtcgcctccagctacgagggtaccaggtcggaccctaccgttagacttagtcgagggtcggggcccgaagggtcggacgtaagtaggaacgtcgtacgaacttacttagttacgttaccgcaacctaggaacgtagttacggtgtacgagtacgggtaggggttagtcgggacgggtaacgggaccgtaaggttaccggtaccggttccggttacggtaccgtaccgacccgtaggtcccgtcccggtccccccgtcgggttaccctacccgttcttccccggg

SEQ ID NO: 89716 - DNA, 711 bp, Homo sapiens
  misc_feature: GYAE6OF02H19N6.21.8.A08.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcttgggttttcctccttgcttcttttaagaggtgtccagtgtcaggcgcaacgtggtggagtcgtggggggaggcagtgggtccaggccgtggggacggtccctggacgcctctcctggtcgcagcgtctggattcagtatcggcttccttgccatgctacgtgggtcccncgaggcctcgaggcgaaggggctggggaggtgggggtggacgtagtttacgtcgttagggtagtggtaaggttaggggaaaggttggaaaggtacggtaaatttagtttaacgttcgaacggtaccgttccgggttagggaacggggtccgtaacgtttaccgaaccgtactccgtaccgaaggacgaacaacgtacgaaccctaaacgaaccaacctaacgttagtaactacctttaacaaacgtaccggaccccggtacttaggaaccgacggaccccggaaaggaaccgaccggtactagttacggtttaacttaaccggttaggtaaccgtaggtttcgtttggttcgttaagggttccgggggacccgtacggggtaccccgttgggtaaccccg

SEQ ID NO: 89717 - DNA, 554 bp, Homo sapiens
  misc_feature: GYAE6OF02H2L85.21.8.A08.1.454.CMB.1.raw
  modified_base (219)..(219): a, c, t, g, unknown or other
  misc_feature (219)..(219): n is a, c, g, or t
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttggttccagcaagaagtcaggccaggcccctgtactggtcactccatgaggccagtcgacgacacgtccgggatccctgagagattcnctgcctcagctcgagggacaggtcgcctaccgttgaccttagtcgacggtcggggaccctagggtggacgagtcgaacgcgtagaacttactagttcgtacgcacaagacaggtagtgacagtcggtaggggtctggcgggtaggacctaggtcgtaccgtcgttggtacacggtacccgaggtcctaccggccccgttcgggtacctaccgttcgtcccg

SEQ ID NO: 89718 - DNA, 730 bp, Homo sapiens
  misc_feature: GYAE6OF02F4BRE.21.8.A08.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagcatactctacagggggctgtgggctcaggaggcagagctctgggaatctcaccatggcctggacccctctcctgccctccccctcctctactttctgcacngtctcgtggacggcctctatgagctgacacgacgcccacccgtcggtgtcgagttccgaccccgaggaacgaaaccggccgaaggactccaccgtcgctcgtggatacttactagttcgaaaccaaaaagtaattacttacgtttggtttcggttaccagcaaggaacgtcgacggccgacggtcccctagtacgtcggtcactccagtggacggccaggtcgacgacacgtccgggactcccgagagacgtacttcgtctcgcctcgacgtctcggacgggactggtcgaccctaccgttagacttagtcgtacgggtccggggacccgtagggtacgggaacgtagtacggaacgtcgtacgtaaccttaacgttagtttacgtaccggacctaaccgtagaaccgtaagggttacggttcgtaccgtaagtacgggggtaaggggttacgttccggggaacggggtacggaaaccgttagggttaccgggtaaccccgtttcggttcgggtaacccacccgggaacccgtaacggggtccgtaccccggttcccccggttacggtcccttacccgttcgtttaccccccgg

SEQ ID NO: 89719 - DNA, 518 bp, Homo sapiens
  misc_feature: GYAE6OF02G70IC.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgcctccagctcgagggacagtcggccaccttgactatcaggtcggggcccaggtggacgagtgaagctgacttactattgtacgcacagacagtagtgtcagtcgaggggttattcggcggaggaccagttcgaccggtcgttggtcacgcccgaaggctcggccccctggtcctactcgttcccg

SEQ ID NO: 89720 - DNA, 530 bp, Homo sapiens
  misc_feature: GYAE6OF02GRA3U.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggattcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggcttcctttgcccatgctactgggtccgccaggcctccgaggcaagggggctgggagtgggtggcgattatctggtatgatggaagtgagagatattatcagactcgtgagggcattcaccatctccagagacaatcgaccaacaacacactgtatctacaaatcgaccgctgagacgccgagacacggctagtgtacttcgtagtacggagttcgtttggtactaggtttcggggacccgtacgggtacccgtggtacccg

SEQ ID NO: 89721 - DNA, 620 bp, Homo sapiens
  misc_feature: GYAE6OF02GCWWO.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttggtccagcagaagtcaggccaggccctgtactggtcatccatggacggccaggtcgacgacacgtccgggatcccgtggagagatttctctgccctcagctacgagggacaggtcggaccctaccgttgaaccttagtccgaagggtccggggacccagggtcgggaacgagtaggaagtcgtaggtaacttaacgttagtttacgttaccgccaacctagactaggttagtggtactagtcggtaaggggttacttcgggacgggaacgggtaccgtaggttcggacccggttcgttacgggtaccgaccggacccgtaaggtcccgttcccggtaccccccgttcggtaccctaccgttcccgttaccccgg

SEQ ID NO: 89722 - DNA, 577 bp, Homo sapiens
  misc_feature: GYAE6OF02HUJUJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctcgtggagattcattgaccaaaagatatacttgttggttccagcagaagtcaggccaggcccctgtactggtcatccatgaggccagtcgacgacacgtccgggactccctgagagattctctcgcctccagctcgagggacagtcgccctaccttgacttatcgacggtcggggccccgagggtagggaccgagtaggaacgtcgtagaacttaacttagttacgttaaccgcaccgaagacgtagtagtgtacgagtacggaggggttagtcgggacgggagggaccgaggttcggacccggttcgttcggtacacggacccgaaggccgtccgccccgttcggtccaccgttcgtccccgg

SEQ ID NO: 89723 - DNA, 525 bp, Homo sapiens
  misc_feature: GYAE6OF02H049Y.21.8.A08.1.454.CMB.1.raw
  modified_base (216)..(216): a, c, t, g, unknown or other
  misc_feature (216)..(216): n is a, c, g, or t
  modified_base (328)..(328): a, c, t, g, unknown or other
  misc_feature (328)..(328): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtgtcccaggacaaacggccaggatcacctgctctgganattcattgacaaaagatatacttgttgtccagcagagtcaggccaggcccctgtactggtcattccagtgaggccagtcgacgacacgtccgggatccctgacgagacttcnctcgcctcagctcgagggacaggtcgccctacttgactatcgaggtcgggcccagggtcggacgagtagagctgacttacgtattgttacgcacagacgagtagtgtacagtcgaggggtntcggnggaggacgtagttcgaccgtcgttcggtcgacgcccgaaggcctcggccccgtcggtctacctccgtcccg

SEQ ID NO: 89724 - DNA, 593 bp, Homo sapiens
  misc_feature: GYAE6OF02GZ9ZN.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagaatatacttgttgttccagcagagtcaggccaggcccctgtactggtcatccatgaggccagtcgacgacacgtccgggatcccgtgacgagtacttctctcgcctcacgtctcgagggacagtcggcctacttgactatcgaggtcgggacccgagggtcggacgagtaggaacgtctagaacttacttagttacgtacgaccaccgagacgtagtagtggtactagtacggagggggttactcgggacgggacgggaaccgtaggttacggacccggttccgttacgggtccgaaccggtacccgaaggtcccgtcccggtacccccgttcggtacctaccgttccgttaccccg

SEQ ID NO: 89725 - DNA, 629 bp, Homo sapiens
  misc_feature: GYAE6OF02JHHUE.21.8.A08.1.454.CMB.1.raw
  modified_base (355)..(355): a, c, t, g, unknown or other
  misc_feature (355)..(355): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctctggagattcattgaccaaaagatatacttgttggttcagcagaagtcaggccaggcccctgtactggtcatccatgaggccagtcgacgacacgtccgggactcccgtgacgagtattctctcgcctccagctcgagggacnggtcgccacgttgactatcaggtcgggccgagggtcggaacgcgtaggaacgtcgtagtaaccttacgttagtttcgttaaccgccaacccaggtaactaacggtaggttcggtaccaagtcggtaagggggttactttacgggaccgggtacgggaacccgttaaggttacggaacccggtttccggtttcgggtaccgtaacggtaccccgtaaacgggcccgttaccggtaccccccgttcgggtacccgtaccgttcccgtttaccccgg

SEQ ID NO: 89726 - DNA, 598 bp, Homo sapiens
  misc_feature: GYAE6OF02GSRE9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccaggtcgacgacacgtccgggatcccgtgagagtattctctgccctccagctcgagggacaggtcggaccctacctttgaactagtcgtacggtcggggaccccgagggtacggacggtagtaggaacgcgtagaaccgttacttagttacgttaccgactaccagacaggtagtggtacagtcgggtaggggttacgttcgggacgggacgggaccgtaggttcggtacccggttcgttgggtaccgacggacccgtagggcctaccggcccccgttcgggtacctccgtccgttcccgg

SEQ ID NO: 89727 - DNA, 560 bp, Homo sapiens
  misc_feature: GYAE6OF02GO5XY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactgtcatccatgaggccagtcgacgacactccgggatcccgtgagagattctctgcctcagctcgaggacagtcggcctaccgttgactatcgaggtcggggcccagggtcggacgatgaacgtctagacttaacttagttcgttacgccaccgaagacgtaggtagtcggtacagtcgagggggttatcgggacgggagggacctaggttcggtaccggtccgttaggtcacggacccgaaggcgtccggtccccgtcggtcctccgtcgttccccgg

SEQ ID NO: 89728 - DNA, 647 bp, Homo sapiens
  misc_feature: GYAE6OF02JEGSV.21.8.A08.1.454.CMB.1.raw
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
tcagtcgtcgctcgcacgaccggtgctcgatttagcatactctacagggggcgtgtggggctcgaggacggcagagcgtctgggaatcttcaccagtggcctggacccctctcctgcctccccctcctcactttctcgcacgagttctctgaggccttcgttatgagcttagacacagccacctcggtgtcagtcgtccccgaggacaacggccaggactcgactgctcggtgagattcattcgacaaaagatatacttgttcgtccagcagaagtcaggcaggccctgtacctggtcatccagtggagccagtcggacacacgtcggatccnggacgagtnttccactgtacctccgagtcctacgagggacctagggtccggaccctaccggtttcgaaccttacgtccgtaacgggtccgggaccgtagggtaccggacgtacgtacgaacgtccgtacgtaaccgttacgtttaagttacgttaccgacctaccgtacgaacgtaggtacgtggtaccacggtacggtaggggttactcgggtacgtagggtaccgtaggttcggaccgttcggttacgtacgtaccggaccgtaacggccgttaccggccccgttacggtacccgtacgttccgttccccgg

SEQ ID NO: 89729 - DNA, 546 bp, Homo sapiens
  misc_feature: GYAE6OF02I1SF4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgtggttccagcagaagtcaggccaggcccctgtactggtcatccatgaggccagtcgacgacacctccgggatccctgagagattctctgcctccagctcgagggacaggtcggccctacttgaactagtcaggtcgggacccgagggtggacgatgaagctgactatattgtacgcaccagacagtagtgtcagtcgaggggttagtcggacgggacgggaccgtaggttcgtaccggttccgttggtacacggacccaagggtctccggtcccccgtggtacccgtacgttccgtcccgg

SEQ ID NO: 89730 - DNA, 549 bp, Homo sapiens
  misc_feature: GYAE6OF02FXMR7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagattctctgcctccagctcgaggactagtggccctaccgttgactagtcgaggtcggggacccagggtggacgagtgaacgctagacttactattgttaccgcaccagacaggtagtggtcagtcgaggggttattcgggacggagggaaccgtagttaggtaccggttccgttaggtcgacgccgaaggtcctccgtcccccgtgtccacttccgttacccg

SEQ ID NO: 89731 - DNA, 576 bp, Homo sapiens
  misc_feature: GYAE6OF02GFJT2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggccctgtactggtcatccatgacggccagtcgacgacacgtccgggatcccgtgagagtacttctctcgcctccagctcgagggacaggtcggccctacgttcgactatcgacggtcgggccgagggtcggacgataggaagcgtagacttactattcggttacgctaccagtacgagtaggtgtacgagttacggtagggggttacgtcgggacgggagggtaccgtagttcggtaccggttcgttcggtaccgtacgacccgaacggtccgtccggtccccgtacggtcctaccgtccttcccgg

SEQ ID NO: 89732 - DNA, 727 bp, Homo sapiens
  misc_feature: GYAE6OF02G5IVZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagattcattgaccaaaagatatacttgttgttccagcagaagtcaggccacggcccctgtactggtcatccagtgacggccagtcgaccgacccgtcgggactcccgtggacgagtacttctcgtggcctaccaactcgagggacggtcggcccgtacgtttgactttccgtacgtagggtccgggggacccgtaggggtcgggaagggtagtacggtaacggtccgtacggtaaccttaaccgttacgttacggtttaaccgtccgaaggtaccaacggaaccgtacggacgtacggttacgggtacgtaacgtacgggaacgggggtacttaacgggttccggggaacgggtaccggggtaacccggttaggggtttaccggaacccgggtttacccggttaacggggtacccgtaaccgggtaaccccgaacgggttccccgttcccgggtacccccccggtttaccgggtacccgttaccccgtttcccggtttacccccggg

SEQ ID NO: 89733 - DNA, 577 bp, Homo sapiens
  misc_feature: GYAE6OF02JDKW8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatcacctgctctggagattcattgaccaaaagatatacttgtggttccagcagaagtcaggccacggcccctgtactggtcatccatcggacggccagtccgacgacgaccgtaccgggactcccgtagagacgtacttcgtctcgcctccacgtctacgagggaccaggtcgaccctacgttgactatcgaggtcgggcccgtaggtcggacgatggagcgtagtactagttacgttagtacgacgacaagacgagtacgtggtactagtacggtaaggggttcgtcggacgggagggactaggttcggaccgttcgttacggacgacgacccgaggcccgtccggccccgttcggtcctcgtccgtccg

SEQ ID NO: 89734 - DNA, 556 bp, Homo sapiens
  misc_feature: GYAE6OF02G2EXT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctcgcctccacgctcgagggacagtcggccctaccgttgaactagtcaggtcggggcccagggtcgggaacgagtggaacgctaggacttactagttcgttacgcaccagacagtagtcgtcagtcgaggggttacgttcggacggaggaccgtaggttcgaccgttccgtaggtccgacggcccgaaggcctacggtcccccgtacggtccaccgttcgtcccgg

SEQ ID NO: 89735 - DNA, 573 bp, Homo sapiens
  misc_feature: GYAE6OF02HLS47.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctgganattcattgaccaaaagatatacttgttgttccagcagagtcaggccaggcccctgtactggtcatccatgaggccagtcgacgacacgtccgggactcccgtgagagtattctctcgccctccagcctcgagggacaggtcggccctaccttgactatcgacggtcggggcccagggtcggacgtagtgaagctgaacttacttattgttaccgcacagacgagtagtgtacagtacgtaggggtagttcggacgggtaacgggacctaggttacgtacccggttcgttacggtcaacggcccgaaggtcctccgggtcccccttcgggtaccctaccggttccttaccccgg

SEQ ID NO: 89736 - DNA, 590 bp, Homo sapiens
  misc_feature: GYAE6OF02HY3PP.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttcngcacagtctctgaggcctcctatgagctgacacagcccacctcggtgtcagtcgtccccaggacaaacggcaggatcacctgactcgtggatattcatgaccaaaagatatacttgttcgtcagcagaagtcaggccaggcccctgtacgtggtacactccatggagccagtccgacgactaccgtaccgggacttcccgtagagacgtattcctctcggccctcagtcctcgagggacaggtcgacctacgttgactctacgaggtcgggaccgaggtcggacgtagtagacgtctacgactactagttacgtacactaccagacgtagtacgtggactagtacggtaggggtacgtcggacgggtacgggtaccgacgtcggtaccgtccggttacggtcgaccgtacccggaaggccgtacccggtccccgttaccgggtcctaccgtccgttaccccg

SEQ ID NO: 89737 - DNA, 572 bp, Homo sapiens
  misc_feature: GYAE6OF02IYPIO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccagtgaggccagtcgacgacacgtccgggatccctgagagacttctctgccctccagctcgaggacaggtcggccacttgactatcgaggtcggggccagggtcggacgatagaagctagacttactagttcgttaccgcaccgagacaggtaggtggtacagtacggagggggttactcggggacgggacgggtaaccgtagggttacgacccggttcgttcgggtaccacggacccgaagggccttccggtacccccgttggtaccctacgttccttccccgg

SEQ ID NO: 89738 - DNA, 593 bp, Homo sapiens
  misc_feature: GYAE6OF02GOS91.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctgctctggagattcattgaccaaaagaatatacttgttggttccagcagaagtcaggccacggcccctgtacgtggtcatccatgaggccagtcgacgacacgtccgggatcccgtgagagtacttctctcgccctccagcctcgagggacagtcggccctaccgttgaaccttatcgacggtcgggggccccgtagggtcgggacgtagtacggaagtcgtacgtaacttacttagtttcgttaaccgcaccgaagacgtagtaggtggtacagtcggtaggggttagtcgggacggagggaccgtaggttcggaccgttcgttaggtccacgtacccgaaggtccgtccggtcccccgtcggtcctaccgtccgttcccg

SEQ ID NO: 89739 - DNA, 603 bp, Homo sapiens
  misc_feature: GYAE6OF02HN3W7.21.8.A08.1.454.CMB.1.raw
  modified_base (361)..(361): a, c, t, g, unknown or other
  misc_feature (361)..(361): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactggtcatccatggacggccagtcgacgacaccgtccgggactcccgtgagagtacttcctctcgccctccagctcgagggacnggtcggcctacttgactatcgaggtcgggcccgagggtggacgagtgaagtcgtagacttacttagttacgttacgacctaaccgagtacgaggttagtcggtactagtacggtaggggttacgttcggggacgggtagggaccgtaaggttcgaccggttcgttacgggtcacggtacccgaaggtcccgtaccggtcccccgttcgggtccctaccgtccttccgttaccccctaccccg

SEQ ID NO: 89740 - DNA, 561 bp, Homo sapiens
  misc_feature: GYAE6OF02I8J3Z.21.8.A08.1.454.CMB.1.raw
  modified_base (294)..(294): a, c, t, g, unknown or other
  misc_feature (294)..(294): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggaccaaacggccaggatcacctgctctgcagatggactgaccaaagaatatgacttattacggtaccaacagaacgccaggccacggccctagtgtagtgatatanaacgacactgagacgccctacagagactcccgtagacgcgtacttctctcggctccagctacgaggacagctagtctacggttagactagtcagtgaagtccgaggcagacggacgagctgactattacgtgtacaagagtagaacgaggtagacggtaacctgttaacggttggggttacgtccgggacgggacgggaaccaacggtcctaggtacccgttacggacggttcaccggacccgaaggtccgtacccggtacccccgg

SEQ ID NO: 89741 - DNA, 612 bp, Homo sapiens
  misc_feature: GYAE6OF02FOK7Q.21.8.A08.1.454.CMB.1.raw
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
tcagtcgtcgctcgcacgaccggtgctcgatttagcatactctacagggggctgtgggctcaggaggcaaagctctgggaagtactcaccaatggcctggaccctcctcctgctcccctccctcacttctgcacagtctctgaggcctcctatgagctgacacagccaccctcggtgtcagtcgtcccaggacaaacggcagatcactgctctggagattcatgaccaaaagatatacttgttggttaccagcagaagtcgagccacggcccctgtactggtcattaccatggtacggcccaagtcggaacgaaccncgtccggggactccccgtgagtacgtacttccgtttcnggccccttcgacgtcttaccgaagggggtacaacggttcggccctaaccctttcggaactacgttccgaacgggttcggggccccaaggggtcggaacggactaggaacgcgtcgaacgttacttagttcgttacggcaccagacaggttatggtctagaggtaggggttacgttggaccgggagaccgtaagtggaccgtcgttggcacggacccgaaggccgtcgccccgtcggtacacgttcctcgttcccccg

SEQ ID NO: 89742 - DNA, 578 bp, Homo sapiens
  misc_feature: GYAE6OF02JVN3C.21.8.A08.1.454.CMB.1.raw
  modified_base (222)..(222): a, c, t, g, unknown or other
  misc_feature (222)..(222): n is a, c, g, or t
  modified_base (335)..(335): a, c, t, g, unknown or other
  misc_feature (335)..(335): n is a, c, g, or t
  modified_base (449)..(449): a, c, t, g, unknown or other
  misc_feature (449)..(449): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctgctcgtgganattcattcgaccaaagatatacttgttgttcaagcagaagtcaggccaggtccctgtactggtcatccatgacgcagtcgacacacgtccgggatcccgtgagacgtacttcnctcgcctccgacgctcgagggacagtccggacctaccgttgaactgtccgacgggtcgggaccctagggtcggacgcgtagagtctgacttattgtcgttaccgacacagtacngtacgtcggtacagttccggtaggggttcgtacgggacggacggtaacgagttacggtaccggtcggttacggtccgaacgccgtaacggccggtccgtaccccgttcggtcctacccgtccgtaccgg

SEQ ID NO: 89743 - DNA, 664 bp, Homo sapiens
  misc_feature: GYAE6OF02JA7ZB.21.8.A08.1.454.CMB.1.raw
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
tcagtcgtcgctcgcacgaccggtgctcgatttagcatactctacaggggcgtggtgggcgtcgaggaggcgaggaggctctgggaagtcgtcaccatggcctcggaccccgtcctccctcgcctccccctccctccacctttcctgtccacagtctctgacggcctcctatcgagctgacacagccacctcggtcgtcagtcgtcccacggacaacggccaggactccgacctgacctcgtggagactcgattgaccaaaaagataatacttgttagttccagcagaagtcagccaggcccctgtactggcatccgntcggagccgaagtcgacgacacgtccggnccgtgacgagcttctacgccgtccncctgctaccgtagggacccagttacccgggccctaccggtttccgaaagtttacgtaccgtacgggttcgggacccggtacgggttacggaccggtagtagggaacgtcgtaacgaccgttaacgtttacgttggttaaccgaccgacgtacgaacgtaggtacggtgtagacgtacggtagggggttatccggagggaccgggtacgtaaggttcggaccgttcggttccggagtccggacccgaacggtcgtcccggtaccccgtcggtacccttaccgtcccgtacccg

SEQ ID NO: 89744 - DNA, 524 bp, Homo sapiens
  misc_feature: GYAE6OF02G4KOY.21.8.A08.1.454.CMB.1.raw
  modified_base (218)..(218): a, c, t, g, unknown or other
  misc_feature (218)..(218): n is a, c, g, or t
  modified_base (462)..(462): a, c, t, g, unknown or other
  misc_feature (462)..(462): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatcccctgacgagtattctctcgcctccagctacgagggacaggtcgcctaccgttgactatcgaggtcggggcccgagggtcggacgagtagaagctagtactactattagtacgcacagacagtagtgtcagtcgagggtgtcggnggaggacgtagtcgaccgtcgtggtacacgccgaggctcggcccctcggctacgtctcccgg

SEQ ID NO: 89745 - DNA, 542 bp, Homo sapiens
  misc_feature: GYAE6OF02HJYSQ.21.8.A08.1.454.CMB.1.raw
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttggttccagcagaagtcaggccaggcccctgtactggtcatccatgaggccagtcgacgacacgtccgggatccccngagagattcnctgccctccagcctcgagggacaggtcggcctaccgttgacttatcgacggtcggggcccagggtcggacgatggaagctagacttactagttgttaccgcaccagacagtagtggtcagtcgaggggtagttcggcgggtaggaccgagttcgtaccggttcgttggtcgacgccgaaggctacggtccccgtcggtcctacgtctccg

SEQ ID NO: 89746 - DNA, 688 bp, Homo sapiens
  misc_feature: GYAE6OF02G5C5Q.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggaacaaacggccaggatcacctgctctggagattcattgacccaaaagaatatacttgttggttccagcaagaagtcaggccacggcccctgtactggtcactccatgacggccagtcgacgacaccgtccggactcccgtagagagtacttctctcgcctccacgcgtacgacgggtacacggtcggaccctaccgttcgaactacgtccgtaacgggtccgggggaccccgtaggggtacgggaaccgtagtaggaacgtcgtacgtaacgttaactttaacgtttcgtaaccgaccaaccgaacgtaacgtaggttaggtcggtactacggtacgggtaaggggggtttacgttcgggacggggtaaggtaacccggttaagggttccgtaacccgggtttccggttagggtaacccgtaccggaaccccggtaacggtcccgttaccccggtccccccggttacgggttaccctacccgttcccgtttcccccgg

SEQ ID NO: 89747 - DNA, 565 bp, Homo sapiens
  misc_feature: GYAE6OF02HXP0V.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctcctatgagctgacacagcccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatccccgtgagagatttccgtctgccctcagctcgaagggcagtcgccacttgactatcaggtcgggcccgaggtcggacgagtagaagcgtagacttactagttacgttacgcaccagacagtagtgtacagtcgaggggttactcggacggacgggaccgtaggtccggtaccggttccgttggtacgaaccggacccgaagggtccgttccggacccccgttcggtacctaccgttccgttcccgg

SEQ ID NO: 89748 - DNA, 531 bp, Homo sapiens
  misc_feature: GYAE6OF02GDV70.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacagacggccaggatcacctgctctgcagatggactgaccaaagaatatgcttattggtaccaacagaagccaggccaggccccctgtgttagtgatataataaagacactgagaggccctcagagactccctgagcgatttctctggcctcagtctcgagggacagcagtcacgttgactatcaggtgaacgtccaggacaggaggacgaggctagactattactgacaaacagtagacaaggtagagtactacgtagttagggttggtcgggacgggagggaaccgaagtcgtacggacccgttcgtaggtccgacggacccgtacggcttaccccgg

SEQ ID NO: 89749 - DNA, 986 bp, Homo sapiens
  misc_feature: GYAE6OF02H8VRT.21.8.A08.1.454.CMB.1.raw
tcagtcgtcgctcgcacgaccggtgctcgatttagcatactctacaggggggctgtgggctcaggaggcagagctctgggaatctcaccactggcctggacccctcgtcctgcctcccctcctcacgtttctggcacagtctctggaggcctcctatgacgctggacaccagtccaccctcgggtgtccaggtgtccccaggtacaaacggccaggagtccaccgtggctcgtagggacgtagttccattcggaccaaaaaggattactaccgtttggttcgggttacccagtccgaaggaagttacgaacgggtcccaacggggtccccccttgttaaccttacggggttaccaacgtttccccgaagttcggaacgggtacccctacggttaccggaaccggtaaccgtaacccggttacccggggggaaactttcccccggttagggaacggtaacgtaacggttttacccttacccgtaccggtacccgttaccgaagggtcccttaccggaaacgggggtaccgacggtttaccggggaccctacccgtttacgggtaacccgtttaacggttaccggtaacgggggttaccggggggtacccccgtaacgggggtacggggaacccggtaaggttacggggaaacggttaccggttaggtaacccgttaacggtttaacgtttaccgggttaacccggtaccgtaaaccccggtaacggtaaccggttaaacgggtttaaccggtttaccgggttaccgtaacggtttacccgggtaagggggggtttaccgttaccgggggaaccgggggtaacgggggtaaaccccgttaaccggggttttccgggtaacccgggttttcccggttaacggggttcccgtaacccgggtaccccccgtaaagggggtcccggttacccgggtacccccccggtttaccggggtacccttaccccgggtttccgtttaaccccccgggg

SEQ ID NO: 89750 - DNA, 646 bp, Homo sapiens
  misc_feature: GYAE6OF02ILHKO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctcgtggagattcaattgaccaaaaagaatatacttgttggttccagcagaagtcaggccaggcccctgtactggtcatccatgagccagtcgacgacacgtcggatcccgtgagagattctctcgccttccgagctacgacgggactaggtcgacctaccttgacttatcgagtcggggcccgaggtcggacgagtacggaacgtcgtacgtacttaacgttagttacgttaaccgtctaaccacggtaactaacggtaggtacggtacgtagttacgtaagggggttacgtttacgggaccggggaacgggtaaccgtaacggttacggtacccggttccggttacgggttccggtaaccggtacccggtaaacgggtcccgttaccggaccccccgttaccggggttaccctaccggttcccgtttaccccgg

SEQ ID NO: 89751 - DNA, 555 bp, Homo sapiens
  misc_feature: GYAE6OF02HYC4K.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttggttccagacagaagtcaggccaggcccctgtactggtcatccatgagcagtcgacgacaccgtccgggatcccgtagacgagtacttctctcgcctccagctcgagggacaggtcggcctaccgttgacttatcgacggtcggggacccgagggtcggacgagtaggaagctagaacttacttagttacgttacgcacgagactagtagtgtcagtcgaggggttactcgggacggaggactaagttcggaccgtcgttaggtcgacgacccgaggcctccgccccgtcggtcctaccgtccttccgg

SEQ ID NO: 89752 - DNA, 581 bp, Homo sapiens
  misc_feature: GYAE6OF02IUWCM.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatcacctgctctggatnttcattgaccaaaagatatacttgttgtccagcagagtcaggccaggcccctgtactggtcatccagtgacggccaggtccgacgaccacgtccgggatcccgtgagagtattcctctcgccctcagctacgagggacagtcgacctacctgactatcgaggtcgggcccgagggtcggacgagtagaagtctagacttacgttattcgtaccgcaccgagtacaggtacgtggtacagtcggtaggggtcgttacgggacgggtacgggaccgtaggttcggtaccggttccgttacggtacgaccggtacccgaggtccgtaccggtcccccgtcggtacctaccgttccttcccgg

SEQ ID NO: 89753 - DNA, 530 bp, Homo sapiens
  misc_feature: GYAE6OF02IL9QN.21.8.A08.1.454.CMB.1.raw
  modified_base (130)..(130): a, c, t, g, unknown or other
  misc_feature (130)..(130): n is a, c, g, or t
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagtcgtcgctcgcacgaccggtgctcgatttagcatactctacagggggctgtgggctcgaggaggcagagctcgtgggaatctcaccagtggcctggacccctctcctgctccccctctcactttcngcacagtcctctgaggccctcctatgagctgacacacgccaccctcggtntcagtcgcccaggacaaacggccaggatcacctgctcnggatattcattgaccaaaagatactattgttgtccagcagaagtcaggcaggcccctgactggtcatccatgagcagcgacactacnccggatcccgngagagtattcnctcgcctccagcacgagggacagtggcctaccttgactatcgcggtgggcccaggtggacgatagaagctgaacttacgtattgtacncaccgagacagttagnggtacagttcgaggggtacttcggacggtaggaccagttcgaccgtcgtacggtcaacgcccgaaggcccgtcgcccctgggtcctactccgttcccgg

SEQ ID NO: 89754 - DNA, 617 bp, Homo sapiens
  misc_feature: GYAE6OF02FTPMC.21.8.A08.1.454.CMB.1.raw
  modified_base (218)..(218): a, c, t, g, unknown or other
  misc_feature (218)..(218): n is a, c, g, or t
  modified_base (324)..(324): a, c, t, g, unknown or other
  misc_feature (324)..(324): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctggtgtcagtcgtccccaggacaaacggccaggatcacctgctctgganttcattgaccaaaagatatacttgttggttccagcagaagtcaggccaggcccatgtactggtcactccatgaggccagtcgacgacacgtccggatccctgaganattctctcgccctcagctcgaagggacagtcggcctaaccgtttgactagtcgaagggtcggggaccctagggtacggacgtagtaggaagtcctaggaaccttacgttaagttcggttacgacctaaccgacgacgtacggttagtcggtactaagttcgggtaaggggttacgttcggggacggggacgggtaccgtaaggttaccggtacccggtttcggttacgggtacccgtacgtacccggtacggtccttacccggcccccgtttacggtccctaccgttccccgg

SEQ ID NO: 89755 - DNA, 584 bp, Homo sapiens
  misc_feature: GYAE6OF02HDO3L.21.8.A08.1.454.CMB.1.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagtcgtcgctcgcacgaccggtgctcgatttagcatactctacagggggggagtaggagcccagctactagaagtcggcggtgtttccattcggtgatcagcactggaacacagaggactcaccgatggagtttgggctgagctgggttttcctccttgctcttttaagaggtgtccagtgtcaggcgcaactggtggagtctgggggaggcatggtccagcctgggaggtccctgagcctctcctgtgcagcgtctggattcgagtatcggtctcctttgccctatgcacgtgggtcccnccaggcctccgaggcgaaggggcctggagtgggtgcgtattancgtggtatgatggaagtgagagatattatcagtactccgtaggaacgggtccattccaaccgtatctccgagagactaatcgaccaacgaccacactcgtactcttacaattccgacccgtctgacgtacgccggaaggaccacggtactacgttaggttaaccttacgtcgtaaccggtagtaccgtttaggacgtacggttaccggggacctaaccggggacccttcgggtacccg

SEQ ID NO: 89756 - DNA, 687 bp, Homo sapiens
  misc_feature: GYAE6OF02INSBY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggactcacctgctcgtggagtattcattgaccaaaagatatacttgttgtccagcagaagtcaggccaggcccctgtactggtcatccagtggacggccagtcgacgacacgtccgggactcccgtagagatattcctctcgtccctccgagtcctacgaacgggacacggtcggaccctaccgtttcggaacttacgtcgacgggtcggggaccccgtaagggtacgggaacgtaggtacggaaacggtccgtacgtaaccgttaacgtttacgtttacggtttaaccgaccaaccgaggtaacgtaaggttaaggtcggtacaggttacggtaacgggggttacgttacgggaccggggtaacgggtaacccgtagggttaccggtacccggttccgtttacgggtaccgaaccggtaccccggtaaggtcccgttacccggtccccccggttacgggtacccttaccgttcccgttaccccgg

SEQ ID NO: 89757 - DNA, 560 bp, Homo sapiens
  misc_feature: GYAE6OF02JQ6VJ.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagatatacttgtgttccagcagaagtcaggccaggcccctgtactggtcatccatgacgccagtcgacgacacgtccggatcctgacgagattcctctcgcctccagctcgaggacagtcgcctactgtactactcgaggtcgggaccctagggtcggacgtagtagaacgcgtagactacttatacggtaccgcaccagacgtagtacggtgtacagtcggtagggttacgtcggacgggacggacgtaggttcggcccggttacgttggtcgacgtaccgaacgggccttccggcccccgttaggtccctacgtccgttccccgg

SEQ ID NO: 89758 - DNA, 669 bp, Homo sapiens
  misc_feature: GYAE6OF02G68L9.21.8.A08.1.454.CMB.1.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
  modified_base (381)..(381): a, c, t, g, unknown or other
  misc_feature (381)..(381): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgttggttccagcaagaagtcaggccaggcccctgtactggtcatccatgaggccagtccgacgacacgtccgggatcccgtagagagtattccnctcgcctccagcctcgacgggacaggtcgacctacttgactancgaggtcgggcccgagggtggacgagtaggaagtcgtagtaacttacgttagttacgttaccgaccgtaacccgaaggaaccgtaaggttacggttacggtactaacggttaccgggtaaggggggtttacgttaccgggggacgggtaacgggggtaacccgtaagggtttaccggtaacccggtttccggtttaccgggttaccgaacccggtaccccggtaacgggtccctacccgggtccccccggttaccgggttacccgttacccgttccgtttaccccggg

SEQ ID NO: 89759 - DNA, 614 bp, Homo sapiens
  misc_feature: GYAE6OF02FMX53.21.8.A08.1.454.CMB.1.raw
  modified_base (459)..(459): a, c, t, g, unknown or other
  misc_feature (459)..(459): n is a, c, g, or t
tcagtcgtcgctcgcacgaccggtgctcgatttagcatactctacagggggctgtgggctcaggaggcagagctctgggaatacctcaccatggcctggacccctctcctgctccccctcctcactttcctgcacagtacctctgaggtcctcctatgagctgaccacagcccaccctcggttgtcagtggtaccccaggaccaaacggccaggatccacctgcctctggagattcattgaccaaaagaatatacttgttcgttccagcagaagtcaggtccacggcccctgtacctggtccatccatgacggcctaggtccgagaccgaccgtccgggatcccctgacgagtacttcgtctacgcctccagctcgagggactaggtcgccctacttgactatcgaggtcgggccaggtcggacgagtagaagtctagtacttaactagttcgttaccncaccgtacgacgagtagtgtcgaacgttcgaaggggttacttcggggacggtacgggaccgtaggttacggtaacgttaccggttaccgttagggtaccgtaacggtaccccgtaagggtccctaccggacccccgttccggtcctaccgttccg

SEQ ID NO: 89760 - DNA, 585 bp, Homo sapiens
  misc_feature: GYAE6OF02IPDYS.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccagtggaggccagtcgacgacacgtccgggatccgtagagagattctctcgcctccagctcgagggacagtcggaccctaccgttgactatacgagggtcgggacccgagggtacggacgtagtagaagcgtagtaacttacttagttacgttacgccaaccgagactagtaggtgtactagtacggaggggttacgtcgggacgggaacgggtacctaggttcgacccggttcgttacggtacgacgacccgtaaggtccgtccggtcccccgttcggtacctaccgtcgtccccg

SEQ ID NO: 89761 - DNA, 591 bp, Homo sapiens
  misc_feature: GYAE6OF02I6QCC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggacaaacggccaggactcacctgctctggagtattcattgaccaaaagaatatacttggttgtccagcagaagtcaggccacggccctgtactggtcactcagtgacgccagtacgacgacacgtccggactcccgtagacgagtacttcctctcgtcctccagctacgaggtacacggtcgcctaacttgaacttactcggacggtccggggacccgtagggtcggaacgtatacggaaacgtcgtacgtactacgttagttacgtacgaccacgaagactaaggtacgtcgactagtacggtaggggttactcggacgggaacggacgtagtcggtaccgtcgttaggcacggtacccgtaggtcccgtccgccccgttcggctaccgtcgtccccg

SEQ ID NO: 89762 - DNA, 524 bp, Homo sapiens
  misc_feature: GYAE6OF02GJ11K.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggagcatggtccagcctgggaggtccctgagcctctcctgtgcagcgtctggattcagtatcggctcctttgccatgcactggggtcccgccaggctccgaggcaaggggctgggagtggggtggcgattatctggtatggatggaagtgagagatattattcagactcggtagaacgggcgatcacatctcagacgacaatcgaccaacaaccacactgtacggtcttacaatcgaccgctgagacgcgaggacgacgctagtgtattactgtacgagtctttggtcgtagttcgggccgacgggtacccgtggtaccg

SEQ ID NO: 89763 - DNA, 516 bp, Homo sapiens
  misc_feature: GYAE6OF02JNH9I.21.8.A08.1.454.CMB.1.raw
  modified_base (220)..(220): a, c, t, g, unknown or other
  misc_feature (220)..(220): n is a, c, g, or t
  modified_base (332)..(332): a, c, t, g, unknown or other
  misc_feature (332)..(332): n is a, c, g, or t
  modified_base (372)..(372): a, c, t, g, unknown or other
  misc_feature (372)..(372): n is a, c, g, or t
  modified_base (448)..(448): a, c, t, g, unknown or other
  misc_feature (448)..(448): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgagccagtcgacgacactccgggatcccgtgagagacttcncgtcgcctcagtctcgagggacaggtcgcctacttgactntcgaggtcgggccaggtcggacgagtgaagctagactagtattgtacgcacgagacagtagtgtacatcgagggtntacggcggaggaccaggttcgaccgtcgttaggtcacgccgaggcgtcgccctcggtcaccgtctccg

SEQ ID NO: 89764 - DNA, 629 bp, Homo sapiens
  misc_feature: GYAE6OF02HYIXY.21.8.A08.1.454.CMB.1.raw
  modified_base (177)..(177): a, c, t, g, unknown or other
  misc_feature (177)..(177): n is a, c, g, or t
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtntcagtcgtccccaggacaaacggccaggatcacctgctctgganattcattgaccaaaagatatacttgttgttccagcagagtcaggccaggccctgtactggtcatccagtgacggccagtccgacgacacgtccgggatcccgtgacgagtactttctctcgccctccgacgtcctacgaacgggactacggtcggccctaccgttgaacttacgtacgacgggtcggggaccccgtagggtacgggacgagtaggaacgcgtacgtaacgttaacgttagttacgttaccgaccaccgaacgtaacgtaggtacggtcggtactacgtacggtaaggggttacgtccgggacgggacgggaccgtaggttacgtacccggttcgttacggtacgtacggtacccgaacggtccgtccggtccccgtcggtacctaccgtcgttcccgg

SEQ ID NO: 89765 - DNA, 497 bp, Homo sapiens
  misc_feature: GYAE6OF02FZVDJ.21.8.A08.1.454.CMB.1.raw
  modified_base (188)..(188): a, c, t, g, unknown or other
  misc_feature (188)..(188): n is a, c, g, or t
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattntgtttttggaccagcagaagtcaggccaggcccctgtgttagtgatatataaagacactgagaggccctnagagatccctgagcgattctctggctccagctcagggacagcagtcacgttgactatcagtgaagtcaggcagagacgagctgactattactgtacaaacagtagacagtagagtactcagttggtgtcggcggaggacagctgaccgtctaggtcacgacccaggcctcgcccccgtggtccactctcccg

SEQ ID NO: 89766 - DNA, 488 bp, Homo sapiens
  misc_feature: GYAE6OF02IBIRG.21.8.A08.1.454.CMB.1.raw
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (484)..(484): a, c, t, g, unknown or other
  misc_feature (484)..(484): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaaacggccaggatcacctgctctggagattcattgaccaaaaagaatatacttgttggttccagcagaagtcaggccaggcccctgtactggtcatccatgaggccagtcgacgacactccgggatcccgtgagagattctctgcctcagctcgagggcagtggccacttgaactatcgagtcgggcccaggtggacgagtgaagctgactatattgtacgcacagacagtagtgcagtgagggtntcggngaggacagtgacgtctgcagccaagctcgcccctggcactntccg

SEQ ID NO: 89767 - DNA, 534 bp, Homo sapiens
  misc_feature: GYAE6OF02GCBLR.21.8.A08.1.454.CMB.1.raw
  modified_base (216)..(216): a, c, t, g, unknown or other
  misc_feature (216)..(216): n is a, c, g, or t
  modified_base (422)..(422): a, c, t, g, unknown or other
  misc_feature (422)..(422): n is a, c, g, or t
  modified_base (451)..(451): a, c, t, g, unknown or other
  misc_feature (451)..(451): n is a, c, g, or t
  modified_base (514)..(514): a, c, t, g, unknown or other
  misc_feature (514)..(514): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggactcccgtgagagtattctctcgccctcagcctcgagggacagtcggacctacgttgactatcgacggtcgggcccgagggtggacgatgaagctgactactattgtacncacagactagtagtgtcagtcgagggttntcgggacggaggacgtagttcgacgtcgtggtcgacgccgaaggccgtcgccccgtcgtaccnctcgttccgtccctaccccg

SEQ ID NO: 89768 - DNA, 517 bp, Homo sapiens
  misc_feature: GYAE6OF02G5BSS.21.8.A08.1.454.CMB.1.raw
  modified_base (369)..(369): a, c, t, g, unknown or other
  misc_feature (369)..(369): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtgtccccaggaaaaacggccaggatcacctgctctggagattcattgccaaaagatatacttgttggtccagcagaagtcaggccaggcccctgtactggtcatccatgagccagtcgacgacacgtccgggatccccgtgagagactttctctgccctcagctcgagggacaggtcggccacttgactancagtgggcccaggtgacgatgacgctagactactattgttacgctaccagacagtagtggtcagtcgaggggttattcggcggagggacaagtcgaccgttcgttggtcacgccgaaggtctcgccccgtgtcctactctcgttcccc

SEQ ID NO: 89769 - DNA, 601 bp, Homo sapiens
  misc_feature: GYAE6OF02IBFIC.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggaccaaacggccaggatcacctgctctgganattcattgacaaaagatatacttgttggttccagcagaagtcaggccaggcccctgtactggtcatccatggaggccagtcgacgacacgtccgggactcccgtgagagtattcctcgtcgcctccagcctcgaagggtcagtcggcctaccgttagaccttatcgaggtcggggcccgtagggacgggacgagtaggaagcgtagaaccgttacttagttcgttacgacaccgagactaggtacggtgtactagtacggtagggggttagttcgggacgggagggtaccgtaaggttcggtaccggttcgttacggtcgaaccggtacccgtaacgggtcctcggtcccccccgttacggtcctacccgttccttccccgg

SEQ ID NO: 89770 - DNA, 839 bp, Homo sapiens
  misc_feature: GYAE6OF02JON34.21.8.A08.1.454.CMB.1.raw
tcagtcgtcgctcgcacgaccggtgctcgatttagcatactctacaggggcgtgtgggcgtcaggaggcgagagctctgggaatctcaccatggcctggacccctctcctgcctcccccctcctccacctttcctgcacagtctctgaggcctcctatgagctgacacagcccaccctcggtgtcagtgtccccaggaccaaacggccaggatcacctgcctctggagattcattcgaccaaaaagtaatagtacttgtggttccagcaagaagtcaggccaggtccccctgtacgtgtcatccagtgaacgccagtcgacgacacgtaccgggactccccgtgaagtactagtttcctcgtcgtacccttccgaacggtcctaccgagggggaacctagggtaccggcccctaaacccgtttgggaaaccctttacgtacccggtaacgggttacccgggggggtacccccgtaaaggggggttccgggaaaccggtaagttaacgggtaaaccgggtacgtttaccgggtaaacctttaaacgtttaaccgtttaggttaaccccgggtaaccttaaccccggaaaggtaaacccgttaggtaaaaccgggtttccgggtaaccgtaaaggttcccgggtaaaagggggggtttacttcccggggtaaccggggaacggggtaaccccgttaggggtttaacccggtaaccccgggttcccggttttagggtaacccggtaacccggtaaccccgggttaaaccggcccggttccccccggtaacccccccgggttccggggttaaccctaaccccggtttcccggtttcccccggg

SEQ ID NO: 89771 - DNA, 554 bp, Homo sapiens
  misc_feature: GYAE6OF02J2SFE.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggctcctttgccatgcactgggtcccgccaggcctccgaggcaagggggctgggagtggggtgcgtattatcgttggatgagtgggaagtggagagtatattattcagtactccggtaggaacgggccgtattcaccatcctcagagacaatcgaccaacacacacgtgtactcttacaaagtcgaccggacctagacgacgaccggacggacgacggctagtgttactacgtgtacgtagtcgtttgtacgtcggttacgggaccgtacgggtacccgtggtaccg

SEQ ID NO: 89772 - DNA, 677 bp, Homo sapiens
  misc_feature: GYAE6OF02H5JHJ.21.8.A08.1.454.CMB.1.raw
  modified_base (109)..(109): a, c, t, g, unknown or other
  misc_feature (109)..(109): n is a, c, g, or t
  modified_base (131)..(131): a, c, t, g, unknown or other
  misc_feature (131)..(131): n is a, c, g, or t
  modified_base (136)..(136): a, c, t, g, unknown or other
  misc_feature (136)..(136): n is a, c, g, or t
  modified_base (168)..(168): a, c, t, g, unknown or other
  misc_feature (168)..(168): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (395)..(395): a, c, t, g, unknown or other
  misc_feature (395)..(395): n is a, c, g, or t
tcagtcgtcgctcgcacgaccggtgctcgatttagcatactctacgagggggctgtgggctcagggaggcgagagctactgggaatctcaccatcggcctggacccctntcctgctcccctctcactttcngcacngtcctcgtgaggtcctctatgacgctgaccanacgcccacccgtggtgtcagtcgtcccgaggacaaacggccaggatcacctgctcgtgganttcattgacaaaagntactacgttgttgtccagcagagtcaggccacggcccctagtacgtggtcactccagtcgacggccagtcgacgcacgtcgggactcccgaggagcgtcttcgactcgacctcgagctcggaagggcagggtcgacctacgttgaaccttntcgacgggtcgggtaccccgaagggtcggaaccgtagtacgggaaacgtccgttaagtaaccgttacgtttaagtttcggttaaccggcctaacccgtaaggtacctaagggttagttccggtaactagttacgggttagggggttaaccttcgggaaccggacggggtaaccttacggttcccgggtaccggttaccggtttcgggaaccgtaacggtacccggtaagggtccctaacccggcccccggttagggtaccctaccggttccgtttcccccgg

SEQ ID NO: 89773 - DNA, 526 bp, Homo sapiens
  misc_feature: GYAE6OF02F67O4.21.8.A08.1.454.CMB.1.raw
  modified_base (448)..(448): a, c, t, g, unknown or other
  misc_feature (448)..(448): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgcactccgggatccctgagagattctctgcctccagctcgagggacagtcggcctaccttgactatcgaggtcggggccagggtggacgagtagaagcgtgactactattgtacgcaccagacagtagtgtcagtcgaggggtnttcggacgggaggacgagttcgaccgtcgttcggtcacgacccaggctccgccccgtcggtcctacctcgggttaccc

SEQ ID NO: 89774 - DNA, 500 bp, Homo sapiens
  misc_feature: GYAE6OF02H1TVA.21.8.A08.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgtctggagattcattgaccaaaagatatacttgttggttccagcagaagtcaggccaggcccctgtactggtcatccaatgaggccagtcgacgacactccgggatccctgagagattcnctgctccagctcagggacagtgccaacttgactatcagtgggcccaggtgacgatgaagctgactactattgttacgctacagacagtagtggcagtcgaggggtattcggaggaggaccaagtgaccgtcgtgctagccaaggctcgccccgtcgtcactcctgttccccg

SEQ ID NO: 89775 - DNA, 530 bp, Homo sapiens
  misc_feature: GYAE6OF02FWZOK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagagtcaggccaggcccctgtactggcatccatgagccagtcgacgacactccgggatcccctgagagatttctctcgcctccagctcgagggacagtggccaccttgactatcaggtgggcccagggtggacgagtgaagctgacttactattgttacgcaccagacagtagtggtcagtcgagggggtattcggcgggagggacctaggttcgaccggttccgttggtcgacgcccgaaggcctcgcccccggtcggtccaccgtcgttcccg

SEQ ID NO: 89776 - DNA, 584 bp, Homo sapiens
  misc_feature: GYAE6OF02IOHA6.21.8.A08.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggtccagcagaagtcaggccacggcccctgtactggtcactccatgacggccagtccgacgacacgtccgggactcccgtgacgagtacttctctcgccctcgagcctcgacgggacaggtcgacctaccgttgacctatcgaggtcgggcccgagggtcggacgagtagaagcgtacgactacttagttcgttacgaccaccgaagacgagttaggtggtactagtcggaggggtagttcgggcgggtacggaaccgtagttcgaccgttcgttcggtccgacgcccgaacggtccgtccgcccccgtcggtcctaccgttcgttccgttacccctacccc

SEQ ID NO: 89777 - DNA, 679 bp, Homo sapiens
  misc_feature: GYAE6OF02HNAI9.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggactcacctgctcgtggagtattcattgaaccaaaaagatatacttggttcggttccagcagaagtcaggccacggcccctgtactggtcatccatggacgccaggtcgacgacacgtccgggactcccgtagagtagtacttcctcgtcgccctccgagtctacgagggacagtcggccctacgttgactagtcgagggtcggggacccgtagggtacggaacgtagtaggaacgtcgtacgtaaccttacttagtttacgttaaccgctaaccgagtaacctaggttaggtcggtactagtacgggtaagggggttacgttcggggacggggtaacggaaccgttaggtttccggtacccggtttccggtttacgggtacccgtaaccggaaccccggtaagggtcccgttcccggtccccccggttacgggtaccccttaacccgttccgtttaccccggttcccccttaccccccg

SEQ ID NO: 89778 - DNA, 532 bp, Homo sapiens
  misc_feature: GYAE6OF02G3ECB.21.8.A08.1.454.CMB.1.raw
  modified_base (481)..(481): a, c, t, g, unknown or other
  misc_feature (481)..(481): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagcgtgggttttcctccttaggctcttttaagaggtgtccagtgtcaggcgcaactggtggagtctgggggagcatggtccagcctgggagtccctgagcctctcctgtgcagcgtctggattcagtatcggctcctttgccatgcactgggtccgccaggctccaggcaaggggctgggagtggggtggcgattatcgtggtatgatggaagtgagagatattattcagactccgtgaacgggcgattcaccatctccagagacaagtgaccaacaaccacacctgtactcttacaaagtcgaccggcctagagacgaccgaggacacggctatgtattcngtacgagtcgtttggtcgtagttcggggaccacgggtacccgtggtacccg

SEQ ID NO: 89779 - DNA, 664 bp, Homo sapiens
  misc_feature: GYAE6OF02JNVHL.21.8.A08.1.454.CMB.1.raw
  modified_base (217)..(217): a, c, t, g, unknown or other
  misc_feature (217)..(217): n is a, c, g, or t
  modified_base (404)..(404): a, c, t, g, unknown or other
  misc_feature (404)..(404): n is a, c, g, or t
tcagtcgtcgctcgcacgaccggtgctcgatttagcatactctacagggggcgtgtgggctcaggaggcagagctctgggaatctcaccatggcctggacccctctcctgctccccctcctccactttctgcacagtctctgaggcctcctatgagctgacacagccaccctcggtgtcagtctcccaggacaacggcaggactcactgctctgganatcattgaccaaaagatatacttgttcgttcagcagaagtcaggccacggcccctgtactggtcatccatcggagccagtcgaacgacgacgtccgggaactccccgaggacgagtacgttcctacgcggtccctacgtaggccttcggaacgggacacgggttcgacccgtaccgttcgaaccttntacgtacggttcggggacccgtagggtccgggtaacggtagtacggtaagtacgtacggtaaccgttacttaacgtttcgttaaccgaccgtaacccaacgtactaacggttacggtagtccgtaacggtacggtacggggttagttccgggaggggtaaccgggtaacgtacggttcggaccgttccggtacggttacgaaccgttcccgaacggtccgtaccggacccccgttcggtaccgtccgtacgtttccccgg

SEQ ID NO: 89780 - DNA, 506 bp, Homo sapiens
  misc_feature: GYAE6OF02F3KEI.21.8.A08.1.454.CMB.1.raw
  modified_base (219)..(219): a, c, t, g, unknown or other
  misc_feature (219)..(219): n is a, c, g, or t
  modified_base (448)..(448): a, c, t, g, unknown or other
  misc_feature (448)..(448): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggccccctgtactggtcatccatgaggccagtcgacgacactccgggatccctgagagattctctgcctccagctcgagggacagtcggccacttgactatcagtcgggccagggtggacgagtgaagctgactactattgttacgcaccagacagtagtggtcatcgaggggtatcggnggaggacagtgaccgtcgtgtcagccgaaggctcgccccgtcggtctacgtcttcccg

SEQ ID NO: 89781 - DNA, 740 bp, Homo sapiens
  misc_feature: GYAE6OF02J2VV6.21.8.A08.1.454.CMB.1.raw
tcagtcgtcgctcgcacgaccggtgctcgatttagcatactctacaggggggaggaggagcccagcactagaagtcggcggtgtttccattcggtgatcagcactgaacacagaggactcaccatggagtttgggctgagctgggttttcctccttgctctttaagaggtgtccagtgtcaggcgcaactggtggagtctgggggaggcatggtccagcctgggaggtccctgagcctctcctgtgcagcgtctggattcagtatcggctccttgccatgcacgtggtccgcaggctccgaggcgaaggggctgggagtgggtggcgtattagcgtggtatggaagtgggaaggtggagtaacggattagtttactttacgaggtaaccgtccgggttacggaaacgggggtcccgtacgttaccgtaacccgaacgttacccgtaccgtaaacggaggaaacccgtaaagttacgaacccgtaaaaccaaacctacccgtaaaccgttgttaaaccttacccgttttaacgaaaacttaccgggtaaaccccgggtacccgttcgggtaaagggaccggaacccgggaaacgggtaacccgaaccggggtctaacgttacggttaaccgtttaaaccgtagggttaaccgtaaccgggtttccgtttaacgggttaccgttaacgggttccgggggtaacccggtaccgggggtaaacccccgtttggggtaaccccgg

SEQ ID NO: 89782 - DNA, 789 bp, Homo sapiens
  misc_feature: GYAE6OF02JOZ9B.21.8.A08.1.454.CMB.1.raw
  modified_base (771)..(771): a, c, t, g, unknown or other
  misc_feature (771)..(771): n is a, c, g, or t
tcagtcgtcgctcgcacgaccggtgctcgatttagcatactctacaggggctgtgggctcaggaggcagagctctgggaatctcaccatggcctggacccctctcctgctcccctcctcactttctgcacagtctctgaggcctcctatgagctgacacagcccaccctcggtgtcagtcgtccccaggacaaacggccaggactcacctgcttcaggacgtattccgattcgaccaaaaagtaatacgttactttgttaggttacaaggcaaggaagttacaacggtccaacgggtccccctaggttactcgggttccaattccgaagtcggaacggcccaggtccggaacgaccgtaccggtcccggggaactccccgtaggaacgtacgtaacgtttccgtaccgtacgtccccgttaccgacggttacccgtacccggaaaggggtaccgtaacgggttcgggaacccccttaacggttttacgggaaccttaacgttaccgtaacggggttccgggggaaccccggtaaggggttacgggaccggtaaggtacggaacggtacgttacggtaacgttaacgtttacgtttacggttaccgaccgtacccgaagtaccgaaggttagtaccgggtacacggttacggaacggggttacgtccgggtacggacgggtaaccgtagttaccggaacccggtttccgtacggttaccgaccgggtaaccccgtagggtacccgttcccgggcccccgttagggttacccnccggttaccgttccccgg

SEQ ID NO: 89783 - DNA, 623 bp, Homo sapiens
  misc_feature: GYAE6OF02HT688.21.8.A08.1.454.CMB.1.raw
  modified_base (172)..(172): a, c, t, g, unknown or other
  misc_feature (172)..(172): n is a, c, g, or t
  modified_base (213)..(213): a, c, t, g, unknown or other
  misc_feature (213)..(213): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctgcacagtctctgaggcctctatgagctgacacagccaccctggtntcagtcgcccaggacaaacggcaggatcacctgctctgganattcattgaaccaaaagatatacgttgttggttccagcagaagtcaggccaggccccttgtactgggtcatccatgacggccagtcgacgacacgtccgggatcccgtgagacgtattctcgtacgcctccgacgctacgagggtactaggtcgacctaccgttgactatacgaggtaccggggaccgtagggtcggacggtagtacggtaagacgtagtaaccttacttacgtttacgttaaccgacgaaccaagacgtaggtacgtggtactaggtacggtaggggttacgtacgggaacgggtacgggaaccgtaggttcggtaccggtcggttacggtaccgacgtacccgtaacggtcccgtaccggtcccccgttacgggtaccctaccgttacccgttacccg

SEQ ID NO: 89784 - DNA, 529 bp, Homo sapiens
  misc_feature: GYAE6OF02IJIIL.21.8.A08.1.454.CMB.1.raw
  modified_base (220)..(220): a, c, t, g, unknown or other
  misc_feature (220)..(220): n is a, c, g, or t
  modified_base (310)..(310): a, c, t, g, unknown or other
  misc_feature (310)..(310): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaaagatatacttgttggttccagcagaagtcaggccaggcccctgtactggtcatccatggaggccagtcgacgacncgtccgggatccctgagagattctctgccctcagctcagggacagtggccacttgactatcaggtcgggcccagggtggacgatgaagctgacttatatttgttacgcaccagacagtagtgtacagtcgaggggttatcgggcggacgggaccgtaggttcgtaccggtcgttggcacgccgaaggctccggcccccgttcggctaccgtccttcccg

SEQ ID NO: 89785 - DNA, 592 bp, Homo sapiens
  misc_feature: GYAE6OF02HOI46.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgacggccagtcgacgaccacgtcccgggactcccgtagacgagacttcctctcgcctccagctacgagggacaggtcggccctaccgttgactactcgtacggtcggggcccgtagggtcggacgtagtagaagcgtagacttaacgttattacgttacgctaccagacaggtagtgtcagtcggtaggggtacgttacggcgggtaacgggacgtacggttcggtaccggttccgttacggtccgacggacccgaaggtccgtaccggcccccgttcggtcctaccgtccgttacccg

SEQ ID NO: 89786 - DNA, 722 bp, Homo sapiens
  misc_feature: GYAE6OF02H7W4M.21.8.A08.1.454.CMB.1.raw
  modified_base (129)..(129): a, c, t, g, unknown or other
  misc_feature (129)..(129): n is a, c, g, or t
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgaggcctcctatgagctgacacagcccacctcggtgtcagtcgtccccaggacaaacggccaggatcacctgctctgganattcattgaccaaaagatatacttgttgttccagcagaagtcaggccaggcccctgtactggtcatccatgaggccagtcgacgacacgtccgggatccctgagagattctctgcctccagcctcgacgggacagtcggcccaaccgtttgaaccttagtcgaggtcggggacccgtagggtcggaaccggtagtacggaaacggtcgtacggtaaccgttaacgtttaacgtttcggtttaaccgccgtaacccgaacgtaacgttaacggttaacgggttcggttacctaacggttccgggtaaacgggggggttacgtttaccggggaccggggttaacggggaacccgttaacggtttccgggtaaccccggtttccggtttaccgggttacccggaacccggttacccccggtaaacggggttccccttacccgggtaccccccccgtttaccgggttaccccgtttaccccgtttccccggtttttccccccccgg

SEQ ID NO: 89787 - DNA, 595 bp, Homo sapiens
  misc_feature: GYAE6OF02H73OK.21.8.A08.1.454.CMB.1.raw
  modified_base (127)..(127): a, c, t, g, unknown or other
  misc_feature (127)..(127): n is a, c, g, or t
  modified_base (321)..(321): a, c, t, g, unknown or other
  misc_feature (321)..(321): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttcngcacagtctctgaggcctcctatgagctgacacagccaccctcggtgtcagtcgtcccaggacaaacggccaggatcacctgctcgtggagtattcattcgaccaaaaagatatacttgttgttccagcagaagtcaggccaggcccctgtactgcatccatgagccagtcgacgacaccgtcgggacttcccnggagacgtattcgtctacggtccctcagtcctacgaggggtactaggtcggaccctaccgttgacctttagtcgtacgggtaccggggcccgtagggtacgggaaccgtagtacggaacgtcgtacgtacttacttaagttcggtacgcacagacgtaggtagtgtacagtgaggggtacgtcgggacggagggaccgtagttcggaccgtcgttaggtcaccggtaccgaaggtccgtccggtcccccgttcgggtacctccgtcttccccgg

SEQ ID NO: 89788 - DNA, 732 bp, Homo sapiens
  misc_feature: GYAE6OF02HWSEN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctcgtggagattcattgaccaaaagatatacttgttgttccagcagaagtcaggccaggcccctgtactggtcatccatggagccagtcgacgacacgtccgggatcccgtagagacgtactttctctcgtccctccagtcctacggaacgggactaggtcggaccctaccgtttgaacttactcgagggtccggggaccccgtagggtcgggacgtacgtaggaacggctacggtaaccttaacgtttagtttacggtttaaccgaccgtaaccgaaggtaaccgtaagggttaacgttacgggtaccgtaacggttaccgggttaaaggggggggtttaacgttacccggggcgggggtaaacggggtaacccggttaacgggtttaccgggtaaccccgggtttccgggttttaccgggtaccggtaaccgggtaaccccggtaaccggggtcccgttacccgggtcccccccggtttacggggtaccccttacccggtttacccgttacccccggg

SEQ ID NO: 89789 - DNA, 727 bp, Homo sapiens
  misc_feature: GYAE6OF02IN0BY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagttcgtcccccgaggaaccaaacgggccaggactcacctgctcgtggagattcagttcgaccaaaaagaattatacgttgttcggttccagcagaagtcaggccaggccctgtactcggtacatccagtggacggccgagtccgacgaccacgtcccggggatcccgtgaagacgtactttcctcgtcgtccctccgaagtccgtacgaacgggtaactagggtcggacccctacgtttagaccttagtaccgagggtaccggggacccgaagggtacgggaacgaagtacggaaaggcctacggtaaccttaacgttagtttaccggttaacgaccctaccgaaagacgtaacggttaggttcgggtactaaggttaccgggtaaaggggggttacgttaccggggaccggggtaacggggtaacccggtaggggttacccggtaacccggttccggttaaccggggtacgtaacccgggacccgaagggtaccccgttccgggtaccccccgttaccgggtaccctaccgttcccgttaccccgg

SEQ ID NO: 89790 - DNA, 532 bp, Homo sapiens
  misc_feature: GYAE6OF02JDPRC.21.8.A08.1.454.CMB.1.raw
  modified_base (219)..(219): a, c, t, g, unknown or other
  misc_feature (219)..(219): n is a, c, g, or t
  modified_base (374)..(374): a, c, t, g, unknown or other
  misc_feature (374)..(374): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattcgaccaaaagatatacttgttggttccagcagaagtcaggccaggcccctgtactggtcatccatggagccagtcgacgacactccgggatcccgtgagagattctctcgcctccagtctacgagggacagtcggccaccgttgactntcgaggtcgggccagggtggacgagtgaacgctgactatattcgtacgcacgagacagtagtgtacagtacgaggggtacgtcggacggaggactaggtcgaccgtcgttcggtcgacgccgtacggcttccggccccgtcggtccacgtcttacccg

SEQ ID NO: 89791 - DNA, 544 bp, Homo sapiens
  misc_feature: GYAE6OF02JEZP3.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgagccagtcgacgacactccgggatccctgagagtacttctctacgcctccagctacgagggacagtcggccaccgtttgacttatcaggtcgggcccagggtcggacgagtgaagctgactactagttcgtacgcaccagacagtagtgtcagtcgaggggttattcggcggaggaccgtagttggacccgtcgttcggtacgacgtacccgaaggccgttacgcccccgttgggtacctaccgtcgttcccgg

SEQ ID NO: 89792 - DNA, 651 bp, Homo sapiens
  misc_feature: GYAE6OF02GFCQS.21.8.A08.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagcatactctacagggggacgtgtgggctcaggaggcacgacgcctctgggaatctcaccagtggccgtggaccccgtctccgtcgcctccccctcctcactttctgcacagtctctgaggcctcctatgagctgacacagccaccctcgatgtcagtcgtcccaggacaaacggccaggatcgacctgctcgtggagtattcattgaccaaaaagattatactttgttgttccagcaagagtcaggccacggccctgtactggtcatccatggnggccagtcgaaccgacacgtccgggactcccgtagagagtactttctcgtgccctcacgctcggaacgggcgaagtcgggaccctaccgtttgaaccttaacgtcgaggttcggggacccggtaggggtacggaaccgaggtacggaaggtacttggtaaacttacttacgtttacgttaacgacctaaccgacgacgaaggttacgtaggtacgtagtcgggtaggggttacgttaccgggcggggtaacgggtaccgtaaggttcggtaacccggttcgttacgggccgtaacggaccggaacggtccgtaccgtcccccgtcggttacctaccgttcccg

SEQ ID NO: 89793 - DNA, 844 bp, Homo sapiens
  misc_feature: GYAE6OF02JR6VQ.21.8.A08.1.454.CMB.1.raw
tcagtcgtcgctcgcacgaccggtgctcgatttagcatactctacaggggcgtggtgggcgtcgaggaggcgagagcgtcgtgggaatcgtcaccatggcctcggacccctcgtcctcgcctccccctcctccacttcctgtccacacgtctcctgacggcctcctatcgagcctgacacgacgcccacccgtcggtcgtcgacggttcggtccccgacggaaccgaaaccgggccagggacttccgaacctggaccttccgtacgggagtacttacagtttcgacccgaaaaagtaactaattaccgttttggttccggttacccgagccgtaagaacgtccgaacggtccacgggtccccctagtaccgtggtaccacgtccaagtcggacgccaggtccgaccgactaccgtccgggacttccccgtaggaaccgtagtaccttcgtaccgtcgcccttaccggagtcgtacggaacggggtacaagggtccgtccccgacccgttttaggaccttaacggtccgtaccggggttacggggaccccttaacggggggtacgaccgggtaagttaccgggacggttaccgtacgggtaaccttaccggtttaagttccggttaacgaccgaaccgtaaccgggaattaccgggtaaggttcgtaaccggttagtaacccggggttagggggttaacggtttccggggaacggggttaaccgggaaccgggttaacgttaccggggtttacccggtaccgggtttacgggtaccggtaaccggacccggtaacggtccccgtaccggtcccccggtcgtaccgggttccctaccggttccccg

SEQ ID NO: 89794 - DNA, 1018 bp, Homo sapiens
  misc_feature: GYAE6OF02I9HB0.21.8.A08.1.454.CMB.1.raw
tcagtcgtcgctcgcacgaccggtgctcgatttagcatactctacagggggtgggcggtcagggaggcgagagcgtctgggaagtcggtcacctatcggcctaggaccctctccctgtctacccctcctctacgtttctgccacgagttcctcctagtacggcccttcctatacgaagtcgtaggacctacctacgcccacccgtccggtcgtcggacgttcgtaccccaaggtaccgaaaccggtcccgaaaaggggtcttacccgtacccgtggtccgttccgttaggggaggtaacttttaccttagtttacggaaccctaaaaaggaacttaacttaaccgttttcggtttacccgggttaccctacggtaccccgtaacgggtaaacccggtttccgaaaccccggggttccccggaaacgggggtaccccccccgtttcggggtttaaccccctttcgggggttaaccctaaccttttacccccgaaagttccgggaaaccggggttccccgtaaaagggtttccccgggaaaccggaacccgtaaccccgtttccccggggggtaacttacccccgtaagggtaaacgggtaaacggttaccggtttacccttaccgttaacggttaccccttaccggtaacgttccgtacgtaacggggtacacggtacggaccctaccgttgggaacttaacgtccgtaacggtaccggggacccctacggggttacggtaaccgtagttacggtaaacgggtccgttaacggtacccgttaccgttacggtttaccggttaaccggtaccgtaaccggtacggtaaccgtacggttacgggttcggtaccgtacgttaccgggaaggggggttacttaccggggtacgggtaacggtaacccgtaagggttcgtaccggttaccggttcggtaccgaacggtacccggaaggtcccgtccgggtacccccggttcggtaccgtaaccggttcgtttacccggttacccgttaccccgg

SEQ ID NO: 89795 - DNA, 677 bp, Homo sapiens
  misc_feature: GYAE6OF02I8EZI.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggactcacctgctcgtgganattcattgaccaaaagatatacttgttgttccagcagaagtcaggccaggcccctgtactggtcatccagtgacgccagtcgacgacacgtccggactcccgtagagacgtattcctctcgccctccagtctacgagggacaggtcgccctacgttgactagtcgaggtcgggccgtagggtggacgtagtaggaacgtcgtagtaccttaacttagtttacgttaaccgacctaaccgaaggtaacgtaggttacggttacgggtacctaaggttacgggtaacggggggttacgttacggggaacggggtaacggggtaacccgttaacgggttaccggtaaccccggtttaccggttacgggtaccgtaaccgggtaccccgtaaacgggtcccgttacccggtaccccccggttccgggttacccgtacccgttcccggtttacccccggg

SEQ ID NO: 89796 - DNA, 665 bp, Homo sapiens
  misc_feature: GYAE6OF02IRHLO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtcccaggacaacggccaggactcacctgctcgtggatattcattcgaccaaaagatatacttgttgtccagacagagtcacggccacggcccctgtactggtcactccagtgacggccagtcgacgaccacgtccgggtactccgtgagatacttctctcgcctccagtcctacggacgggacacggtccggaccctaccgtttgacttacgtccggtaacgggtccgggggacccgtaaggggtcgggaacggtaacgtacggaacggtcgtacgtaaccttaacgttacgtttacggttacccgacaaccgaaggtacgtaaggttacggtacggtactaggtcgggtaaggggttcgtcggggaccgggtaacggtaaccgtagttaccggtacccggttcgttacgggaccgtacgaaccccggtaaggttcccgtcccggtacccccgttccggtactcccgttccgttccccgg

SEQ ID NO: 89797 - DNA, 635 bp, Homo sapiens
  misc_feature: GYAE6OF02I1VZM.21.8.A08.1.454.CMB.1.raw
  modified_base (169)..(169): a, c, t, g, unknown or other
  misc_feature (169)..(169): n is a, c, g, or t
  modified_base (298)..(298): a, c, t, g, unknown or other
  misc_feature (298)..(298): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagnggtgtccagtgtcaggcgcaactggtggagtctgggggagcatggtccagccgtggggaggtccctgacgcctctcctgtgcagcgtctggattcagtatcggctcttgccatgctacgtggggtcccnccgaggcctccgaggcaaggggctggggagtggggtggcgattagcgtggtatgagtggaagttgagtagatatttatcagtaccgttccggtaggaacgggtccgtacttccaaccctattcctaccgtaaggagtaaccgtaagtcgaaccctaaacaacctactaacctagttactaccttaacgaaacgtccggacccggtacctagggacgtacggacccggtaacggaaccgtacggtacttacgttacgtactttaacggtacggtacggtaacgttcgtttacggttctacgggttcggggacccgtacggggtacccgttggtacccg

SEQ ID NO: 89798 - DNA, 656 bp, Homo sapiens
  misc_feature: GYAE6OF02IP1NK.21.8.A08.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgccaccctcggtgtcagtcgtcccaggacaaacggccaggactcacctgctctggactattcatgaaccaaaagatattacttgttacggttcagcagagtcaggccacggcccctagtactggtcactccagtgacgccagtcgacgactacgtcccgggacttcccgtaggagtagtacgtttcncgtccggtccctaccaggtccctacggacgggactaggcggaccctaccgttgaacttacgtcggaaggtccggggtaccgacgggtcggaacgtacgaggaacgtcgtacgtacttaacgttgtttacggtaccgactaaacgacgaacgtaggttacgtcggtacgaacgtcggggttaaggggttacggttcgggaacggggtacggtaaccgtagggttacggtacccggttcggttccgggtactaccggacccgttaggccgtacccggtccccgtacggtctacccgtcttacccccgg

SEQ ID NO: 89799 - DNA, 513 bp, Homo sapiens
  misc_feature: GYAE6OF02IC0SN.21.8.A08.1.454.CMB.1.raw
  modified_base (217)..(217): a, c, t, g, unknown or other
  misc_feature (217)..(217): n is a, c, g, or t
  modified_base (453)..(453): a, c, t, g, unknown or other
  misc_feature (453)..(453): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggcaggatcacctgctctgganattcattgaccaaaaagatatacttgttggttccagcagaagtcaggccaggcccctgtactggtcatccatgaggccagtcgacgacacgtccgggatcccgtgacgagattctctgcctccagctcgagggacagtcggaccacttgactatcgaggtcggggacccagggtcgacgatgaagctagactactagttgttacgctacagacagtagtgtacagtcgaaggggtntcggaggaggacagtcgaccgtcgttggcagccgaggctcgcccctggtcacctcgtccg

SEQ ID NO: 89800 - DNA, 559 bp, Homo sapiens
  misc_feature: GYAE6OF02IQ8TE.21.8.A08.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctggggggaggcatggtccagcctgggaggtccctgagcctctcctgtgcagcgtctggattcagtatcggctcctttgccatgcactgggtccgccaggctccaggcaaggggctggagtggggtgcgattatntggtatgatggaagtgagagtatattatcgagtactccggtagaacgggccgtacttacacctatccttccaagacgaactaactcgaccaaacaaccaacactagtactcttacaaatcgaccggcctaggacacgccggacggacacggactagtgtattacgtagtacgacgtacgtttgtacgtaggtttcggggaccctacggggtaccctcggtaccg

SEQ ID NO: 89801 - DNA, 532 bp, Homo sapiens
  misc_feature: GYAE6OF02FZI2K.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtgtccccaggacaaacggccaggatcacctgctctgganattcattgaccaaaagatatacttgttggttccagcagaagtcaggccaggcccctgtactggtcatccatgaggccagtcgacgacactccgggatccctgagagattctctgcctccagctcgagggacagtcgccaccttgactatcaggtcgggcccagggtcggacgatagaagctgacttactattgttacgcaccagacagtagtggtcagtacgaggggtatcgggacggagggaccagttcgaccgttccgtggtcgacgcccgaaggtcctccggcccccgttcggtcctaccgtcttcccg

SEQ ID NO: 89802 - DNA, 723 bp, Homo sapiens
  misc_feature: GYAE6OF02J0PQM.21.8.A08.1.454.CMB.1.raw
  modified_base (167)..(167): a, c, t, g, unknown or other
  misc_feature (167)..(167): n is a, c, g, or t
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
tcagtcgtcgctcgcacgaccggtgctcgatttagcatactctacagggggcgtgtgggcgtcaggaggcagagctctgggaatctcaccatggcctggacccctctcctgcctccccctcctcactttcctgcacagtctctgaggcctcctatgagctgaccacngcccaccctcgggtgtcaggttcgtcccccagggaaccaaacgggccaagggtatccgaccctgccttcgtgggatattcattcgaccaaaaagtatatactttgttggttccagcagaagtcaggccgaggcccccttgactggtaccntccatgacggcagtcgacgacctacgtccgggactacccgtgacgagtacttcctntccggccctccgagtcctcggaacgggtactacggtcggacccgtaccgttagaccttagtaccgagggtcgggtaccccgagggtcgggacgtagtacggtaacgtctacggtaaccttaacgtacgtttacggttacgactaaccgacggtaacgtaggttacggtaggttaccgaacggttacgggtaagggggttaccggttacgggaccggggaaggggttaacccgtagggttaccggttacccgggttcccggtttacggggtccaaccggggttaccccgtaagggtcccgttcccgggaccccccgtttcgggtacccgtaccgttcccgtttaaccccgg

SEQ ID NO: 89803 - DNA, 604 bp, Homo sapiens
  misc_feature: GYAE6OF02FGOH1.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcactgtctctgaggcctcctatgagctgacacagccaccctcggtgtcagtgtccccaggacaaacggccaggatcacctgctctggagattcattgaccaaaagaatatacttgttggttccagcagaagtcaggccaggccccctgtactggtcatccatgaggccagtcgacgacacgtccgggatccccgtgagagattcctctcgcctccagcctacgagggacaggtcgggccctacctttgacttatccgaggtcgggggccccagggtcgggaacgagttaggaaacggctagtaaccttacttagtttacggttaacgccaaccagaactagtaggtggtactagtcggtaagggggttacttcgggcgggaacgggaccgtaggttcggacccggttccgttgggtccacggtcccgaagggtccctccggaccccccgttcggtccctaccgttccgttcccgg

SEQ ID NO: 89804 - DNA, 632 bp, Homo sapiens
  misc_feature: GYAE6OF02ILJIH.21.8.A08.1.454.CMB.1.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (338)..(338): a, c, t, g, unknown or other
  misc_feature (338)..(338): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtgtcagtcgtccccaggacaaaccggccaggactcacctgctcngganattcattgaccaaaagatatacttgttgtccagcagagtcaggccaggcccctgtactggtcatccagtgacggccgagtcgacgacaccgtccgggactcccgtgagagacttcnctgtcctccacgctacgacgggacacggtcgaccctacgttcgaacttatcgacgggtcggggcccgtagggtcggacgagtcggaagtccgtagacttacttagtttacgtaccgacaccgaagaccgtaaggtacgttcggtacgacgttacgggtaggggttactccggggacgggtaacgggtacccggtaggttccggtacccggttccggttacggtacctaccggtaccccgaaagggttcccgacccggtcccccgtacgggttcccgtaccgttcccgttccccg

SEQ ID NO: 89805 - DNA, 641 bp, Homo sapiens
  misc_feature: GYAE6OF02FS1WD.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggtcgtgtgggctcaggaggcagagctctgggaatctcaccgatggcctggacccctctcctgctccccctctcactttctgcacagtctctgaggcctcctatgagctgacacacgccaccctcggtgtcagtgtccccaggacaaacggccaggatcacctgctctgganattcattcgaccaaaagatatacttgttggttccagcagtaagttcaggccaggcccctgtactggtcactccgatggacgtccaggtcgacgacacgtccggatcccgtagagtagactttccgctcgcctccagtcctcgagggactaggtggaccctacgttgaacttatcgtaaggtcgggacccacgggtacggacgagtaggaacgctacgtaacttaccgtagtttacgttaccgacctacccgagtaaccgtaggtagttcggtactaagtacggtaagggggttacttccgggacgggtaacgggaccgttacggtacggtacccggtaccggttaggtccgtaacggtacccgtaaagggtcccgttacccggtccccccggttacggtccctaccgtcccgttacccgg

SEQ ID NO: 89806 - DNA, 587 bp, Homo sapiens
  misc_feature: GYAE6OF02GTTFR.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcactgctctgganatcatgaccaaaagatatacttgttgttccagcagagtcaggccacggcccctgtactggtcatcatgacggccgaggtccgacgaccacgtccgggactcccgtagagagactttctcgtcgccctccacgtcctcgaagggacaggtcgacctacgttgactagtcgaggtcgggacccgagggtacggacgagtaggacgtcgtagaacttacgttattcggttacgacctaaccgagacgtagttaggtcgtacgtacgtcggtaaggggttagtcgggacgggtaggaccgtaggttcgtaccggttcggttagtccgaccgtaccgacgtccgtccgtcccgtcggtcctccgtcgttccccg

SEQ ID NO: 89807 - DNA, 553 bp, Homo sapiens
  misc_feature: GYAE6OF02FK18O.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgacggccagtcgacgacacgtccgggatcccgtgagagattctctgcctccagctcgagggacagtcggccctacgttgactatcgaggtcgggcccgagggtggacgagtaggaagcgtagactacttagttcgttacgcaccagacagtagtgtctagtcgtaggggtagttcggacgggacgggaccgtagttcggaccggttcgttaggtccgacggtcccgaacggtctccggcccccgtcggtcctacgtcctcccg

SEQ ID NO: 89808 - DNA, 516 bp, Homo sapiens
  misc_feature: GYAE6OF02FQJZE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttgttccagcagaagtcaggccaggcccctgtacctggtcatccatgaggccagtcgacgacactccgggatccctgagagattctctgcctccagctcagggacagtgccaccttgactatcagtcgggcccaggtggacgagtgaagcgtagacttacgtattgttaccgcaccgagacagtagtggtcagtcgaggggttatcgggcggaggaccgtagtgaccgtcgtggtcacgccgaagctacgccccgtcggtccactcgtcccg

SEQ ID NO: 89809 - DNA, 620 bp, Homo sapiens
  misc_feature: GYAE6OF02IN7CO.21.8.A08.1.454.CMB.1.raw
tcagtcgtcgctcgcacgaccggtgctcgatttagcatactctacaggggctgtgggctcaggaggcagagctctgggaatctcaccatggcctggacccctctcctgcctccccctctcactttctgcacagtctctgaggcctcctatgagctgacacagcccaccctcggtgtcagtcgtccccaggacaaacggccaggatcacctgctctaggatattcattcgaccaaaaagtatatacttgtcggttccagcagaagtcaggccaggcccctgtactggtacatccatgacgccagtcgacgacacgtccggatcccgtgaagagtattcgtctcgccctccaaggtccctcgaacgggtacacggtcggcccctaacgttggaaccttagtcgacggttcggggacccaacgggtgacgtagtcgaagctgacttaactagttcgtacgcaacgacgaatagtacgtggtacacgtacgtagggggttacttacgggacgggtacggaaccggttagttaccgggtaacccgttccggtttacggtccgtaaccggtaccccgaaggtcccgttccgaacccccgttcgggtacctaccgttcttaccccgg

SEQ ID NO: 89810 - DNA, 693 bp, Homo sapiens
  misc_feature: GYAE6OF02IH22D.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggcctcctatgagctgacacagcccaccctcggtgtcagtcgtcccaggacaaacggcaggactcacctgctctggatattcattgaccaaaagatatacttgttcgtccagcagagtcaggccacggcccctagtacgtcggtacacgttccagtcggacggccaggtccgaccgacgacgtccgggactcccgtaggagtagtactttcctcgtcgtacccctcagtcgtacggaaggggacctagggtccggaccctaccgttagaccttatacgagggtccgggacccgtagggtacggacgtagtaggaacgtcgtacgtaacgttacgtttagttacggttaaccgactaaccgaagtaacgtacggttaggtcggttacgaagttacgggtagggggttaacgttcgggaccgggtaacgggtaaccgttaacggttcggtacccggtttccggttacgggtaccgtaaccggtacccggtaacgggtcccgttacccgggtcccccgttaccgggtacctacccggttcccgtttaccccgg

SEQ ID NO: 89811 - DNA, 508 bp, Homo sapiens
  misc_feature: GYAE6OF02I85ZK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaaagaatatacttgttggttccagcagaagtcaggccaggcccctgtactggtcatccatgaggccagtcgacgacactccgggatccctgagagattctctgcctccagctcagggacagtggccaccttgactatcagtgggcccaggtggacgatgaagctgactactattgttacgcaccagacagtagtggtcagtcgagggggtattcggacggagggaccagttgaccggtccttggtcagcccgaaggctcgcccctggtccactctccg

SEQ ID NO: 89812 - DNA, 726 bp, Homo sapiens
  misc_feature: GYAE6OF02HVC85.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattcgaccaaaagatatacttgttgttccagcagaagtcaggccacggcccctgtactggtcatccatggaggccagtcgacgacaccgtccgggatcccgtagagagtattctctcgcctcagctacgagggacaggtcggacctaccgtttagaaccttacgtaccgtacgggtccgggggacccgtaacggggtacgggaaccggtaagtacgggaaacgtccgttaacgtaaccgttaaaccgtttaacgtttacggtttaaccgacccgtaacccgtaacggaaccgtaaggttaacgggttcgggttaccgtaacggttacgggtaacggggggtttacggttaccggggacggggtaacggggtaacccgtaacgggtttacggtaacccggttccggtttaccgggttaccgtaaccggtaccccgtaacgggtcccggttacccggtacccccccggttaccgggtaccccttaccgttcccgtttaccccgg

SEQ ID NO: 89813 - DNA, 662 bp, Homo sapiens
  misc_feature: GYAE6OF02HZ29O.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccacctcggtgtcagtcgtcccaggacaaacggccaggatcacctgctctgganattcattgaccaaaagatatacttgtggttccagcagaagtcaggccacggcccctgtactggtcatccatggaggccagtcgacgacacgtccgggactcccgtagagagacttcgtcctcgccctaccgagtcctacggaacgggtaccaaggttcggaccctaccgttagaaccttacgtcgaggtcggggaccccgtaggtacgggacgagtacgaaggtccgtagtaaccttaagttagttacgtttaaccgacctaaccgaagtacgtaaggtaggttacggtactaagtaccgggtaagggggttacgttacgggacggtaacggggtaaccgtaggtttaccggacccggttccgttaggacccgtacggaccccggtaacggtcccgttacccggtccccccgttaccgggttacctacccgttaccgttccccgg

SEQ ID NO: 89814 - DNA, 560 bp, Homo sapiens
  misc_feature: GYAE6OF02HQJ68.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaaggacaaacggccaggatcactgctctgganattcattgaccaaaagatatacttgttgttccagcagaagtcaggccaggcccctgtactgtcatccatgaggccagtacgacgactacgccgggatccccgtagagagacttctcctgcctccagtctcgagggacaggtcgccaccgttgacttatcaggtcggggcccagggtcggacgagtggaagctagaccttacttattagttaccgcaaccagacagtagtaggtactagtcgaggggttatcggacggagggacctagtcgtaccggtcgttacggcgacgacccgaaggtccgtaccgccccgttacggaccctacgtccttacccgg

SEQ ID NO: 89815 - DNA, 582 bp, Homo sapiens
  misc_feature: GYAE6OF02G14NX.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaaagatatacttgttggttccagcagaagtcaggccacggcccctgtactggtcatccatgaggccagtcgacgacacgtccgggatcccgtgagagattctctcgcctccagcctcgagggacagtcggaccctaccttgactatcgaggtcggggcccgagggtcggacgagtgaagctgactacttattgtacgcacgagactagtagtggtacagtcgaaggggttattcgggacgggagggaaccgtaagttcggacccgttccgttacgggtcgaccggtacccgaacggtcccgtccggacccccgttcggttaccgacccttcgttcccggttccccgtcccccg

SEQ ID NO: 89816 - DNA, 557 bp, Homo sapiens
  misc_feature: GYAE6OF02HMWXL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccaccctcggtgtcagtcgtcccaggacaaacggccaggactcacctgctctggatattcattgaccaaaagatatactgtggttccagtcagaagtcaggccaggcccctgtactgtcatccatgaggcagtcgacacactccgggatccctgagagattctctgcctccgagctacgagggacagtcgcctacttgactagtcgaggtcgggcctagggtcggacgagtacgaagcgtagaacttacttagttcgttaacgctaccagtacgaggtacgtggtcagtcgaggggttacgttcggacgggacgggaccaggttcgaccgttccggttggtcgacgtacccgaaggtcctccgccccgtcggtacctaccgtaccgttcccgg

SEQ ID NO: 89817 - DNA, 542 bp, Homo sapiens
  misc_feature: GYAE6OF02IN2DI.21.8.A08.1.454.CMB.1.raw
  modified_base (219)..(219): a, c, t, g, unknown or other
  misc_feature (219)..(219): n is a, c, g, or t
  modified_base (324)..(324): a, c, t, g, unknown or other
  misc_feature (324)..(324): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctggggcctcctatgagctgacacagccaccctcggtgtcagtgtccccaggacaaacggccaggatcacctgctctggagnttcattgaccaaaagatatacttgttggttccagcagaagtcaggccaggcccctgtactggtcatccatgaggccagtcgacgacacgtccgggatccctgagngattctctgcctcagctacgaggacagtcggccacttgactatcgagtcgggccagggtggacgatgaagctgactacttattgtacgcacagacagtagtgtcagtcggaggggtgttcgggacggtagggacctaggttcggaccgttccgtcggtccgacgtcccgaaggtcctaccggcccccgttacggtccctaccgttcctccgttccccc

SEQ ID NO: 89818 - DNA, 524 bp, Homo sapiens
  misc_feature: GYAE6OF02FGOXC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacctccgggactcccgtgagagtattctctcgcctccagctcgagggacagtcggcccacgttgactatcaggtcgggccagggtggacgagtgaagctgactactattcgtacgcaccagacagtagtgtacagtcgaggggtacttcgggcggacgggacctagttcgaccgttcgtggtcacgccgaggcctcgccccgtcggtcacgtctcccg

SEQ ID NO: 89819 - DNA, 774 bp, Homo sapiens
  misc_feature: GYAE6OF02JQ3OQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggactccaccgtgcctgtggagtattcagttcgaccaaaagattattacttggtttcggttaccagacgaagtaacgtcgacggaccgacggtccccctaggtaccgtggtaccactccgagtcggacggcctacgtccgaaccgtaccgtaccgtccgggactcccgtagacgacgtactttcctcgtcgtccctccgacgtcgtaccggtaacggacgtacggttcccgacccgtaaccgtttacggaccgttacgtaccggaacggggttcccggggtaccccggtaagggtcggtaacggtagtacggaaccgtccgtagtaaccgttacgtttaacgttacggttaccgtacccgaacgtaaccggaaccgttaaggttacgttacgggtaccctaaggttccgggttaacgggggtacggtttcccggggaaccgggttaaccgggtaccgtacggtttcccggtaacccgtttcccggttaacggacccggtaaccgtcccggtaaaccgttcccggtacccgtcccccggttacggtcccgttaccgttccgttaccccccg

SEQ ID NO: 89820 - DNA, 686 bp, Homo sapiens
  misc_feature: GYAE6OF02G2A1I.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttggttcaagcagaagtcaggccaggcccctgtacgtggtcatccatgacggccaggtcgacgacaccgtccgggatcccgtagagtagtattcgtctcgcccttccagtctcgacgggacaggtcgcctaccttggaactacgtacgacggtcggggaccctaggggtcggaacgtagtacggaagtccgtacggtaaccttacgttagtttaccggttacgacccgaccgtaaggaaccgttaagggttacggttacggtaccgtaaggttaccgggtaaggggggtttaacgttaccgggggaacggggtacgggtaaccggttaagggttccgggtaacccggttcccggtttacggtaccggtaccggacccggtaacgggtcccgttacccggacccccgtttaccgggtaccctaccggttcccgttccccgg

SEQ ID NO: 89821 - DNA, 693 bp, Homo sapiens
  misc_feature: GYAE6OF02HD4UM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggacaaacggccaggactcacctgcctcgtggatattcattcgaccaaaagatatacttgttgttccagcagaagtcaggccaggcccctgtactggtcactccagtgacggccaggtcgacgactacgtccgggatcccgtagagacgtacttctactcgccctcgagctcgagggacagtcgacctacgttgacttatcgaggtcgggaccgtagggtcggacgtagtaggaacgcgtagtaaccgttacgttaacgtttacggttaaccgacgtaacccgaaggaaccgttaagggttacggttcgggttacgtaagttaccgggtaaggggggtttacgttacggggaacggggtaacggggtaaccgttaacgggttccggttaaccccggttccgggtttacggtaacccggtaaccgggtaaccccgtaagggtccccgttcccgggtaccccccgttaccggggttaccctacccggttccctttaccccccgg

SEQ ID NO: 89822 - DNA, 605 bp, Homo sapiens
  misc_feature: GYAE6OF02IIUAC.21.8.A08.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctggtgtcagtgtccccaggacaaacggccaggatcacctgctctggagattcattgaccaaaagatatacttgttggttccagcagaagtcaggccaggcccctgtactggtcatccatggacggccagtcgacgacacgtccgggatccccgtgagtagatttctctgccctccagcctcgagggacnggtcggcctaccttgaactatacgaggtcgggccagggtggacgatcggaagtccgtagtacttagttagttgttaccgcaccagacgtaggtagttggtactacgtacggtaaggggttacgttacgggacgggacgggtaccgtaggttcggtacccggttccgttacggtccgtaaccgtaccccggtaagggtcccgttaccggtaccccccggtcgggttacccaccgttccgttaccccgg

SEQ ID NO: 89823 - DNA, 580 bp, Homo sapiens
  misc_feature: GYAE6OF02G2N60.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaaggaccaaacggccaggactccacctgctcgtggagattcattgaccaaaagatatacttgttgttcagcagagtcaggccacggcccctgtactggtcatccatgacgccagtcggacgacaccgtccggggactcccgtgagagtacttctctcgtccctccagctacggagggacgaggtcgccctaccgttgacctagtcgtacgggtcgggacccgagggtacggacgtagtaggacgcgtacgacttacgttagttcgtaacgcgtaacagcagtagtcgtctagtaggagggttacgtcgggcggaacggacgtaggtcgtaccgtcgttcggtacgacggaccgacggtccgccgtccccgtcggtcctaccgtcgttcccg

SEQ ID NO: 89824 - DNA, 638 bp, Homo sapiens
  misc_feature: GYAE6OF02IJAQ6.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctcggtntcagtcgtcccaggacaaacggcaggatcacctgctctggatattcattcgaaccaaaaagattactactttgttacggttccagcaagaagtcacggccacggcccctgtctggtcactccagtgacggccagtcgacgacaccgtccggactcccctggagagtacttctccgttcgtccctccgagtccttacggaacgggactacggtccgaccctaaccgtttacgaaccttagtacgacgggttccgggaccggtagggtacggacggtaacgtaggaacgtcgtacgtaacgttactagttacgttacgtacgaaccacgaacgtaggtacggttggtacctaggtcggtaaggggtcgttacgggacgggtacgggaaccgtagtacggtaccgtcgttggacgaccgtaccgacggccgtccgccccgttacggtcctcgtcccgttaccg

SEQ ID NO: 89825 - DNA, 533 bp, Homo sapiens
  misc_feature: GYAE6OF02F6H6D.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtcggtgtcagtcgtccccaggacaaacggccaggatcacctgctctgganattcattgaccaaaagatatacttgttggtccagcagaatcaggccaggcccctgtactggtcatccatgaggccagtcgaacgacacgtccgggatcccctggacgagtatttaccgtcgtcgccctccgaagctacgaagggaccaggtcggccctacgttgaactatcgaggtcgggcccagggtggaacgagtaggaagcgtagaacttacgtattgtacgcacagactagtagtgtacagtcggagggtagtcggcggaggacagtcgaccgtctgcacgccgagctcgcccgtcgtcacgtctccg

SEQ ID NO: 89826 - DNA, 706 bp, Homo sapiens
  misc_feature: GYAE6OF02J1WVN.21.8.A08.1.454.CMB.1.raw
  modified_base (305)..(305): a, c, t, g, unknown or other
  misc_feature (305)..(305): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgcttcttttaagaggtgtccagtgtcaggcgcaactggtggagtcgtgggggaggcatggtccagcctgggaggtccctgacgcctctccgtgtcgcagcgtctggattcagtatcggcttcctttgccatcgctacgtcggggtcccnccgaggcctccgagggcgaacggggcttggggacgttgggggtcggcgtagttaagtcgttggtatcggaagtcgggaagtggaaggtagtaattagtttacttacgagtaaccgtcggtaaggaaccgggggtccgtactaccgtaacctactcctaccgagtaacgaactaacgtacgaacccaaagtaaccacctacttgttaacttaccgttaacaagttaccgacccggtacttacggaacgtaccggaccgaacggtaaccgacgtacgttactaggtttaaccgtacggttaacggttacggtaacggtttcccggttttagggttaacccggttagggtttacccgggggaaccccggttaccgggggtaccccgtttaccggggtaacccgg

SEQ ID NO: 89827 - DNA, 633 bp, Homo sapiens
  misc_feature: GYAE6OF02IEN8G.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagcccaccctcggtgtcagtcgtcccaggacaaacggccaggatcacctgctcgtggatattcattcgaccaaaagatatacttgttggtccagcagaagtcaggccacggcccctgtactggtcactccagtggacggccaggtccgacgactaccgtccgggactcccgtaggagagtacttctctcgccctcacgtctacgaagggctacggtcggccctacgttcgactactcgacggtccggggccctagggtacggacgtagtacggaacgtcgttacgaacctttaacttagtttacgttaccgacctaaccgaagtacgtaggtaggtggtaccgtagtacgggtaagggggttacgtcggggacgggtacgggacctaagggttccggtaccgtccggtttaggaccgacggtacccgaaggtccgtaccggtcccccgtcggtccctaccgttcgttccccgg

SEQ ID NO: 89828 - DNA, 885 bp, Homo sapiens
  misc_feature: GYAE6OF02HYNN7.21.8.A08.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagcatactctacaggggcgtggtgggcgtcgaggaggcgaggaggctcgtgggaatcgtcaccatggcctcggacccctctcctgcctcccctcctccactttctgctacagtctctgaggccctctatgacgctgacacagccctaccctcggtgtccagtcgtacccgacggtaacgaaaacggccaagggatacctacctgctcgtagagtnttactacttaggaccaaaaaagattaacgtacttttggttcggttacccagtacgaaggtaacgttacaggaccccgaggacccccttggtaaccgtggtaccgactaccagtacgacggaccgtagtacccggacaacgtaccgtcccgggtatccccgttaggaacgggacttacgtttacaccgttcgtaccgtaccgacgtccgtagaaccggggtcgtaagtccgggacccttaccgttggtaaccccttaagtttcgacgggttaccggggcccgaagggtcgggtaaacggtagacgggaaacggtcgttacggtaaaccttaacccggtttaagttttaacccggtaaacggttacccgaacccgttaaaacgggaaccgttaaaacgggtaaaccgggttgggtttaccgaaaacgttcccggggtaaaaggggggggttttaccggtaacgggtttaaccccgggggaaagggggtacccggtaaaacgggtttcccggttaacccggggttcccgtttaaggggtttaccaaccccggggtaaaccccggtacgggttaaccggttaccccccggccccccggttttaaaccggggttcccaccggtttaaccccggtttccccgg

SEQ ID NO: 89829 - DNA, 649 bp, Homo sapiens
  misc_feature: GYAE6OF02JALEH.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtcccaggacaacggccaggactcactgctcgtggagnttcattcgaccaaaagatatacttagttgtccagcagaagtcaggccaggcccctgtactggtcatccagtgacgccaggtacgacgacacgtccggactcccgtaggacgtagtacttccgtactcgcctcacgtcgtacggaggactaggtcgaccctaacgttcgaacttacgtccggtagggtccggggaccccgtaaggggtacgaacgtaagtaggtaaacgctacgtaacgttaactttacgttacgtaccgtacaaccgaaggactaagggttacgtggttaccacgttaccgggaggggttactcgggaaccggaggtaaccgtaggttacgaacccggtttcgtacggtacaacccgggtacgtaacggtccgtacccggttcccccgtacgggtaccctacccgtccgttaccccg

SEQ ID NO: 89830 - DNA, 635 bp, Homo sapiens
  misc_feature: GYAE6OF02FRW5Z.21.8.A08.1.454.CMB.1.raw
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
tcagtcgtcgctcgcacgaccggtgctcgatttagcatactctacagggggctgtgggctcaggaggcagagctctgggaatctcaccatggcctggacccctctcctgctcccctcctcacttctgcacagtctctgaggcctcctatgagctgacacagcccaccctcggtgtcagtcgtccccaggacaaacggccaggatcacctgctctggagattcattgaccaaaagaatatacttgttggtccagcagaagtcaggccaggcccctggtactggtcatccatggacggccaggtcgacgacncgtccgggatcccgtgganagtattcctcgtgccctccagcctcggaagggacaggtcgaccctacgttgactagtcgagggtcgggcccgagggtcgggacgaggtacggaacgtcgagtaacttaacgtatttacggttaaccgacctaaccgaacggtaacgtaaggttacggttcggtacgtaagtacgggtaagggggttagttccgggacggggacgggtaccggtcggtacggtacccggtacggttacggaccgtaccggacccgtaaggtacccgtcccggtacccccggtcgggtccctaccgtcccgttcccgg

SEQ ID NO: 89831 - DNA, 610 bp, Homo sapiens
  misc_feature: GYAE6OF02HRBNG.21.8.A08.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtntcagtcgtccccaggacaaacggccaggatcactgctctggatattcattcgaccaaaagatatacttgttggttccagcaagaagtcaggccaggcccctgtactggtcatccatgacggccagtccgacgacactccgggatcccctgaagagtattctctcgcctccgagtccgtcacgggcagtcggccctaccttgaactatcgagggttcgggcccgtaagggtggaacgagtacgacgcgttagactacttagttcggttaccgacaccgagacgtaggttacgtggtactagtacggtaagggggttgttaccgggacgggtacgggaaccgtacggtttgtacccggttcgtttcgggacctacgtaccccggaaggtccgtacccggcccccgttgggtaccctaccgttccgtttaccccgg

SEQ ID NO: 89832 - DNA, 529 bp, Homo sapiens
  misc_feature: GYAE6OF02I013L.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaaagatatacttgttgttccagcagaagtcaggccaggcccctgtactggtcatccatggaggccagtcgacgacacgtccgggatccctgagagattctctcgcctccagctcgagggacagtcgccacttgactatcgagtcgggccagggtgacgagtgaagctagactatagttgtacgcaccagacagtagtgtacagtcgaggggttatcgggcggaacgggacgtagttcggaccgttcgttggtacgacgtaccgaaggcctcggtcccctggtacctacgtccttcccg

SEQ ID NO: 89833 - DNA, 606 bp, Homo sapiens
  misc_feature: GYAE6OF02IZINU.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagaatatacttgttggttccagcagaagtcaggccacggcccctgtactggtcatccatgagccagtcgacgacacgtccgggatccctgagagattctctcgcctccagctcgagggacaggtcggccaccgttcgactacgtcgacggtcggggcccgagggtcggacgagtaggaacgcgtacgtacttacgttagttccgttacgccaccgagactagtacgtggtactagtcgggtaggggttagttccggggacgggtacgggtaccgtaggttaccgtacccggttccgttcggtaccgtaccggacccgtaacggtccgttaccggtccccccggttacggtaccctacccgttccgttccccgg

SEQ ID NO: 89834 - DNA, 568 bp, Homo sapiens
  misc_feature: GYAE6OF02JCGY2.21.8.A08.1.454.CMB.1.raw
  modified_base (299)..(299): a, c, t, g, unknown or other
  misc_feature (299)..(299): n is a, c, g, or t
  modified_base (465)..(465): a, c, t, g, unknown or other
  misc_feature (465)..(465): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtttccagtgtcaggcgcaactggtggagtcgtgggggaggcatggtccagcctgggacggtccctgacgcctctcctgtgcagcgtctggattcgagtatcggcttcctttgccatgcacgtgggtccnccgaggcctccgaggcgaaggggctgggaggtgggtggcgatttagtcgtggtatgatgggaagtgagagtattattattcaagtactccggtaggaagggccgtattccacctatcctccagacgacaatcgaccaacaacacactgtatctacaagtgaccgcngagacgaccgagacgacgctagtcgttattacgtcggttacgagttcgtttggtacgtacggttcggggacccgacgggtaaccccgttggtaccgtacccgg

SEQ ID NO: 89835 - DNA, 579 bp, Homo sapiens
  misc_feature: GYAE6OF02FTFKX.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagaatatacttgttgtccagcagaagtcaggccaggcccctgtactggtcatccatgacggccaggtcgacgacacgtccggggatcccgtagagagtatttctcgtcgccctccgagcctcgagggacaggtcgaccctaccgttgaacttatcgaggtcggggcccgagggtaggacgagtaggaagtctagaccttactattggttacgcaccagacgagtaggtgtacagtacggtaggggtacttcgggcggaacgggtaccgtaggttcgaccggttcgttaggtaccgtacgacccgaaggtccgttccggcccccgttcgggtcccacgttcctcccgg

SEQ ID NO: 89836 - DNA, 651 bp, Homo sapiens
  misc_feature: GYAE6OF02G941X.21.8.A08.1.454.CMB.1.raw
  modified_base (218)..(218): a, c, t, g, unknown or other
  misc_feature (218)..(218): n is a, c, g, or t
  modified_base (323)..(323): a, c, t, g, unknown or other
  misc_feature (323)..(323): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttgttccagcagaagtcaggccaggcccctgactggtcatccatgagccagtcgacgacacgtcggatcccgtgagtagnttctctcgcctccagtcctacgagggacaggtcggaccctaccgttgaccttagtcgacggtcgggacccgtagggtacggacgtagtacggaacgtcgtagtaaccgttacgttaagttacgttaacgaccaaccgtaacggtacgtaagttacggtcggtacgtacggtacggtaagggggttacgttaccgggaagggtaacggggtaccgtaagggttccggtaacccggttccggttacgggtaccgaacggtaccccggtaaacgggtcccgtaccgggtccccccggttacgggtacccgtaccgttcccggttaccccgg

SEQ ID NO: 89837 - DNA, 664 bp, Homo sapiens
  misc_feature: GYAE6OF02HG22N.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggaacaaacggccaggatcacctgctctggagattcattgaccaaaagatatacttgttggttacaagcaagaagtcaggccaggcccctgtactggtcatccagtgaggccagtcgacgaccacgtccgggactccccgagacgtacttcctctcgccctcgacgctcgagggacgacggtcggaccctaccgttcgaccttacgtacggacgggtcggggacccgtaggggtacgggaacgtagtacggaaacgtccgtagaaccttaacttagtttacgttaccgacctaaccgagaaccgtagttaggtacggtcgtacgtacgggtaagggggttacgttacggggacgggtaacgggtaccgtaacggttcggtacccgttcggttcgggtaccgtaccggacccgtaacggtcccgtcccggtaccccggttccggtaccctaccgttccgttacccgttaccccccg

SEQ ID NO: 89838 - DNA, 547 bp, Homo sapiens
  misc_feature: GYAE6OF02JHN5F.21.8.A08.1.454.CMB.1.raw
  modified_base (218)..(218): a, c, t, g, unknown or other
  misc_feature (218)..(218): n is a, c, g, or t
  modified_base (422)..(422): a, c, t, g, unknown or other
  misc_feature (422)..(422): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttgttccagcagagtcaggccaggccctgtactggtcatccatgagccagtcgacgcactccgggatccctgagagattctcgtcgcctccagctcgagggacaggtggccaccttgacttatcgaggtcgggcccagggtcggacgagtggaaagctagacttacgtattagttaccncgaccagacagtagtggtacagtcgtaggggtacgttcgggacgggagggacctagttcggaccgttcgttggtacgagtacccgaaggtccgtcggcccccgtcggtcctaccgtcgtacccgg

SEQ ID NO: 89839 - DNA, 736 bp, Homo sapiens
  misc_feature: GYAE6OF02FGLAA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctctggagattcattgaccaaaagatatacttgttggttccagcagaagtcaggccaggcccctgtactggtcatccatgacgccagtcgacgacacgtccgggactcccgtagagacgtattcctacgtcgtcccttaccgagtccttacgaacggggactagggttacggaccctaacccgtttcggaaccttacgtccgtaacgggtcgggggaccccgtaaggggttacgggaaccggtagtacggtaaacggtccgtagggtaaccttaacgttacgttttacggtttaacccggaccgtaaccgtaacggtaaccgtaagggttacgggttacgggtacctaacggttaccgggttaagggggggttaactttaccgggggacggggtaacggggtaacccgtaacgggttacgggtacccggtttaccggttcgggtacccgaacggtaccccgtaaagggtcccgttcccggtaccccccggttcgggtacccgtacccgttccgttacccccggg

SEQ ID NO: 89840 - DNA, 577 bp, Homo sapiens
  misc_feature: GYAE6OF02HAUR4.21.8.A08.1.454.CMB.1.raw
  modified_base (218)..(218): a, c, t, g, unknown or other
  misc_feature (218)..(218): n is a, c, g, or t
  modified_base (481)..(481): a, c, t, g, unknown or other
  misc_feature (481)..(481): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatcccgtgacgagtattctctcgcctccagcctcgacgggacaggtcggaccctaccgttgacttatcgacggtcggggcccgagggtcggaacgagtaggaagtcgtagtaacttacgttagtttcgttaccgcaccagacagtagtgtactagtcgagggggttnttcgggacggacgggaccgaggttcggaccggttcgttggtacgacgacccgtaaggccgttccggcccccgttcggtcctaccgtcgttaccccg

SEQ ID NO: 89841 - DNA, 716 bp, Homo sapiens
  misc_feature: GYAE6OF02G0SX5.21.8.A08.1.454.CMB.1.raw
  modified_base (357)..(357): a, c, t, g, unknown or other
  misc_feature (357)..(357): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttggttcaagcagaagtcaggccaggcccctgtactggtcatccatggacgccagtcgacgcacgtccgggatcccgtgagagtacttctctcgcctccgagctcgagggacngtcggcctaccgttgacttactcgtacgggtcggggacccgtaggggtacggaacgtagtacggaaggtctacggtaaccttaacgtttacgtttacggtttaaccgacctaaaccgtaacggaaccgtaagggttacgggttcggtaccgtaacggttacgggttaacgggggggtttaacggttccgggggaaccggggtaaccgggggtaacccggttaagggtttaccgggttaaccccgggtttcccggtttacgggttaccgtaaccgggtaacccccggtaaagggtcccggttaccccggttccccccggttaccggggttacccctacccggtttcccgtttacccccgg

SEQ ID NO: 89842 - DNA, 669 bp, Homo sapiens
  misc_feature: GYAE6OF02F7K7P.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttgtccagcagaagtcaggccaggcccctgtactggtcatccatgacggccaggtccgacgacacgtcggacgtcctcgagagtattactctcgtccgtccctacgcgtctacgggacgtacgtcggtccgtacctacgtacgtactacgtacggtacgggtcccgggacggtagggtacggagtacgtaacggacgtacgtaacgttaacctttaacgttacgttaaccgtaccgaaccaacgaacgtaacgtagggttcgtacgtacgtacggtacggggttaagggttacgggtacggggaacggggtaacgggtaacgttacggttaccggtacccggttacggttccggaccgtacccgggaaccgtaccggttcccgtacccccggtaccccggtccggttaccctcccggtttcccgg

SEQ ID NO: 89843 - DNA, 538 bp, Homo sapiens
  misc_feature: GYAE6OF02HS3RB.21.8.A08.1.454.CMB.1.raw
  modified_base (220)..(220): a, c, t, g, unknown or other
  misc_feature (220)..(220): n is a, c, g, or t
  modified_base (462)..(462): a, c, t, g, unknown or other
  misc_feature (462)..(462): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatcccagagagattctctcgccctccagctcgagggacaggtcggcctaccgttgacctatcgaggtcggggaccccagggtcggacgagtagaagcgtagacttactattgtacgcacagacagtagtggtcagtcggaggggtntcggaggtagggacctagttcgaccgttcgttggcacgtcccgaggtcctccggcccctcggtcctacgtctcccg

SEQ ID NO: 89844 - DNA, 544 bp, Homo sapiens
  misc_feature: GYAE6OF02HRR8G.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgccctccagctcgagggacaggtcggccctaccgttgacttatcgaggtcggggcccgagggtcggacgagtagaagcgtagacttacgttattacgttacgcaccagacagtagtggtcagtcgtaggggttgttcggacggacgggaccgtagttcgaccggtccgttggtcgacggcccgaggctcgccccgtcggtctccgtctccg

SEQ ID NO: 89845 - DNA, 818 bp, Homo sapiens
  misc_feature: GYAE6OF02G7AIC.21.8.A08.1.454.CMB.1.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcactgctctgganattcattgacctaaaaaattnttgtttttaggaccagacagaagtcaggccacggcccctgtgttggtcatccatggaggacaggacgaccgacccgtccgggactcccgtagacgagtacttcgtcgtcggtcctaccgaaacgtccggaacggggtaccgggtcgggacccgtacggtttacgtacgtttccgtcggagggttccgggggtacccggtaggggtcggggtaacgggtagtaacgggaaacgtcggttacgtaaccgtttaaccgttacgtttacggtttaacctacggtaacggtaccgaacggtaaccgaacgtaccggtaacgggttacggtaaccgttaacggtaccggggacggggggtaccgtaacggggtttccggggaaccggggggtaaaccgggtaacccgggttaacggggtttacccggtacccgggtttacccgttaaccgggggttacccggaacccggtaaccccgggaaccgggttaccccgtacccccgggtacccccccgtttacccgggttacccgttaccccggtttaccccggtttccccgggtttacccccccgttcccccccgg

SEQ ID NO: 89846 - DNA, 620 bp, Homo sapiens
  misc_feature: GYAE6OF02HP333.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagccaccctcggtgtcagtcgtccccaggacaaacggccaggatcacctgctctggagtattcattcgaccaaaaagatatacttgttggttccagcagaagtcaggccaggcccctgtactggtcatccatgaggccagtcgacgacaccgtccgggatcccgtgagagattctctcgcctccagtctcgacgggactaggtcgccctaccgttgaaccttacgtcgacgggtcgggggaccccgtagggtcgggaacgtagtaggaacgtcgtaggaaccttaacttagtttacggtttaaccgacctaaccaggacgtaggtaggtggtcagtcggtagggggttactcggggacggtacgggaccgtaggttcggtacccggttcgttcgggtacctacggacccgaaggtccgtccggcccccgttcgggtccctaccgttccttaccccgg

SEQ ID NO: 89847 - DNA, 587 bp, Homo sapiens
  misc_feature: GYAE6OF02GI9H7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgacgagatttctctcgcctccacgctcgagggacaggtcggccctaccgttgactatcgagggtcggggacccgagggtcggaacgagtagaagtcgtagacttactatttcgttacgacaccagactaaggtagtggtacagtcggagggggttagttcgggagggacgggaccgtaggttacggtacccggttccggttcggtaccgacggtacccgaaggtcctaccggtcccccgttcgggtacctaccgttccgttccccg

SEQ ID NO: 89848 - DNA, 592 bp, Homo sapiens
  misc_feature: GYAE6OF02HOJK8.21.8.A08.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagcatactctacagggggtgggctcaggaggcagagctctgggaatctcaccatggcctggacccctctcctgctcccctcctcactttctgcacagtctctgaggcctcctatgagctgacacagccaccctcggtgtcagtcgtcccaggacaaacggccaggatcacctgctctgganattcattgaccaaaaagaatatacttgttggttcaagcagaagtcaggccaggcccctgtactggtcatccatgaggccagtcgacgacacgtccgggatccctgacgagtattcctcgtcgccctccgagcctcgaagggacaggtcggaccctaactttggaccttaatccgaggtcggggacccgagggtacggacgagtagaagcgtagactacgtattagttacgctaaccgagacgaggttagtggtacgagtacgtaggggtacgttcgggcgggaaggaccgtaaggttacgtaccgtacgttcggtcgacgacccgaacggtccgtccgtaccccgtcggtcctacgttccgtccgttccccgtccccg

SEQ ID NO: 89849 - DNA, 562 bp, Homo sapiens
  misc_feature: GYAE6OF02I4EIP.21.8.A08.1.454.CMB.1.raw
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttgttccagcagaagtcaggccaggcccctgtactggtcatccatggaggccaggtcgacgacacgtccgggatcccgtgagagatttcnctcgccctccagctcgaggacngtcggccacttgactatcgaggtcgggcccagggtggacgagtgaagctagtacttatattcgtaccgcgaccacgacagtacgtgtcgataggtacggggtaaggtcggtgggaacgggtacgacgtacggtaccgtccggttcggtacggtacgtaccggaacgtccgtccgtcccccgtccggtccgtaccgtccgttcccg

SEQ ID NO: 89850 - DNA, 591 bp, Homo sapiens
  misc_feature: GYAE6OF02JHCOI.21.8.A08.1.454.CMB.1.raw
  modified_base (174)..(174): a, c, t, g, unknown or other
  misc_feature (174)..(174): n is a, c, g, or t
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
tcagtcgtcgctcgcacgaccggtgctcgatttagcatactctacagggggggggagaggagcccagcactagaagtcggcggtgtttccattcggtgatcagcactgaacacagaggactcaccatggagtttgggctgagctgggttttcctccttgctcttttaagaggtntccagtgtcaggcgcaactggtggagtcgtgggggagcagtggtccagcctgggagtccctgacgcctctcctgtgcagcgtctggattcagtntcggctcttgccatgcacgtgggtcccncgaggcctccgaggcaagggggctgggaggtggggtggacgtatttagtcgtaggtatggagtaggaagtggaagagattagttatcaagccgtacggtagaacgggcctattcactatcctacgagtacgactacgtacgaccaacaacaccatacgtactacttacaagtcgacccgcgtagacgacgaccggacgaaccgtacggactagtacgttaagtaccgtaggtaacgtagttcgttcggtacgtaggttaccggggaccgtaacgggtacccggtggttaccccgg

SEQ ID NO: 89851 - DNA, 537 bp, Homo sapiens
  misc_feature: GYAE6OF02HKFF1.21.8.A08.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgtggttccagcagagtcaggccaggcccctgtactggtcatccatgaggccagtcgacgacacgtccgggatcccgngagagattctctcgcctccagctacgagggacaggtcggaccaccgtttgacttagtcgaggtcggggcccagggtcggacgagtgaagctggacttatattcgtacgccaccgagacaggtagtgtacagtcgagggggttatcgggaggacgggacaggttcgaccggtcgttggtcgacgcccgaggcgtccgccccgtggcctacgtcgtccg

SEQ ID NO: 89852 - DNA, 674 bp, Homo sapiens
  misc_feature: GYAE6OF02JSPCN.21.8.A08.1.454.CMB.1.raw
  modified_base (243)..(243): a, c, t, g, unknown or other
  misc_feature (243)..(243): n is a, c, g, or t
  modified_base (337)..(337): a, c, t, g, unknown or other
  misc_feature (337)..(337): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (547)..(547): a, c, t, g, unknown or other
  misc_feature (547)..(547): n is a, c, g, or t
  modified_base (579)..(579): a, c, t, g, unknown or other
  misc_feature (579)..(579): n is a, c, g, or t
tcagtcgtcgctcgcacgaccggtgctcgatttagcatactctacaggggcgtggtgggcgtcgaggaggcgagagcgtctgggaagtctcaccatggcctcggacccctctcctcgcctccccctcctccactttcctgtcacagtctctgacggcctcctagtgacgtctgaccacacgcccaccctcggtgtcacgtcgtcccacggaccaaacggccgaggactcacctgctctggganattacagttacgaaccaaaaaggtaactacgttaactttggttacggttccaagcaacgtaagtcgaacggccacggcccctagtactacggtnacgtccatgacgcccaggtaccacggaactcggtaccggntacccgtggaacggtctattcctcncgtcaccctacgngtaccggaaggtacncgggtcggacccctaggttcgagtactcgacgggtcggacccggtgggacgacggaatcgggaagtctagtacctacggtttactggtaaccgtcaaccgagaactggtagtacggngtacggacggttagggtcgtacgggtacgggnggaaacccgttgggttcggaacccgttcgggttacctagggacccgtacgtacggccgtaccgtccccggttccgaccgttacgcccgttaaccg

SEQ ID NO: 89853 - DNA, 662 bp, Homo sapiens
  misc_feature: GYAE6OF02F52SS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctggtgtcagtcgtccccaggaccaaacggccaggatcacctgctcgtggagtattcattgaccaaaagatatacttgttgtccagcagaagtcaggccaggcccctgtacgtggtcatccagtgacggccagtccgacgaccaccgtccgggactcccgtaggacgacgtacttccgtctcggtccctaccgagtccgtacgagggacaggtcggccctaccgttgaacctagtacgagggttccggggacccgtaggggtcggaacgtacgtaggacggtcctacgacgttactagtttaccgttaacgccaaccgagtacgtaggtacggttcggtactaaggtcgggaacgggggttcgtacgggtacggggaacggtaccgtagggttccggacccggtttcggttacgggtaccgaccggtacccgtaagggtcccgtacccggtccccccgttacgggtacccttacccgtccgtttcccccgg

SEQ ID NO: 89854 - DNA, 615 bp, Homo sapiens
  misc_feature: GYAE6OF02IAATG.21.8.A08.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccctcctatgagctgacacacgccaccctcggtgtcagtcgtccccaggaccaaacggccaggatcacctgctcgtgganattcattgaccaaaaagatatacttgttggttccagcagagtcaggccacggccctgtactggtcatccagtgagccagtcgacgcacgtccgggatcccgtgagagattccgtctcgccctccagtcctcgaacgggtacaggtcggcccctacgttcgaaccttagtcgacggttcggggaccccgtagggtcggaacggtagtacggaagtccgtagtaaccttacttagttacgtacgtcaccgagacgtagtaggtgtacgagtacggtaggggttacgtcgggacgggtagggacgtaggttacggaccggtttccgttcggtaccgacggtacccgaacggtccgtaccggccccccgttcggtcctacccgttcttaccccgg

SEQ ID NO: 89855 - DNA, 647 bp, Homo sapiens
  misc_feature: GYAE6OF02GPC77.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccgaggacaaacggccaggatcacctgctcgtggatattcagttgaccaaaaagatatacttgttgttccagcagaagtcaggccaggcccctgtacgtggtcatccagtgacggccagtcgacgacacgtccggactcccgtagagagtacttctctcgcctccgagtcctacgagggacaggtccgacctaccgttagactacgcgagggtcgggcccgaggtcggacgtagagaacgtcgtagaccgttagtagtttacgttaccgactaaccgaacgtaacgtacggtaggttacggtctacggttacggtaaggggggttacgttaccggggacgggtacggggtaacctagggttccggtaacccggttccggtttacgggtaccgtaccgacccggtaagggcccgttacccggtaccccccggttaggtacccgtaccgttccgttacccccg

SEQ ID NO: 89856 - DNA, 560 bp, Homo sapiens
  misc_feature: GYAE6OF02IWLXA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttgttcagcagaagtcaggccaggcccctgtactggtcatccatgaggccaggtcgacgacacgtccgggatcccgtgagagattctctgccctaccgagcctcgaggacaggtcggcctacttcgactatcgacggtcgggcccgagggtcggacgatggaacgtcgtacgacttactagtttcgtaccgcaaccagacgagttagtggtctagtcggtagggggtatcgggaggtacgggaccgaggttcgaccggttcgttcggctacgcccgaaggtcctcccggccccgttcggacctactccgttacccg

SEQ ID NO: 89857 - DNA, 678 bp, Homo sapiens
  misc_feature: GYAE6OF02GGYHF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtcggtgtcagtcgtccccaggacaaacggccaggatcacctgctctggatattcattgaccaaaaagtaatatacttgttggttccagcagaagtcaggccacggcccctgtacgtggtcatccagtggacggccaggtccgacgaccacgtccgggactccgtaggagagtacttcgctcgcctaccagtcgtacgaacgggacaggtcggcctaaccgttcgaaaccgttcgtacgtaggtccggggacccgtagggtacgggtacgtagtacggaagtccgtagtaaccttaactacgtttacgttaccaccgtaacctaaggtaacgtaaggttacggttcggtacctaggtacgggttaaggggttacgtacgggacgggtaacggggtaaccgtaacgggttacggtacccggtttcggttacggttaccgtaaccggtacccgtaacggtccgttacccggtaccccccgttcgggttaccctaccgttccgttaccccg

SEQ ID NO: 89858 - DNA, 683 bp, Homo sapiens
  misc_feature: GYAE6OF02IFB8R.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggcgtgtgggctcaggaggcagagctctgggaatctcaccatggcctggacccctctcctgctcccctcctcactttctgcacagtctctgaggcctcctatgagctgacacagccaccctcggtgtcagtcgtccccaggacaaacggccaggatcacctgctctgganattcattgaccaaaagatatacttgttggttccagcagaagtcaggccaggcccctgtactggtcatccatgaggccagtcgacgacacgtccgggactcccgtggagacgaactttcctcgtcgccccttacgacgccttacgaaggggtacctaggttacgggacccctaccgtttgaaccttaactcgtaacgggttcgggggacccctagggggtacggaacggacgttacgggaaacgtcgtaggtaaaccttaacgttaagtttcggttaaccgtaccaacccgtagaacgtaaggtaacggttcggtactacgttacggaggggggtttacttacggggaccggggtaacgggaccgtaacggttcggacccggttccgtttacgggtaccgtaaccgacccgaacgggttcctaccggtcccccgttaccgggtaccttaccgttccgttaccccg

SEQ ID NO: 89859 - DNA, 563 bp, Homo sapiens
  misc_feature: GYAE6OF02I5LNN.21.8.A08.1.454.CMB.1.raw
  modified_base (443)..(443): a, c, t, g, unknown or other
  misc_feature (443)..(443): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccttcggtgtcagtcgtccccaggacaaacggccaggatcacctgctctggagattcattgaccaaaagatatcttgttgttccagcagaagtcaggccaggcccctgtactggtcatccatgagccagtcgacgacacgtccgggatccctagagagtacttctaccgtgccctccagtccgtacgagggtacaggtcggccctacgttcgactagtccgaggtcgggaccctagggtcggacgtagtagaacgcgtgacttactagttacgtacncacagacagtagtgtcagtcgtagggtatcggacggtacggacgtaggtcgtaccggttccgttaggtcaccggtacccaggtccgtccggtccccgtcgggtcctaccgttcgtcccgg

SEQ ID NO: 89860 - DNA, 516 bp, Homo sapiens
  misc_feature: GYAE6OF02IOI87.21.8.A08.1.454.CMB.1.raw
  modified_base (330)..(330): a, c, t, g, unknown or other
  misc_feature (330)..(330): n is a, c, g, or t
  modified_base (423)..(423): a, c, t, g, unknown or other
  misc_feature (423)..(423): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagattcattgccaaaagatatacttgttgttccagcagaagtcaggccaggcccctgtactggtcatccatgaggccagtcgacgacactccgggatcccgtgagagacttcnctgccctccagctcgagggacaggtggccctaccgtttgactatcgaggtcgggcccgagggtggacgatgaagctgacttactattgttacncaccagacagtagtgtcagtcgaggggttatcggacggaggacagttcgaccgtcttggcacgccgaaggctcgccccgtcggtcacctctcg

SEQ ID NO: 89861 - DNA, 553 bp, Homo sapiens
  misc_feature: GYAE6OF02GA78U.21.8.A08.1.454.CMB.1.raw
  modified_base (303)..(303): a, c, t, g, unknown or other
  misc_feature (303)..(303): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggaggcagtgggtccagccgtggggacggtccctggacgcctctcctgtgcagcgtctggattcagtatcggcttccttgccatgcacgtgggtcccnccaggcctccgaggcaaggggctggaggtgggtggcgtattatcgtggtatgagtggagtgagagatatattcagtactccgagaggccgtattcacntcacagagacatcgaccaanaacacactagtactctacaagtcgacccgctagacgtacgccgaggaccacggctagtcgttacttacgtagtacggtacgttcgtttaggacttagggttccgggaccgtacgggtacccgtgggtacccg

SEQ ID NO: 89862 - DNA, 646 bp, Homo sapiens
  misc_feature: GYAE6OF02GUAHR.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccaccctcggtgtcagtcgtccccaggaaccaaacggccaggactcacctgctcgtggatattcattgaccaaaagatatacttgttggttccagcaagaagtcaggccacggcccctgtactggtcactccagtgacggctacgtcgacgacaccgtccgggatcccgtagagacgtattctcgtcgccctccacgctcgagggacaggtcgaccctaccttgaactactcgacggtcggggccgagggtcggacgtagtacgacggtcgtagtaacttacttagtttacgtaaccgccaaccgaacgtaaccgtaggtaacggttcggtactagtacgggtaagggggttacgttcgggacgggaacgggtaccgttaaggttccggtacccggttcgttaccggtaccgtaaccggacccgtaaggtcccgttcccggtcccccgttacggacccttacccgttcgttacccccgg

SEQ ID NO: 89863 - DNA, 646 bp, Homo sapiens
  misc_feature: GYAE6OF02GNESJ.21.8.A08.1.454.CMB.1.raw
  modified_base (176)..(176): a, c, t, g, unknown or other
  misc_feature (176)..(176): n is a, c, g, or t
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtntcagtcgtccccaggacaaacggccaggatcacctgctctgganattcattcgaccaaaagatatacttgttggttccagcagaagtcaggccaggcccctgtactgtcatccatgaggccagtcgacgacacgtccgggatcctagagagtacttctctcgccctcgagtctacgagggactaggtcgaccctacttgactacgtacgacggtcgggccctagggtacggaacgagtacgaacgtcgtacgaccttaacgttagtttacgttaaccgccgtaaccgaggtaacgtacggttagttcggtacctaagttacgggtaggggttacgttaccgggacgggaacggggtaccgtaacgggtttacggtacccggtttccggttaccggtaccgtaaccggtacccgaaccgggtccgtacccggtaccccccgttacgggtccctaccggtcgttacccccgg

SEQ ID NO: 89864 - DNA, 566 bp, Homo sapiens
  misc_feature: GYAE6OF02G1XY6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtgtccccaggacaaacggccaggatcacctgctctggagattcattgaccaaaaagatatacttgttggttccagcagaagtcaggccaggcccctgtactggtcatccatgacggccagtcgacgacacgtccgggatccctgagagattctctcgcctccgagcctacgagggacaggtcggaccctaccgtttgaacgttatcgacggtcggggccccgagggtcggacgagtgaagctagacttactattgtacgcaccagacagtacgtgtacagtcgaggggttagtcgggacgggacgggtacgtaggttcgtaccggttcgttcggtacgacggacccgaggccgtccggtcccccgtcggtcctaccgtccgttcccg

SEQ ID NO: 89865 - DNA, 637 bp, Homo sapiens
  misc_feature: GYAE6OF02I2YU1.21.8.A08.1.454.CMB.1.raw
  modified_base (221)..(221): a, c, t, g, unknown or other
  misc_feature (221)..(221): n is a, c, g, or t
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgttccagcagaagtcaggccaggcccctgtactggtcatccatgacggccagtcgacgacacgtccgggactcccgngagagtacttctaccgtgccctacacgtcctacgacgggacctaggtcggaccctaccgttgaaccttagtcgacgggtcgggacccgtagggtcggaacgtacgtagaacggtctagtaccttattagttacgttaccgactaccgaggaccgtagttagtcggtactagttacgggtaggggttacgttcggggacgggaacgggtacccgttaaggtccggtacccggttccggttacggttaccgaccggtacccggaaggtcccgtacccggtcccccgttacggtaccctaccgtccgttaccccg

SEQ ID NO: 89866 - DNA, 643 bp, Homo sapiens
  misc_feature: GYAE6OF02IOJX7.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcactgtctctgaggcctcctatgagctgacacagccaccctcggtgtcagtcgtcccaggacaaacggccaggatcacctgctctgganattcattgaccaaaagatatacttgtgtccagcagaagtcaggccaggccctgtactggtcatccatgaggccagtcgacgacacgtccgggatccctggagagtattctctcgccctcgaagctacgaagggaccagtcggcccacctttagacctatcgaggtcggggccagggtgaacgactaggaacgcgtagaacttacgtaatttcgtaacgtcgaaaccagtaaccgtagtaaacgtcggtacgtaacgtaccggttaaagggggtaggttaccgggacgggttaacggggaaccctaacgggttacgggtaaccccggttacccggtttacgggtccgtaaccgggaccccgttaaaggggtccctaccgggtacccccccgttccggggtaccctaacccgttccgtttccccggg

SEQ ID NO: 89867 - DNA, 625 bp, Homo sapiens
  misc_feature: GYAE6OF02JNZM3.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagactatactgttgttccagcagatcaggccaggcccctgtactggtcatccatgagccagtcgacgacacgtccgggatccctagagtagattctctcgccctcagcctcgagggacaggtcggccctaacgttgactactcgaggtcgggcccgaggtcggacgtagtagaagctagacttacgtagttgtacacgacacgtacagttagtacggttcacgtacggtacgggggttattccggggtacgggaacgggtaacccgtaagggttaccggtacccgttaccggttcgggtcctaaccggtaccccggtaacgggcccgtttacccgggccccccggttcggttaccccgtacgtttcccgttacccgttacccccgttaccccccg

SEQ ID NO: 89868 - DNA, 739 bp, Homo sapiens
  misc_feature: GYAE6OF02JTJ0V.21.8.A08.1.454.CMB.1.raw
  modified_base (420)..(420): a, c, t, g, unknown or other
  misc_feature (420)..(420): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccctacccgtcggtgtcagtcgtaccccgaggaccaaacggccaggactccacctgctcgtaggatattcattacgaaccaaaaagtatacttacgttggttcggttccagacagaacgtcgaggccacggccctgtaccgtggtcactccagtggacggccaggtcgaacgacctaccgtccgggaactcccgtaggaacgtacgtactttccgtcgtcgtaccctaccgacgtcccgtacggaacgggtacnggtccggaccctaaccgttacgaacttcgtacggtacggggtccgggacccggtaaggggtacggacgtaagttacggaacggtcgttaacggtaacttacggttaagtttccgttaacccgacctaaacggtacgtaacgttaggtaacggttcggtaacgtacggttacgggtagggggtttctacggggacgggtaacggaccgttaggttccgtaacccggtttcggttacggaccgtaaccggtacccgtaacgggtcccgttaccccggtacccccggttaggtaccccttacggttcccccgtttaccccgg

SEQ ID NO: 89869 - DNA, 783 bp, Homo sapiens
  misc_feature: GYAE6OF02F0HNE.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggtccagcagagtcaggccaggcccctgtactggtcatccatgaggccagtcgacgacacgtccgggactcccgtgacgagtattcctctcgccctccagtcctacgagggacaggtcggaccctaccgtttggaacttacgtcgacgggttcggggaccccgtaggggttacgggaaccggtagttacgggaaacggtccgttacggtaacccgttaacgttaacggttttacggttaaccggacccgtaaacccgaacggtaaccgtaaagggttacggttacgggttacctaacgggtttaccggggtaaacggggggggtttaacgtttaccgggggaccgggggtaaacgggggtaaacccggtaaacggggttttaccgggtaccccggtttacccgggtttacggggttaacccggaaccgggtaacccccgggtaaacgggttccccggttaccccgggtcccccccggtttaccgggttaccccgtaacccggtttcccggttaccccgggtttccccccggtaccccccgg

SEQ ID NO: 89870 - DNA, 529 bp, Homo sapiens
  misc_feature: GYAE6OF02GF8OH.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggtccagcagaagtcaggccaggcccctgtactggtcatccatgaggccagtcgacgacacgtccgggatccctgagagattctcgtcgcctccagcctacgagggacaggtcggccctaccgttgacctatcgaggtcggggcccagggtggacgagtgaagctagactactagttgtacgcaccgagacagtagtgtcagtcgaggggtacttcgggcggaggacagtcgacgtcgtggcacgccgagcctcgccccgtcggtccacctcgtcgtcccgtccc

SEQ ID NO: 89871 - DNA, 538 bp, Homo sapiens
  misc_feature: GYAE6OF02FJR7H.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccccgtgagagtattctctgcctccagctcgagggacaggtcggccaccttgactatcgaggtcggggcccagggtggacgagtggaagctagacttactatttgtaccgcaccagactagtagtggtacagtcgtagggggtattcgggacgggaggaccgtagttgaccgtcgttggtcacgcccgaagccgtcgccccgtggtcctacgtcgttcccg

SEQ ID NO: 89872 - DNA, 507 bp, Homo sapiens
  misc_feature: GYAE6OF02JB62F.21.8.A08.1.454.CMB.1.raw
  modified_base (219)..(219): a, c, t, g, unknown or other
  misc_feature (219)..(219): n is a, c, g, or t
  modified_base (341)..(341): a, c, t, g, unknown or other
  misc_feature (341)..(341): n is a, c, g, or t
  modified_base (452)..(452): a, c, t, g, unknown or other
  misc_feature (452)..(452): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaaagatatacttgttggttccagcagaagtcaggccaggcccctgtactggtcatccatgaggccagtcgacgacactccgggatcccgtgagagattctctgccctcngctcagggacagcgccaccttgactatcgagtcgggccagggtggacgagtagaagctgacttatagttgtacgcaccagacagtagtgtctagtcgacggggttatcggnggaggacgagtcgacgtccgtggcacgccaggctcgcccctcggtcacgtctccg

SEQ ID NO: 89873 - DNA, 679 bp, Homo sapiens
  misc_feature: GYAE6OF02JX7D0.21.8.A08.1.454.CMB.1.raw
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgccacagtctctgaggcctcctatgagctagacacacgcccacccgtcggtgtcagtcgtccccgaggaacaaacggccaggactcgacctgctcgtaggactattccattcggaaccctaaaagtattattaccgtttggttacggttccagcaagtaacgtcgacggccacggcccctagtactggtcactccagtagcgtcagtcgacgacncgtacggactccgtagangtacttctncgtcctanacgctagacggactacggtcgacctactttagacttagtcgacgggtcgggccgtagggtacggaacgagttacgacgtcgtagtaaccttacgtagtttacgacgtaccgaaccgagtactaaggtaggtacggttacaacggttacgggtaagggggtttactaccggggacggtaaccgggtaacctacgggttaccggtaccggtttcccggttagggtaacccgaacccggtacccgtaacggtcccgtacccggtacccccggttgtacccgttaccgttcccgtttaccccgg

SEQ ID NO: 89874 - DNA, 614 bp, Homo sapiens
  misc_feature: GYAE6OF02HRSNH.21.8.A08.1.454.CMB.1.raw
  modified_base (252)..(252): a, c, t, g, unknown or other
  misc_feature (252)..(252): n is a, c, g, or t
  modified_base (383)..(383): a, c, t, g, unknown or other
  misc_feature (383)..(383): n is a, c, g, or t
tcagtcgtcgctcgcacgaccggtgctcgatttagcatactctacagggggctggtgggctcgacggaggcagaagctctggggaactctcaccatggtcctggacccctctcctgactccccctacctctactttctcgcacagtcctcgtgaggccctccctaatgagctagtacacgacgccaccctccgggtagtccgacgtcgtccccaggtaccaaacggccaggatccgacctggctcgtggtanattcattcgaaccaaaagatactacgtttgttggtaccaggcaaggaagtcaggccaggcccctagtactggtcatccatgagccagtccgacgtacaccgtccggggatcccgtaggaggtagtacttcnccgtacgccctcgagtctacgagggactggtccgtcctacgttcgacttactcgacggtcgggtcccgaggtacgtacgagtacggaacgcgtacgacgttacgttagtacgtaccgacacagtacgtagtagtgtcgagtcggtagggttgtcggacggtaggacctaggtcgaccgtcgttaggcacgcccgaagccgtccgtaccccgtcggtacctcgttcctcccg

SEQ ID NO: 89875 - DNA, 649 bp, Homo sapiens
  misc_feature: GYAE6OF02GXB0L.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatccctgagagtacttctctcgccctccgagctacgagggacaggtcggccctaccgttgactatcgaggtcggggcccagggtcggacgagtacggaagccgtagaacttacttagtttcgttaaccgcctaacccgagaacgtaggttacggttcggtactagttacgggtaaggggggttacttcggggacgggtaacggggaacccgtagggtttaccggacccgggtttcccgtttagggttacccgaaccgggtaccccgtaaggggtcccgttcccgggtacccccccgttaccggggtccctaccggttcccgtttcccccggg

SEQ ID NO: 89876 - DNA, 754 bp, Homo sapiens
  misc_feature: GYAE6OF02HROP8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggactcacctgctctggagattcattcgacaaaagatatacttgttgttccagcagagtcaggccacggcccctagtactggtacatccatggacggccagtacgacgacacgtccgggactccgtgagtagtactttctcgtcgcctaccacgtcgtacggacgggtactacggtcggaccctaccgtttggaacttacgttaccgaacggggtccggggacccgtaaggggtacggaacggtagtacggaacggtccgttaaggtaaccttaacgtttaacgtttaccgggtttaaccgaccgtaaaccggtaacgtaacgtaagggttaacggttcggtaccgtaacgttaccggggttaaggggggtttaccgttacggggtaccgggggtaaacggggtaacccgttaacggggtttaccggttaaccccgggtttcccggtttacggggaccgtaacccgggtaccccggtaaagggttccccggtaccccgggtaccccccggttccgggttaccccgttacccgtttacccgtttaccccccggg

SEQ ID NO: 89877 - DNA, 576 bp, Homo sapiens
  misc_feature: GYAE6OF02FX3ZY.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatcccgtgagagattctctgccctcagcctgagggacagtcggacctacttgactatcgaggtcgggcccgtagggtcggacgtagtaggaagtcgtgtaacttacttattacggttacgcaccagactaggtagtgtacagtacggtaggggtacgttcgggacgggacgggaccgtaggttcggtacccgttcgttcggtaccgacggtacccgaaggtcctaccggtcccccgttggtaccctaccgttcgttaccccg

SEQ ID NO: 89878 - DNA, 674 bp, Homo sapiens
  misc_feature: GYAE6OF02IOBVL.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcaactttctgcacagtctctgaggcctcctatgagctgacacagccaccctggtgtcagtcgtccccaggacaaacggccaggatcacctgctcgtgganattcattgaccaaaagatatacttgtgttccagcagagtcaggccaggcccctgtactggtcatccagtgaggccagtcgacgacacgtccgggatccctagagagtattcctctcgtccctccagcttcgagggacaggtcggccctacgttgactatcgacggtcgggcccgtaggtcgggacgtagtaggaagcgtaggaacttaacgttagtttacggtttaaccgcctaacccgtaaggactaagggttacggttacgggtacctaaggttaccgggtaaggggggtttaacgtttcgggggaaccggggtaacggggtaacccgtaacgggtttaccggaacccgggtttccggttttacgggtaccggtaccggtaaccccggaacgggttcccgttcccggtaccccccgttcgggttacccctacccgtttccgttcccccggg

SEQ ID NO: 89879 - DNA, 536 bp, Homo sapiens
  misc_feature: GYAE6OF02INGP8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagattcattgaccaaaagatatacttgttgttcagcagaagtcaggccaggcccctgtactggtcatccatggacggccaggtcgacgacaccgtcccgggatcccgtagagagattctctcgccctcagctcgagggacagtcggcctaccttcgactatcgacggtcggggcccagggtcggaacggataggaacgctaggacttacttagtttcgttaccgcaccagacagtagtggtacagtcggaggggttagtcggacggaggactagttcgaccgtcgttgcacgccgagctcgccctcgtcactcgtccg

SEQ ID NO: 89880 - DNA, 520 bp, Homo sapiens
  misc_feature: GYAE6OF02JE3O0.21.8.A08.1.454.CMB.1.raw
  modified_base (512)..(512): a, c, t, g, unknown or other
  misc_feature (512)..(512): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatcccgtgagagattctctgcctccagctcagggacagtcggcctacgttgactatcgaggtcggggcccagggtcggacgagtaggaagcgtgacttactattcgttacgcaaccagacagtagtggtcatcgaggggtattcggcgagggacagttcgaccgttcgtgtcgagcccgaaggctcgccccgttcggcnctcgtccg

SEQ ID NO: 89881 - DNA, 734 bp, Homo sapiens
  misc_feature: GYAE6OF02I398A.21.8.A08.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagcatactctacaggggcgtgtgggctcaggaggcagagctctgggaatctcaccatggcctggacccctctcctgcctccccctcctccactttctgcacagtctctgaggcctcctatgagctgacacacgcccacccgtcggtgtcacgtcgtccccaggacaaaccggccaaggactccgacctgctctggatattcattcgaccaaaagatatacttgttagttccagcagaacgtcaggaccacggtccccctggtaccttggtaccagtccaagtcggacggccaggtccgaacgaccaacgtcccgggactccccgtagacgagtactttccgntaccgcccttcgacgtccgtacgacggggactagttccggccctaaccgtttcgaacttacgtcgtacggtcggggtacccgtagggtcggacggacgaggtaacgacgttcgaacgttacgttacgtttacgttaccgaccaccgaacgaccgtaaggttacgtcgggttactaacggtacggtaacggggtttacggtccggggaagggtaaccggggtaccgttacgggtttaaccggtacccgggttacccggttttacgggtacccggttaaccggaccccggtaacgggttacccgccccgggtttcccccccgttacgggtcccgtttacccgttcccggtttacccccggg

SEQ ID NO: 89882 - DNA, 650 bp, Homo sapiens
  misc_feature: GYAE6OF02JKNEY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacactccgggatccctgagagattctctgcctccagctcgaggacagtcggcctaccgttgaactacgtcgaggtcggggcccgagggtcgggaccgagtacgaacgcgtacgtaacttacgttagtttcggttaaccgcaacccggaggaaccgtaaggttacggttacggttaccgaacgttaccgggtaaggggggtttacgtttaccggggccgggtaacggggtaacccgtaaggtttcggaacccggtttcccggtttacgggtaccgtaaccggtaccccgaagggtcccgttaccggcccccccgttagggtacccgttacgttcccgtttaccccgg

SEQ ID NO: 89883 - DNA, 656 bp, Homo sapiens
  misc_feature: GYAE6OF02IQW1G.21.8.A08.1.454.CMB.1.raw
  modified_base (246)..(246): a, c, t, g, unknown or other
  misc_feature (246)..(246): n is a, c, g, or t
  modified_base (497)..(497): a, c, t, g, unknown or other
  misc_feature (497)..(497): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtctcagtcgtcccccgggacaaacggccaggatccacctgctcgtggacgatgcattcgaacctaaaaattnttgtttttaggaccagcagtagtcgagccaggcccctgtgttggtctactccatggagacgaggtacgaccgtacccgtccgggactcccgtagacgtacgactttctcgtggacctcccaaacgtcggaacggggtcggtcggacccgtacgttagtattcctacgtacgggtcggggaccctggggtaggaggacgtaggaacgtcgtagaccgttaacgtacgttaggttacctctagccgaacgacngacgtacggtggtaccaggtcggacggggtactaggttccgggacgggtacggacgtacggttacgaccgttaccggtcggtacgacgacccgtaacggtccgttaccggacccccgtcggttacctaccgtccgtttacccggtcccccttaccccgg

SEQ ID NO: 89884 - DNA, 569 bp, Homo sapiens
  misc_feature: GYAE6OF02J243D.21.8.A08.1.454.CMB.1.raw
  modified_base (221)..(221): a, c, t, g, unknown or other
  misc_feature (221)..(221): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgccagtgtcccccaggacaaacggccaggatcacctgctctggganattcattgaccaaaagatatacttgtgtccagcaggaatcaggccaggcccctgtactggtcatccatgaagcctagtcgacgacaccgtcgggatcccctgaagngnttctctcggaccttccagctacgacggganacggttcggaaccnccgtttaggacctaacgtcgaggtcggggaccccgagggtacgggacgaagtcggaagcttacggacttactacttgttaaccncgaacccngaacnggtatggtacagtcgtacggggtacttcgggcggtacggacctagtcgaccgtcgtcgtcacgtccgaggcctacggcccctcgctaccgtcttacccg

SEQ ID NO: 89885 - DNA, 552 bp, Homo sapiens
  misc_feature: GYAE6OF02GLFLZ.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgacggcctcctatgagctgacacagcccaccctggtgtcagtcgtccccaggaccaaacggccaggatcacctgctctgganattcattgaccaaaagatatacttgttggttccagcagaagtcaggccaggcccctgtactggtcatccatgaggccagtcgacgacacgtccgggatccctgagagtattcctctcgacctccaggctcgagggacagtcggcccacgtcgactatcgacggtcggggaccgagggtacggacgagtaggaacgtcgtacgaacttacgtatttggttaaccgcaccgagtacgtagtagtggtctaagtcggtaggggtatcgggacggacgggactaggtcgaccgtcgtggcacgacgacgcgtccgcccgtcgcctctcgtcccg

SEQ ID NO: 89886 - DNA, 617 bp, Homo sapiens
  misc_feature: GYAE6OF02JJ62G.21.8.A08.1.454.CMB.1.raw
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctctatgagctgacacagccaccctcggtgtcagtcgtcccaggacaaacggccaggactcacctgctctggagtacttcattcgaccaaaagatatacttgttggttccagcagaaagtcaggccacggccctagtactggtcatccagtgaggcctagtcgacggacaccgtccggactcccgtagacgagtacttcnctcgcctcgagctcgaaggacagcgaccactgactatcgngtcgggccagggtcgacgtagtaggagtcgtacgacgttacgtacgtttacggtacacgtaccagtaacgtaggttacgtcggtactaaggttaccggtaaggggttacggttacgggacgggtaacgggtaccgtaagggttccgaccggttcggttacggtacgtaaccggtacccgtaaggtcccgtaccggtcccccggtaggtacccgtacgttaccgttaccccgg

SEQ ID NO: 89887 - DNA, 655 bp, Homo sapiens
  misc_feature: GYAE6OF02JTP74.21.8.A08.1.454.CMB.1.raw
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcaggtcgtccccgaaggaccaaacggccaaggactcacctgctcgtgganggaattcaacttaagcctaaaagattatacgttcgtaggttccagacngaaaggtccaagggcccctaggcccctggtaccnggtccatccgagtcgaggcccagtccgacgccgactccgggatcccagagtgacttctccgtgacctccagacgtcaggggacacgtcggaccaccttgacgtagtccggacggtcggggacccgagggtacggacgaagtcggaaagccttaagtacgttaacttacgttacgttacgacaccgtaagtacgtacgtagtcggtacgtaaggttcgaagggggtacgttacgggacgggtaacgggacggttaacggtttccggtaacccgggttacttacgggaccgaacggtcccgaaccgggtccgtccgacccccggttacggtccctaccgttcccg

SEQ ID NO: 89888 - DNA, 731 bp, Homo sapiens
  misc_feature: GYAE6OF02GVHEY.21.8.A08.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagtcgtcgctcgcacgaccggtgctcgatttagcatactctacagggggctgtgggctcaggaggcagagctctgggaatctcaccatggcctgggacccctctcctgcctccccctctcactttctgcacagtctctgaggcctcctatgagctgacacagccacctggtgtcagtcgtccccaggacaaacggccaaggatccacctgctcnggatattcattgaccaaaagatntacttgttggttccagcagaagtcaggccaggcccctgtactggtcatccatgacggccaggtcgacgacacgtccgggatcccgtgacgatacttctctacgcccttccgaggtcctacgaacggggactacggtcggccctaccgtttcggaacttacgtcgaacgggttcgggggaccccgtaaggggtacgggtaaccggtaagtaggaaccgtacgttcggtaaaccttaaccgttagtttcggttaaccgaccgtaaaccaacggtaaccgtaagggttaacggttcgggttaacaacggtttaccgggtaagggggggtttaccttacggggtaccgggaaacggggtaacccgttaagggtttaccggtaacccgggttttccgttacggggttacccgtaacgggacccccggttaaaggggtccccgttaccggtcccccccggttaccgggttcctacccggtttcccgttaacccccggg

SEQ ID NO: 89889 - DNA, 719 bp, Homo sapiens
  misc_feature: GYAE6OF02H12Z0.21.8.A08.1.454.CMB.1.raw
tcagtcgtcgctcgcacgaccggtgctcgatttagcatactctacaggggcgtgtgggcgtcgaggaggcgagagctctgggaatctcaccatggcctcggacccctctcctcgcctccccctcctccactttcctgcacagtctctgaggcctcctatcgagctgacacagccaccctcggtgtcagtcgcccgacggacgaaaacggcaaggactaccacctgccttccgtggagactttacagttgaaccaaaaagtaataactatttgttaggttaccagacgaagaagtcgaacggccaacggccccctagtaactcggtacacgttacaagtcggaagacctagtaccgacgaccgtaacgtccggaacttccgacgagacgtagttcctcgactccgtcaacgtccgtacgaacggggtacgtaaagtcgggacctaaccgttggtaacctttaccgacgtacgggtccggggaccgtaggggtcggaagggtagtacggaaacggtcgtaagtaaccgttaacgttaacgttacgttacccgttagaacgtacgaacggaccgaagtaccgtaggtacggactaacggtccgggagggtaaccgtacggttacgggacggggtacgggtaaccggtcgggttaacggaccgtaccggttacggccgtaaccggaccgtacgggtacccgccggtacccccgtggtaacccg

SEQ ID NO: 89890 - DNA, 619 bp, Homo sapiens
  misc_feature: GYAE6OF02JD8V5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagccaccctggtgtcagtcgtccccaggacaaacggccaggatccacctgctctggatattcattcgaccaaaagatatacttgttggttccagcagaagtcaggccacggcccctgtactggtcatccatgagccagtcgacgacacgtccggactcccgtagagagtattctacgtcgccttccgagtcctcgaacgggacaggtcggaccaccttggaccttagtcgagggtccggggccctagggtcggacgtagtaggaacgcgtacggtaacttacttagtttacggttaccgcctaaccgagtaccgtaaggttaggtacggtactacgtacggtacgggggttacgtcggggacggacgggaacctaggttcggaccggtttccgtcggtacgacggtacccgtaaggcccgtcggtacccccgttcggtcctaccgtccgttcccgg

SEQ ID NO: 89891 - DNA, 624 bp, Homo sapiens
  misc_feature: GYAE6OF02HX85H.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctcctatgagctgacacagccaccctcggtgtcagtgtccccaggacaaacggccaggatcacctgctctgganattcattgaccaaaagatatacttgttgttccagcagaagtcaggccaggcccctgtacgtggtcactcagtgacggccagtcgacgacacgtccgggactcccgtgagagactttctcctcgccctccgacgtcctcgaacgggactaggtcgggaccctaccgtttgaccttagtcgagggtcggggacccgagggtcggacgagtaggaaggtcgtacgaccgttaacgttattacggttaccgaccaccgaacgacgtaaggtaggtcggtactagtacggtaggggttacgttcgggacgggacgggaccgtaggttcggtaccggttccgttacggtcgaccgacccgtaacggtccgtacccggcccccgttccggtaccgtaccttccgttccccgg

SEQ ID NO: 89892 - DNA, 519 bp, Homo sapiens
  misc_feature: GYAE6OF02GMV42.21.8.A08.1.454.CMB.1.raw
  modified_base (458)..(458): a, c, t, g, unknown or other
  misc_feature (458)..(458): n is a, c, g, or t
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccagtcgacgacacgtccgggatcccgtgagagacttctctcgcctccagctcgagggacagtcggccaccttgactatcgaggtcgggccgagggtggacgagtagaacgcgtagaacttactagttgttaccgcaccagacagtagtgtcatcgaggggttntcggcggagggaccagtcgaccgtctggtcngcccaggcctcgccccgtgtcncgtctccg

SEQ ID NO: 89893 - DNA, 642 bp, Homo sapiens
  misc_feature: GYAE6OF02F8NB1.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctcgtggagattcattgaccaaaagatatacttgttggtccagcagaagtcaggccaggcccctgtactggtcactccatgacggccagtccgaacgaccacgtccgggatcccgtgacgagacttcgtctcgccctcagctacgagggactaggtcggacctacgttcgacttagtcgacggtcggggacccagggtcggacgagtacggaagcgttagaacttacgtagtttacgtaccgacaaccgagtaactaggtagttcggtacgtacgtacggtagggggttacgtccggggacgggtaacgggtaacctaagggttccgtacccggttccgttacgggtccgaacggtaccccgtaacggtccgttaccggtcccccggttcgggtaccctaacccgttccgttacccgttccccctaacccccg

SEQ ID NO: 89894 - DNA, 647 bp, Homo sapiens
  misc_feature: GYAE6OF02HFQB7.21.8.A08.1.454.CMB.1.raw
  modified_base (230)..(230): a, c, t, g, unknown or other
  misc_feature (230)..(230): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcacggtcgtccccgaggaacaaaccgggccaggactcacctgctcgtgganattcattgaccaaaagatatacttgtaggttccagcaagaagtcgacggccacggcccctgtactggtcactccatggacggccaggtcgacgacacgtccgggactccctggagagacttcgtctcgcctaccgagctacgagggactaggtcggaccctacgttgactatacgacgggtcgggaccgaggtggacgagtagaagctagtacttaactattacgttacgccgacgaacgtacgtaggtacggtacggtacgtacggtacggtaagggggttacggttccgggacggggtaacgggtaccgtacggttacggtacccggttccggttacggtacggtaaccggtacccgaacggtcccggttacccggtcccccggtccggtacccgtaccgttcccgttaccccgg

SEQ ID NO: 89895 - DNA, 608 bp, Homo sapiens
  misc_feature: GYAE6OF02ISI4R.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggactcacctgctcgtggatattcattcgaccaaaaagatatacttgttggttccagcagtaagtcgacggccacggccccctgtacctggtcatccagtggacggccagtccgacgacaccgtccgggatcccgtagagtagtacttctctcgtccctccgacgtcctacggacgggtacacggtcggaccctacgttcgacctagtcgacgggtcggggccgagggtcggacgagtaggaacgtcgtagtacttacttagttacgtacgccaacagactaggtagtcgtagagtacggtaggggttcgtcgggacgggtacgggacgtagttcggtaccgttccgttcggtacaccgaccgacggccgtccggtccccgttcggtaccgtaccgtccgttcccg

SEQ ID NO: 89896 - DNA, 523 bp, Homo sapiens
  misc_feature: GYAE6OF02G324R.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcgatgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatccccgtgagagattctctgccctccagctcgagggacagtcggccaccgtttgactatcaggtcggggcccagggtcggacgatgaagctgactactattgtacgcacagacagtagtgtcagtcgaggggtactcgggcggaggtaccgaaggttcgaccggttcgttggcacgccgaaggtctcgccccgtcggtcacgtccg

SEQ ID NO: 89897 - DNA, 656 bp, Homo sapiens
  misc_feature: GYAE6OF02H8S9A.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaccacagcccaccctcggtgtcagtcgtccccaggacaaacggccaggatcacctgcctcgtggagtattcattgaaccaaaaagaatatacgtttgttggttccagacagaagtcaggccaggcccctgtactgtcatccatgagccagtcgacgacacgtccgggatcccgtgagagtacttctcctgccctccagcctacgagggaccagtcggcctaccgtgacttagtcgaggtcggggaccctgggtacggacggataggaagtcgtacgtaaccttaacgttagttcggttacgccaaccgaagacgtaaggttaggtggtaccgtaagttccggtaaggggggttacgttacggggaccgggtaacggggtacctaacggggtttcggtacccggtttccggttaccgggttaccggaaccggaccccggtaacggtcccgttcccggtcccccccgttacgggtcccctacccgttccgttacccccgg

SEQ ID NO: 89898 - DNA, 601 bp, Homo sapiens
  misc_feature: GYAE6OF02FZYB6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagaataatacttgttggttccagcagaagtcaggccacggcccctgtactggtcatccatgacggccagtcgacgacacgtccgggactcccgtggagacgtactttctctcgccctccgacgtcctcgagggacaggtcggccctaccgttgactatcgaggtcggggccgagggtggacgagtagaacgtctacgtaacttacttagttacgttaccgacaaccagacgtaggtagtggtacagtcggtaggggttacgtcgggacgggacgggtacctaggttcggtaccggttccgttaggttacccgacggtacccgaacggtcccgtccggtcccccgtcggtccctccgttccgttcccgg

SEQ ID NO: 89899 - DNA, 667 bp, Homo sapiens
  misc_feature: GYAE6OF02GAFML.21.8.A08.1.454.CMB.1.raw
  modified_base (220)..(220): a, c, t, g, unknown or other
  misc_feature (220)..(220): n is a, c, g, or t
  modified_base (333)..(333): a, c, t, g, unknown or other
  misc_feature (333)..(333): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttgtccagcagaagtcagccaggcccctgtactggtcatccatggacgcagtcgacgacacgtccgggactccctgaagagtattccncgtcgcctccagcctacgagggaccaggtcggccctaccgttagaacttacgtccgtagggtcggggaccccgtagggtacggacgtacgtacggaacgtccgtacggtaacttaacgttaacgtttacggtttaaccgaccgtaacccgtaacgtaacgtaggttaggttcggtacgtacgttacgggtacgggggttacgttccggggaacgggtaacgggtaccgtagggttaccggtaccggttccggttacggtacgtaaccggacccgtaacggcccgttaccggaccccccgttacgggtccccgtaccgttcccgtttaccccggg

SEQ ID NO: 89900 - DNA, 676 bp, Homo sapiens
  misc_feature: GYAE6OF02JNBSM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctctcactttctgcacagtctctgacggcctcctatgagctgacacgagcccaccctggtgtcagtctccccgaaggaccaaacggccaggactcgacctgctctggatattcattcgaccaaaagactatacttggtcgtccagcagagtcacggccacggtccctgtacctggtcactccgagtgacgcagtccgacgcacgtccggatcccgtgaacgagtacttcgtcgtacgtccctcaacggtccgtcgacggggtactacggtccggaacccttaccgtgaacttcgacgtacgggtccggaccggtagggtcggacgtagtacggaacgtcgtacgtaacgttacgtttacgttcggtaaccgtcaaccgtagaacgttacggtaacggttaccggttacgacggtacgggttaacgggggttacgttacgggacgggggtacgaaccggttaggttacccgtaccggttaccgttgggtacccgaacggtcccgaaggtcccgtcccgggtcccccgttaacggtcccgttaccgttacccgtttccccggg

SEQ ID NO: 89901 - DNA, 679 bp, Homo sapiens
  misc_feature: GYAE6OF02HOKK6.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctctatgagctgacacagccaccctcggtgtcagtcgtcccaggacaaacggccaggatcacctgctctgganattcattgaccaaaagatatacttgttgtccagcagagtcaggccaggcccctgtactggtcactccatggaggccagtcgacgacaccgtcgggatcccgtgagagtattcctctcgccctcgagcctacggaacgggacaggtcggacctacgttgaccttatcgagggtcgggacccgtagggtcggacgtagtaggaacgtcgtacggtaacttaacgtttacgtttacgttaaccggactaaccgaaggtaacgtaaggttaacggttggtacgtaacggtacgggtaagggggtttacgttccggggaacggggtaacgggtaacccgtaacgggtttaccggtaccccggttccggtttacggggtaccaaccgggttaaccccggtaacgggttcccgtaccccgggtaccccccgttacggggttacccttacccggttccgtttacccccgg

SEQ ID NO: 89902 - DNA, 602 bp, Homo sapiens
  misc_feature: GYAE6OF02GKD7E.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacctcggtgtcagtcgtcccaggacaaacggccaggactcacctgctctgganattcattgacaaaagatatacttgttggtccagcagagtcaggccaggcccctgtactggtcatccatgacggccagtcgacgacacgtccgggatcccgtgagagtactttctcgtcgcctccgagtcctcggagggacaggttcggccctaccgttgacttatcgaagggtcggggacccgtagggtcgggacgagtaggaacgccgtagtaacttacttagtttcgttaccgactaccacgaactaggtagtcggtacacgtacggtagggggttcttcgggacgggtacgggacgtacggttcggtaccggttcggttacggtcgacgtacccgaggccgtcccggtcccccgttcggtacctccgttccgttacccg

SEQ ID NO: 89903 - DNA, 639 bp, Homo sapiens
  misc_feature: GYAE6OF02I64ZV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagattcattgaccaaaagaatatacttgttgttcagcagaagtcaggccaggcccctgtactggtcatccatgaggccaggtcgacgacacgtcccgggatcccgtagagagtacttcgtcctcgccctcccgagccttacgacgggacagtcggacctaccgttgaactatcgaacggtcggggaccccagggtacggagtacgtagacgtcgtcgacttatacgttagttaccgactaaccgagaacgtaggttacggttcggtacgtaacgttcgggtaacgggggtttagttaccggggacgggtacggggaacccgttaaggtttcggacccgttccggttcggtaccgtaacggtacccgtaacggtccgttccggtacccccgttcgggtaccctaccgttccgttaccccgg

SEQ ID NO: 89904 - DNA, 595 bp, Homo sapiens
  misc_feature: GYAE6OF02IJPDJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggagtattcattgaccaaaagatatacttgttggttccagcagaagtcaggccaggcccctgtactggtacatccatggacggccaggtcgacgacacgtccgggatcccgtagagagtattctcgtcgccctccagctacgagggacaggtcggaccctacgttgaaccttagtcgtacgggtacggggcccgtagggtacggaacgagtaggaagtcgtacgtaacttacgtatttacggtaacgccaccaagacgtaggtaggtcgtactagtcggaggggttagtcgggacgggacggtaccgtaggttcgtaccgtcgttcggtacgtacgacccgaaggtccgtcggccccgtcggtcctaccgtctcccg

SEQ ID NO: 89905 - DNA, 671 bp, Homo sapiens
  misc_feature: GYAE6OF02FLSO6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccaggcccctgtactggtcatccatgacggccagtcgacgacaccgtccgggactccccgtagagagtacttctactcgccctccagtcctcgagggactaggtcgccctaccttagactagtcgaggtcggggcccgtagggtacggacgtagtacggaacgtcgtagtaacttaacgttagtttcggttaaccgctaaccgacggtaacgtaggttaggttcggtacgtagtcgggtaaggggggttactttaccggggacgggtaacgggtaaccgtaacgggttcggtaacccggtttccggttacgggttaccgaaccgggtaccccgtaacgggtcccgttacccggtcccccccggttacgggttaccccttacccggttcccgtttaccccccgg

SEQ ID NO: 89906 - DNA, 632 bp, Homo sapiens
  misc_feature: GYAE6OF02JDJZZ.21.8.A08.1.454.CMB.1.raw
  modified_base (387)..(387): a, c, t, g, unknown or other
  misc_feature (387)..(387): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagtattcattgaccaaaagaatatacttgttggttccagcagaagtcaggccacggcccctgtactggtcatccatggaggccagtcgacgacacgtccgggatcccgtgagagtacttcgtctcgccctccagcctacgagggacaggtcggaccctacttcgaactntaccgaggtcggggccgtagggtggacgagtaggaacgtcgtacgtaacttacgttacgtttaggttaaccgctaacccgaaggaacgtaggttacggttaggtcctaacggttacggtaaggggggttacgtaccgggtacggggtaacgggaaccgtaggttacggtacccggttcggttcggtacgacggtacccgtaacggtccgtccggtcccccgtcggtcctaccgttccgttccccg

SEQ ID NO: 89907 - DNA, 615 bp, Homo sapiens
  misc_feature: GYAE6OF02HWGD8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcgggtgtcagtcgtccccaggacaaacggccaggatcacctgctctggagattcattcgaccaaaagatatacttgttggttccagcagagtcaggccaggcccctgtactggtcatccatggaggccaggtcgacgacacgtccgggatccctgacgagtacttctcctgcccttccagcttacgaacgggtacaggtcggccctaccgtttgacctagtacgacggtcggggacccgtagggtcgggaacgagtacggaagtcgtagtaacgttaacgttatttacggttaaccgactaaccgtaacggacgtagttaagtcggtgtacgttcgaagggggttacgttcgggacgggtacgggaccgtacgttacggaccggttcccggttaggtccgtacggacccaggcctcgacccccgtcggtaccacgtcctaccg

SEQ ID NO: 89908 - DNA, 691 bp, Homo sapiens
  misc_feature: GYAE6OF02H8OOW.21.8.A08.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggngtcagtcgtcccgaggaacaaacgggcaggatccacctgctcgtggagattcattcgaacaaaagatatacgttgtgttccagcagaagtcacggacgagccccgtgtacgtggtcataccagtgaggcctagtccgacgaactaccgtaccggactcccgtagagtagtacttctactgaccctcgacgtctcggaacggcgaacggtcggaccctacgttgtaacgtacgtacgacggtcggggacccgtagggtacgggaacggtaagacggaacgtacgtagtaaccttaacgtttagtttacgttaaccgacgtaaccgtaacggtaacgtaaggttaaggtcgtacgtacgtacgggttaacgggggttacgttacggggacgggtaacgggtaaccggtaacggttccggtaacccggtcggttacggtaccgaccggtaacccgaacggtcccgttacccgggtcccccgttacgggtttccctaacccggttccgttacccccgg

SEQ ID NO: 89909 - DNA, 563 bp, Homo sapiens
  misc_feature: GYAE6OF02HY51X.21.8.A08.1.454.CMB.1.raw
  modified_base (177)..(177): a, c, t, g, unknown or other
  misc_feature (177)..(177): n is a, c, g, or t
  modified_base (345)..(345): a, c, t, g, unknown or other
  misc_feature (345)..(345): n is a, c, g, or t
  modified_base (476)..(476): a, c, t, g, unknown or other
  misc_feature (476)..(476): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctcggtntcagtcgtcccaggacaaacggccaggatcacctgctcgtggatattcattacgaccaaaaagtatattacttgttacggttccagcagaagtcacggccacggcccctgtacgtggtcatccagtgagccagtcacgacaccgtcggactccgagagagtactttcnctcgcctccagctcgaacggcacgtcggcctacgttgactagtcgaggtcgggccgaggtcgagagagaacgcgtagaacttacgtattcgtaacgcaccaagacgagttagtgtacagtcgggtagggtntgggacggagtacgtacgtcgtaccgtcgttcggtacaccggaccgacgtccgtccggtccccgttaggtccctacgtccgttcccg

SEQ ID NO: 89910 - DNA, 765 bp, Homo sapiens
  misc_feature: GYAE6OF02GWHJA.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtgganattcattgaccaaaagatatacttgttgttccagcagaagtcaggccaggcccctgtactggtcatccatggacgccagtcgacgacaccgtccgggattcccgtagagacgtattcctacgtcgtccctaccacgtctacgaagggacacggtcgaccctacgttcgaacctacgtcgacggtcggggacccgtagggtcgggaacgtagtacggaacgtcgtacgtaaccgttacgttaagtttacggttaaccgaccgtaaacccgtaacggtaaccgttaagggttaacgggttccgggttaaccgtaacggttaccggggttaaacgggggggtttaaccgtttaccgggggaacccgggggtaaacggggtaacccgtttaacggggtttcccgggtaaccccgggtttcccggttttaccgggtaacccggtaacccggggtaacccccggtaaacggggttccccgttccccgggttacccccccggttaccgggtttaccccgttaacccggtttccccgtttaaccccccggg

SEQ ID NO: 89911 - DNA, 667 bp, Homo sapiens
  misc_feature: GYAE6OF02JD8QH.21.8.A08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtctcagtcgtccccgggacaaacggccaggactcacctgctctggagatgcattcgaacctaaaaaattnttgttttttaggaccagcagaagtcaggccaggcccctgtgttggcatccagtgaggacaggacgaccgacccgtcgggactcccgtgagagtacttcgtctggcctaccaactcgagggacggtcgccgtacgttgtacttcgtcgacggtcggggccgtagggtggaaggtagtaggaacgtcgtagaaccttacgttacgttcgttactcgacgtacgaacgtacgagacgtaggttggtacctacggtcggaacgggggtcctaacggttccggggacgggaacgggtaccgtaggggtttacccggaccggtttaccgtacggggtacccaaccgggtacccgtaacgggtccgtacccggtcccccggttacggttacctacccgttccggtttccccggttcccccgttacccccg

SEQ ID NO: 89912 - DNA, 559 bp, Homo sapiens
  misc_feature: GYAE6OF02JCNHC.21.8.A08.1.454.CMB.1.raw
  modified_base (178)..(178): a, c, t, g, unknown or other
  misc_feature (178)..(178): n is a, c, g, or t
  modified_base (226)..(226): a, c, t, g, unknown or other
  misc_feature (226)..(226): n is a, c, g, or t
  modified_base (484)..(484): a, c, t, g, unknown or other
  misc_feature (484)..(484): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtntcagtcgtccccaggaaccaaacggccaggatccactgctcgtggagnttcattgaccaaaagatatacttgttggttccagcagaagtcgaggccacggcccctgtactggtcactccagtgaggccgagtcgaacgacacgtccgggatcccgtgagagacttctctcgccctcacgcctagacgggacaggtcggccctaccgttcgactagtcgtacggtcgggccctagggtcggacgagtagaagctagacttacgtagttcgtacacaccagacgtagtgtagtcagttggaagggttntcggaggacggtaccgagtcgaccgttcgtggtacgacgccgaggcctccggcccctcggtccacgtcgttcccg

SEQ ID NO: 89913 - DNA, 666 bp, Homo sapiens
  misc_feature: GYAE6OF02H9YWR.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaaagatatacttgttggttccagcagaagtcaggccaggcccctgtactggtcactccatcggacggccaggtccgaccgacaccgtccgggattcccgtagagagtacttcctctcgtcctccagtcctacgacgggacaggtcggaccctaccgttgaaccttatacgacggtcggggcccgagggtcggaacgagtaggaacgtcgtacgaacttacgttagttacggttaccgacgaaccgtaggaaccgtaggttacggttacggtacctaagttaccggtaagggggttacgttaccggggacgggtaacggggtaacccgtagggttcggtacccggtttccggttacggtaccgtaccggtaccccgtaaggtcccgttaccggccccccgttacgggtaccctacccggttcccgttccccgg

SEQ ID NO: 89914 - DNA, 521 bp, Homo sapiens
  misc_feature: GYAE6OF02HL0A8.21.8.A08.1.454.CMB.1.raw
  modified_base (215)..(215): a, c, t, g, unknown or other
  misc_feature (215)..(215): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (504)..(504): a, c, t, g, unknown or other
  misc_feature (504)..(504): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtcgacgacacgtccgggatccctgagagattctctgccctccagcctcagggacaggtcggccctaccttgactatcgaggtcgggcccagggtggacgagtgaagctgactactattgtacgcaccagacagtagtggtcagtcgaggggtnttcgggnggacggacagtgacgtcgtggtcacgccaaggcctcgccccgtcggtccnctcgtcgtcccctaccc

SEQ ID NO: 89915 - DNA, 569 bp, Homo sapiens
  misc_feature: GYAE6OF02GMXJO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatcccgtgagagattctctcgcctccagctacgagggactaggtcggcccaaccgtttgaaccttagtccgaaggtcggggccccgagggtcgggaacgtagtggaaacgtcgtagaacttaacttagtttacgttacgcctaccagacgagtagtgtacagtcgaggggttaatcgggacggagggaccaggttcgtaccggtcgttggtcacggacccgaaggctccggccccgtaggtcctacgtctcccgg

SEQ ID NO: 89916 - DNA, 740 bp, Homo sapiens
  misc_feature: GYAE6OF02JGXBH.21.8.A08.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaacggcaggatcacctgctctgganatcattcgacaaaagatatacttgttggttccagcagaagtcaggccacggcccctgtactcggtcacgtccagtgacggccagtcgacgacacgtccggatccctgagacgtattccgtacgcggtccctacgtaacgcgtacgaacggggaactacgggttccggaccctaaccgtttacggaaccttagttacccgaaggggtttaccgggggaccccgtaaggggttcgggaaaccgtaagtacggaaacgtccgtacgtaaccttaacgttacgtttacggttaacccgacctaaccgacgtaacgtaacggttacggtacgggtactaacggttcgggtaacgggggtttacttccggggaaccgggtaacggggtaacctacgggtttaccggtacccggtttacccgtttacggggtacctaaacccgggtccccggtaaacgggttccccgttaccccgggtacccccccgttttcgggtaaccccgtttaccgttccccggtttaacccccgg

SEQ ID NO: 89917 - DNA, 674 bp, Homo sapiens
  misc_feature: GYAE6OF02HCN65.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgaggcctctatgagctgacacagcccaccctcggtgtcagtcgtccccaggaccaaacggccaggatccacctgctcgtgganattcattgaccaaaagaatatacttgttggtccagcagaagtcgaggccacggcccctgtactggtcatccatggacggccaggtcgaccgacaccgtccgggatcccgtgacgagtactttctcgtcgccctaccgacggtcctacggaacgggactacggtccggaccctaaccgttcggaacttacgttaccgtacggggtccggggaccccgtaaggggtaccgggtaacggaagtaggaaacgcgttaacgtaaccgtttaacttaagttttccggttaaccgaccaaccgtaaggaacgtaaggttaagggtcggttacacggttacgggtaagggggttacgttcgggacgggagggtaaccgtagggttaccgtacccggttcgttcggtacacggacccgtaggccttaccggccccgttcggtacctaccgttcctacccg

SEQ ID NO: 89918 - DNA, 642 bp, Homo sapiens
  misc_feature: GYAE6OF02I89HC.21.8.A08.1.454.CMB.1.raw
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
tcagtcgtcgctcgcacgaccggtgctcgatttagcatactctacaggggcgtgtgggcgtcgaggaggcagagctctgggaatctcaccatggcctggacccctctcctgctccccctcctccacctttctgcacagtctctgaggcctcctatgagctgacacagccaccctcggtgtcagtgtccccagacaaacggcaggatcacctgctctgagattcattgacctaaaagaatatacttgttggttccagcagaagtcaggccacggcccctgtactggtcatccatgagccagtccgacgacacgtccgggattcccngagatnttctcttcgcccttccgagccgtacgaaggggaccagggttcggccctaaccgttggaaccttataccgtaggtcggggtacccgacgggtaggaccggtaagtcggaaacgtcgtacgacgttaacgtacgttaccggttacgacctaaccgaacgaccgtaagtacggttacgtaccgtagtacggtacggggtaagttccgggaacgggtacgggtacctagggttcgtaacccggtccgtttacggacgtaaccggacccgtaacggtccggttcgcccccgtaccggtcgtaccctccgttacccg

SEQ ID NO: 89919 - DNA, 784 bp, Homo sapiens
  misc_feature: GYAE6OF02IPLUD.21.8.A08.1.454.CMB.1.raw
  modified_base (129)..(129): a, c, t, g, unknown or other
  misc_feature (129)..(129): n is a, c, g, or t
tcagtcgtcgctcgcacgaccggtgctcgatttagcatactctacagggggctgtgggctcaggaggcagagctctgggaatctcaccatggcctggacccctctcctgcctccccctctctactttcngcacagtctctggacgccctctatgacgctagaccacacgccctacccgtcggtgtcacggtccgtaccccaagggaaccaaaccggccaaggactccacctgctcgtaggagtatttatcgaaccaaaaagtattattacgtttgttcggttaccagacaagtaacgtcgacggaccgacggtcccctagtactggtcatccatggaacggcagtcgacgacacgtcggaacttccgtagagtacgtcttcgtaccgcgccttaccgacgtcgtacggaacgggtacttacgttcggaccccgtaaccgttgtaactacgtaccggtacgggtccggggtaccctaacggggtacggtaaccgtaaggtacgtaaaccggtagtaaccggttaaccttaaacgttagttaaccgttaccgaccgaaacccgtaggtaaccgtaaggttaccggttacggtaccgtaacggttacgggtaacgggggttaacgttacccgggggaacgggaaaccggggtacgttaaaccgggttaccggtaacccgttccggtttaacgggaccgtaaccgggtaacccgtaacgggccccgttacccgtcccccgggttaccggtaaccgtcccgtttaaccggttcccctttaaccccccgg

SEQ ID NO: 89920 - DNA, 533 bp, Homo sapiens
  misc_feature: GYAE6OF02JEA7J.21.8.A08.1.454.CMB.1.raw
  modified_base (290)..(290): a, c, t, g, unknown or other
  misc_feature (290)..(290): n is a, c, g, or t
  modified_base (332)..(332): a, c, t, g, unknown or other
  misc_feature (332)..(332): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
  modified_base (482)..(482): a, c, t, g, unknown or other
  misc_feature (482)..(482): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtgagtctggggagcatggtccagcctgggagtccctgagcctctcctgtcgcagcgtctggattcagtatcggctcctttgccatgcactgggtccncaggctccaggcaaggggctggagtgggtggcgtattactcnggtatggatggaagtgagagagtatattcaggtactccggtagaagggccgtattcacctatctcagacgacatgccaanacacactgtacncttacaaatcgacccggtctgtacgacgaccgagacgacggtctagtacgtattacgngttacgagtcgtttaggctaggttcggggccacgggtacccctggtacccg

SEQ ID NO: 89921 - DNA, 623 bp, Homo sapiens
  misc_feature: GYAE6OF02F7XAN.21.8.A08.1.454.CMB.1.raw
  modified_base (223)..(223): a, c, t, g, unknown or other
  misc_feature (223)..(223): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggaccaaacggccaggatcacctgctctgganattcattgaccaaaagatatacttgtgttccagcagagtcaggccaggcccctgtactggtcatccatgacggccaggtcgacgacacgtccgggactccgtgagatacttcncgtcgcctcagctacgngggacnggtccggacctacttgactatcgtaggtcgggccgagggtacggacgtagtagagcgtagaacttacgttattacgttaccgactaccgagaacgtaggtaggtcggtactacgtacgggtagggggttacgtcgggacggggtaacgggtaccgtaagggtttccggtacccggtttccggttacgggtaccgtaccggacccgtaacggcccgttcccggtccccccggttacggttaccccgtaccgttcccgttccccgg

SEQ ID NO: 89922 - DNA, 574 bp, Homo sapiens
  misc_feature: GYAE6OF02FWLKY.21.8.A08.1.454.CMB.1.raw
  modified_base (483)..(483): a, c, t, g, unknown or other
  misc_feature (483)..(483): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgacggccagtcgacgacacgtccgggatccctgagagattctctcgccctccgagcctacgaagggaccaggtcggccctaccgtttgaacttactcgaaggtcggggcccagggtcggaccggagtggaagcgtagaccgttacttatttcgttacgcaaccaggactagtagtcggtcagtcggaaggggtnttcgggacggacgggactaggttcgaccggttcgttacggtcgacgacccgaaggcctccggtcccccgtcggtcctacctcgttacccgg

SEQ ID NO: 89923 - DNA, 621 bp, Homo sapiens
  misc_feature: GYAE6OF02FNVQB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagaatatacttgttggttccagcagaagtcaggccaggcccctgtactggtcatccatgacggccaggtcgacgacacgtccgggatccctggacgagtactttctctcgccctccagcctacgagggacaggtcggaccctaccgtttgactatcgaggtcggggccgagggtcggacgagtaggaagcgtagaacttacgtatttacgttaccgacaccgaagacgagtaggtcggtacgacgtacggagggggttacttcgggacgggacgggtaccgtagggttcggtacccggtttcggttacgggtccgaccggtacccggtaagggtcccgtacccggtcccccccggttcggttacccgtacccgttccgttaccccggg

SEQ ID NO: 89924 - DNA, 542 bp, Homo sapiens
  misc_feature: GYAE6OF02GWDGD.21.8.A08.1.454.CMB.1.raw
  modified_base (295)..(295): a, c, t, g, unknown or other
  misc_feature (295)..(295): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctggggggagcatggtccagcctgggaggtccctgagcctctcctgtgcagcgtctggattcagtatcggctcctttgcccatgcactgggtccnccaggctccaggcaaggggctgggaggtggggtggcgtattatcgtggtatggatgggaagtggagagattattatcagtacctccggtagaagggccatccaccatcaccagagacatcgaccaaacaacacactgtactaccttacaaatcggaccgcctaggagacgccgaggaccacggctagtgtattcgngtacgngttcgtttggtcgtaggttcggggccacggggtaccctggtaccc

SEQ ID NO: 89925 - DNA, 736 bp, Homo sapiens
  misc_feature: GYAE6OF02G8WUY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggagattcattcgaccaaaagatatacttgtgttaccagcagaagtcacggccacggcccctagtactggtcactccagtgacggccagtcgacgacacgtccggactccgtagagtagtattctcgtacgcctccagctacgagggacagtcggacctacgttgacttagtcgacggtcggggacccagggtacggaacgagtacggaacgtcgtacggtaaccttacgtttaagtttacggttaaccgacctaaacccgtaacggtaaccgtaaggggttaacggttacgggtacctaacgggttaccggggtaacgggggggtttaacgttaccgggggacggggttaaaccggggtaacccgttaaggggttttacccggaacccgggttttccggtttaccgggggtaacccgtaacccgggtaaccccgggttaaacgggttccccgttaccccgggtacccccccggtttaccgggtaccccgtttacccgtttccccggtttacccccgg

SEQ ID NO: 89926 - DNA, 577 bp, Homo sapiens
  misc_feature: GYAE6OF02GS3D0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatccctagagagattctcgtgcctccagctcgagggacaggtcggcccaccttgactagtcgacggtcggggacccagggtcggacgagtaggaacgctaggacttactagttacgttacgctaccgagacaggttagtcggtactagtacggtagggggttacttcgggacggagggtaccgtaggttcgaccggttccgttaggtccgtacgacccgtaaggtcccgtccgcccccgttggtaccctacgtccgttcccgg

SEQ ID NO: 89927 - DNA, 660 bp, Homo sapiens
  misc_feature: GYAE6OF02HZ8F3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctcggtgtcagtcgtcccaggacaaacggccaggactcacctgctcgtggagattcattcgaccaaaaagatatacttgttgtccagcagaagtcagcagccctgtactgtcagtccatgacggccagtcgacgacacgtaccgggacttcccagagagtattctctacgcctcagctacgagggtacagtcggcctacgttgactactgacggtcggggaccctaggtcggagagtaggaacgtcgtacgaaccttaacgttagtttcgttaacccgactaaccgtaacggtaactaacgggttaacgtccggtacgtaaagtccgggtaaaggggggtttacttcggggaaaccgggtacggggtaaccctaaagggtttccgggtacccgttccggttttacgggaccctaacgggtaacccgaacgggttcctaccccgggttccccccggttacggtaccgttaacccgtccggttttcccccgg

SEQ ID NO: 89928 - DNA, 643 bp, Homo sapiens
  misc_feature: GYAE6OF02ITPSZ.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctgganattcattgaccaaaagatatacttgttgttccagcagaagtcaggccaggccctgtactggtcatccatgacggccaggtcgacgacacgtcccgggatcccgtgagacgattctctcgcctccaagtcctcgaggacagtcgacctactgactatcgagtcgggacccagggtacggacgtagtacggaagtcgtagtaccttaacgttagtttacggttaaccgactaaccgaacggtacgtaaggttacggttacggttactacgttacgggtaacggggggttacttccggggacgggtaacgggtaaccgtaacggttcggtaaccccggttcgttaccgggtactaaccgggacccgtaaagggtcccgtaccggtccccccgttacgggtaccctaccgttaccgttaccccgg

SEQ ID NO: 89929 - DNA, 646 bp, Homo sapiens
  misc_feature: GYAE6OF02HJUIG.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagccaccctggtgtcagtgtcccaggacaaacggccaggactcactgctctgganattcattgaccaaaaagatatacttgttggttaccagcagaagtcacggccaggccccctgtactggtacatccatgaggccagtcgacgacacgtccggactcccgtagagagtattcctactcgccctcagctcgaagggactaggtcgacctaccgttgacttatcgaggtcggggacccgagggtcggaacgaagtaggaacgtcgtacgaacttaacgttatttacggttaaccgctaacccgagtaacgaggttagtacgggtacaggtacggtaagggggttaacgttcgggaacgggtaacgggtaaccgtaacggtttcggaacccggtttccgttacgggttacctaacggtaccccggtaaggtcccgttacccggacccccccgtttacgggttaccctaccgttcccgtttccccgg

SEQ ID NO: 89930 - DNA, 695 bp, Homo sapiens
  misc_feature: GYAE6OF02G1HE4.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccacccgtcggtgtcagtcgtccccaggacaaacggccaggatcacctgctcgtgganattcattcgaccaaaaagtattatacgttgttcggttaccagcagaagtcgacggccaggtcccctgtacgtggtcatccatggacggccagtcgacgacgaccgtccgggactcccgtagacggtacgtattccgtactcgccctaccagtccgtacgacgggacacggtcggaccctaccgttacgaacttacgtacgtagggtccgggggacccgtaagggtcgggaacgtagtaggaacggcgtacggtaccttaacgttacgtttacggttacccgaccgacctaagacgtaaggttacggtacggtactacggtacggtaggggttacgttccggggaacgggtacggtaaccgtaagggttaccggtaccgttccgtttacgggaccgtaccggacccggtaagggtcccgttaccgggtcccccgttacgggtaccttacccggtcgttaccccggtccccttaccccg

SEQ ID NO: 89931 - DNA, 644 bp, Homo sapiens
  misc_feature: GYAE6OF02GNOGC.21.8.A08.1.454.CMB.1.raw
tcagtcgtcgctcgcacgaccggtgctcgatttagcatactctacagggggctgtgggctcaggaggcagagctctgggaatcctcaccatggcctggacccctctcctgcctccccctcctcactttctgcacagtctctgacggcctcctatgagctgacacagccaccctcggtgtcagtcgtcccaggacaaacggccaggactcacctgctcgtggagattcattcgaccaaaaagatatacgttgttggttccagcagaagtcaggccaggcccctgtactggtcatccatgacggccagtcgacgacaccgtccgggactcccgtagacgagatttctctcgcctcagctcgagggacaggtcggaccctacgttgaactatcgaggtcggggcccgtagggtaggacgtagtaggaacgtcgtagtacttaacttagtttacgtttaccgacaaccaaggtacgtaaggtagttgggtactaacgttacggtaagggggttacgttcgggacgggaacgggtaccgtaaggttccggtaacccggtttccggttcgggtaccgtaaccggtaccccgaacgggtcccgttccggtaccccccgttcgggtacccttaccgttcccgttaccccggg

SEQ ID NO: 89932 - DNA, 527 bp, Homo sapiens
  misc_feature: GYAE6OF02JDWE7.21.8.A08.1.454.CMB.1.raw
  modified_base (422)..(422): a, c, t, g, unknown or other
  misc_feature (422)..(422): n is a, c, g, or t
  modified_base (450)..(450): a, c, t, g, unknown or other
  misc_feature (450)..(450): n is a, c, g, or t
tcagtcgtcgctcgcacgaccggtgctcgatttagcatactctacagggggtgggctcaggaggcagagctctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgcttattggtacaacagaagccaggccaggcccctgtgttagtgatataataaagacactgagacggccctacagagactccctgacgcgtattcgtctcggctcgagctcgaggacagcagtcacgttgaactatcagttagaacgttccaggtacgagtaggacggaggctagaactattacngtacaaagagtaagacagtagagttacncgtagtgggttgtgggcggacggtacaaggtctcggaccgtcgtacgtacgccgtaccgacggccgtccgtaccccg

SEQ ID NO: 89933 - DNA, 578 bp, Homo sapiens
  misc_feature: GYAE6OF02G6RV9.21.8.A08.1.454.CMB.1.raw
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatcacctgctctgganttcattgaccaaaagatatacttgttcgtccaanagaagtcaggccacggtcccctgtactggtcatccagtggacgccaggtcgacgacacgtccgggactcccgtgagagtacttcctctcgccctcacgtctcgagggacagtcggccctacttgacttagtcgaggtccgggcctagggtcggacgtagtgaagtctagaccttattagttcgtacgccacagacagtagtcgtcagtcggagggttacgtcgggacggaacggacgtagttcggtaccgttccggttcggtccacggacccgaacggtccgtcccgccccgtcggtaccctcgttcccgtccgttcccccg

SEQ ID NO: 89934 - DNA, 732 bp, Homo sapiens
  misc_feature: GYAE6OF02IWLD8.21.8.A08.1.454.CMB.1.raw
tcagtcgtcgctcgcacgaccggtgctcgatttagcatactctacagggggctgtgggctcaggaggcagagctctgggaatctcaccatggcctggacccctctccctgcctccccctcctcactttctgcacagtctctgacggcctcctatgagctgacacacgccaccctcggtgtcacgtcgtccccaggaccaaacggccaggactcacctgctctggatatttatgaccaaaagatatacttgttcgtccagcagagtcacggccacggcccctgtactggtcatccagtgacggccaggtcgacgacgacgtccgggacttcccgtgacgagtacttcctctcgccctacgacgcgtacgaacgggtactacgttccggacccctaccgttaggtaaccttaagttccggtaacggggttccggggtaccccggtaaggggtacgggtacggtaaggtaacggtaacggtcgttaacgaaccgtttaactttacgttttacggttacccgtaccgaaacccgtaggaaccgtagggttaacggttacggtacgtaacggtacggggtaagggggttacgttccgggggacgggtaacggggtaaccggtaacgggtttcggtacccggtttccggttgggtaacccgaccggtacccgtaacgggcccgttacccggtcccccggttaccggtaccctaccgttcccgttacccgttacccccg

SEQ ID NO: 89935 - DNA, 746 bp, Homo sapiens
  misc_feature: GYAE6OF02HG2IH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggactcacctgctcgtggagtattcattgaccaaaagaatatacttgttggttccagcagaagtcaggccaggccccctgtactggtcatccagtcgaggccagtcgacgacacgtccgggatcccgtgagacgtattctcgtgcctccagcctacgacggggtacacggtcggaccctacgtttacggaccttaacgtacgtacggggtcggggaccccgtaggggtacgggaaccggtagttacggaaacgtccgttacgaaccgtttaaccgttaagtttcggttaaccgaccctaacccggtaacggtaccgtaacggttacggttacggtaccgttaaggttccgggttaaagggggggtttacgtttacccggggaacggggtaaccggggtaaccgttaacgggttttccgggaaccccgggtttaccggttccggggttaccgtaaccggtaccccggaaacgggttccccggttacccggttaccccccggttaccggggtaccccttacccggttccccggtttacccccggg

SEQ ID NO: 89936 - DNA, 652 bp, Homo sapiens
  misc_feature: GYAE6OF02ISMDB.21.8.A08.1.454.CMB.1.raw
  modified_base (125)..(125): a, c, t, g, unknown or other
  misc_feature (125)..(125): n is a, c, g, or t
  modified_base (335)..(335): a, c, t, g, unknown or other
  misc_feature (335)..(335): n is a, c, g, or t
tcagtcgtcgctcgcacgaccggtgctcgatttagcatactctacagggggtgggctcaggaggcagagctctgggaatctcaccatggcctggacccctctcctgctccccctcctcactttcngcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgacggccagtccgacgacaccgtccgggatcccgtagagagtatttccncgtcgccctaccgacgtcctacgaagggactagggtccggaccctaccgttgaaccttagtccggaggtcggggacccgtagggtcggaacgagtaggaacgtcgtacgtaacttaacttagttacgttaccgaccaaccgagtaacgtaggttagtacggtacagtacgggtaagggggttacgttccggggacgggaaggtaacccgtaaggttccggtacccgttaccgtttcgggtaacaccggtacccgaaggtcccgtcccgtcccccgttacggtaccctaccgttccttcccggttccccctaaccccg

SEQ ID NO: 89937 - DNA, 640 bp, Homo sapiens
  misc_feature: GYAE6OF02IMFCU.21.8.A08.1.454.CMB.1.raw
  modified_base (104)..(104): a, c, t, g, unknown or other
  misc_feature (104)..(104): n is a, c, g, or t
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctntcctgcctccccctcctcactttctgcacagtctctgaggcctcctatgagctgacacagcccaccctggtntcagtgtccccaggacaacggccaggactcacctgctcgtggagtattcattgaccaaaaagatatacgttgttcggttccagcagaagtcaggccaggcccctgtactggtcatccagtgacggccagtcgacgacaccgtccgggatcccgtagagagtacttctctcgccctccgagcgtacgagggacaggtcggaccctaccttgaaccttatcgagggtccggggacccgaggggtacggacgtagtaggaagtccgtaggtaaccttacgttaagtttacgttaaccgccaaccgagacgtaaggtaggttacggtactagttacgggtaggggttacgtcggggacgggtaacgggaccgttacggttccggtacccggtcggtttcgggtacgaccggtacccgaacgggtcctacccggtcccccgttcggtaccctaccgttccgttccccgg

SEQ ID NO: 89938 - DNA, 622 bp, Homo sapiens
  misc_feature: GYAE6OF02F7E99.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagatatacttgttgttccagcagaagtcaggccaggcccctgtactggtcatccatgaggccagtcgacgacacgtccgggatcccgtagagagtatttctctcggccctccagctcgagggacaggtcggacctaccgttgaactatcgaggtcggggcccagggtcggacgatggaaagtcgtagacttacttagttcgttaccgaccaccagtaacctaggttacgtggtaccagttacggagggggttacttccggggacgggtacgggtaaccgtacggttacggtacccggtttccggttacgggtaccgtaacgggtaccccgtaacgggtccttcccgggtaccccccgttcgggttaccctaccgttcccgttaccccgg

SEQ ID NO: 89939 - DNA, 717 bp, Homo sapiens
  misc_feature: GYAE6OF02FLOSX.21.8.A08.1.454.CMB.1.raw
  modified_base (433)..(433): a, c, t, g, unknown or other
  misc_feature (433)..(433): n is a, c, g, or t
  modified_base (453)..(453): a, c, t, g, unknown or other
  misc_feature (453)..(453): n is a, c, g, or t
tcagtcgtcgctcgcacgaccggtgctcgatttagcatactctacagggggctggtgggctctaggaggcagacgctctggggaatctcaccgatcggcctagggacccccttcgtccctggctcccccttcctcactttctgcacaggtcttccgtggacggccttccgtataggacgcgtggaacacaagaccctacccgtcgggtcgtcgacgtcgtccccaggactaacggccaaggtacttccgaccctgtcctcgtaggtagtacttcagttcggaaccgaaaaggtattagttaccttaggtttcggttccagtcagaagtcaaggccacggcccctggtactggtcatccatgaggccagtcgacgcacgtccggactcccgtgagtcgtactttctacgtcgtcctccagctcggacgggtacngtcggccctacgttgacctntacgacggtcgggaccgagggtcggacgtagtggaacgcgtacgtacttacgttattcggtacctactaaccgagtaactagggttacggtacgggtactacggttaggtaacggggggttacttacggggacggggtaccgggtaacgttacgggttacggtacccggtttaccgttacgggtaccctaacgggtaccccgtaaggtcccgttacccgggaccccccggtttcgggacccttaccggttcccgttttaccccg

SEQ ID NO: 89940 - DNA, 626 bp, Homo sapiens
  misc_feature: GYAE6OF02IPV19.21.8.A08.1.454.CMB.1.raw
  modified_base (360)..(360): a, c, t, g, unknown or other
  misc_feature (360)..(360): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcactgtctctgaggcctcctatgagctgacacagcccaccctcggtgtcagtcgtccccaggaccaaacggccaggactcacctgctctggagtattcattcgaccaaaagtatatacgttgttggttccagcagagtcaggccacggtcccctgtactggtacactccatggacggccagtccgacgaccacgtccgggactccgtgagacgtacttcgctcgccctacncgctacgacgggactggtcgccctacgtgactagtcgagggtccgggcccgtagggtcggacgagtagaacgcgtagacttacttagttacgtacaccgtaacaacggtactaaggttacgtcgtactacggtacgggtagggttacggttcgggacgggtacgggtaacctagggttccgtacccggttcggtacggtcgaaccggtacccggtaccggcccgttaccggcccccgttacggtaccctaccgttcccgttccccg

SEQ ID NO: 89941 - DNA, 640 bp, Homo sapiens
  misc_feature: GYAE6OF02IAMJ0.21.8.A08.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggntcacctgctctggagattcattgacaaaagatatacttgttgttaccagcaagaagtcaggccacggcccctgtacgtggtcatccagtggagccagtccgacgaccgaccgtccgggactcccgtgaggagtattcctcgtcgccctccgagccttacgaagggtcacgtcggaccctaccttagacctatcgagggtccggggacccgagggtacggacggagtacggaacggtctaggaaccttacgtttaagttacgttaccgacctaccgaagacgtaaggtaggtcgtacgacgttacgggtaaggggttacgttacgggacgggtaagggaccgtaagggttacggtaaccggttccggttacggtcggaaccgacccgtaacggtccgtcccgcccccgttacggtccctaccgttccttccccgg

SEQ ID NO: 89942 - DNA, 620 bp, Homo sapiens
  misc_feature: GYAE6OF02IVO4C.21.8.A08.1.454.CMB.1.raw
  modified_base (353)..(353): a, c, t, g, unknown or other
  misc_feature (353)..(353): n is a, c, g, or t
tcagtcgtcgctcgcacgaccggtgctcgatttagcatactctacagggggctgtgggctcaggaggcagagctctgggaatctcaccatcggcctggacccctctcctgctccccctcctcactttcgtgcacagtctctgaggccctcctatgagctgacacagcccacccgtggtgtcagtcgtccccaaggaccaaacggccaggactccacctgctctggatacttcaagttgaccaaaaagatatacttgttggttccagcaagatcaggccaggcccctgtactaggtcatccatgaggcagtcgacacacgtccgggatcccgtgagagacttctctacgccctnacgctagaggacaggtcgcctacgtgactatcgaggtcgggaccgagggtcgacgtataggaacgtgtacgacttaacgttattacgttaccgactaaccgaacgaacgtaaggttaggtacggtaactacggtacggaagggggtttacgttaccgggacggggtaacgggtaacctaacggttacggacccggtttacgttccgggaacaccggtacccgaagtcccgtaccgtcccccgttacgtcgtacccgtccttaccccg

SEQ ID NO: 89943 - DNA, 556 bp, Homo sapiens
  misc_feature: GYAE6OF02GYBJ7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtgtcagtcgtccccaggacaaacggccaggactcacctgctctggatattcattgaccaaaagaatatacttgttgttccagcagaagtcaggccaggcccctgtactggtcatccagtgacggccagtcgacgacacgtccgggactcccgtgagagtacttctctcgcctcgagctcgagggacaggtcggacctacgttgactactcgaggtcgggcccgaggtcggacgagtagaacgctagaacttaacttagtttacgtacgactacgagacgtagtaggtgtactagtacggtaggggttacgtcggagggacggacgtagttcgaccgttcgtcgcgacgaccgagccgtcgcccgtcggcctacgtctccg

SEQ ID NO: 89944 - DNA, 607 bp, Homo sapiens
  misc_feature: GYAE6OF02IXFHJ.21.8.A08.1.454.CMB.1.raw
  modified_base (219)..(219): a, c, t, g, unknown or other
  misc_feature (219)..(219): n is a, c, g, or t
  modified_base (359)..(359): a, c, t, g, unknown or other
  misc_feature (359)..(359): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaacggccaggatcacctgctctgganattcattgaccaaaagatatacttgtgtccagcagaagtcaggccaggccctgtactggtcatccatgacgccagtcgacgacacgtccgggatcccgtgacgagtactttctcgtcgccctacgagtctacgagggacngtcgacccacgttagactatcgaggtcgggaccgagggtggacgagtagaagtcgtagaccgttaactagtttacgtaccgacaccgaagacgaagttaggtcggtactaagtcgggtaaggggttacgtacgggacgggtaacggaccgtaagttccggtaccggttccgttacggtccgtaacggacccgtaaggtcccggtaccgtcccccggttaccggttcccgtaccgttcccgttacccgg

SEQ ID NO: 89945 - DNA, 626 bp, Homo sapiens
  misc_feature: GYAE6OF02GREY2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccaggcccctgtactggtcatccatgaggccaggtcgatgacacgtccgggactcccgtagaggatatttctcgtcgcccttccgagtcctcgacggggacaggtcggaccctacctttacggaacttacgtaccgagggtcgggggcccctaggggtacggaacgtagtacggaacgcgttacggtaaccttacgttagtttcgttaccgctaaccgagtaccgtaggttacgtggtactagttcggtaagggggttacttacgggacgggtagggtaccgtaaggttcggaccggttccgttacgggtccgacggtacccgtacggccgtccgtcccccggtcggttaccacgttcccg

SEQ ID NO: 89946 - DNA, 567 bp, Homo sapiens
  misc_feature: GYAE6OF02I4II6.21.8.A08.1.454.CMB.1.raw
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaacggccaggatcacctgctctggagattcattgaccaaaagaatatacttgttggttcagcagaagtcaggccacggcccctagtactggtcatccatgaggccagtccgaacgacacgtccgggatcccgtagagagtactttctctgcccctccgagtcctacgaggacaggtcggaccctaacttgaactagtccaggtcgggaccagggtgacgangaagctagacttaatgttcgtacncacaganagtagtgacngtacgaggggttatcgggaggaggaccgtagttcggtaaccgtcgttacggacacggtacccgtaaggccgtcccggtcccccgttcggtacctaccttccgttacccg

SEQ ID NO: 89947 - DNA, 658 bp, Homo sapiens
  misc_feature: GYAE6OF02FMSAS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctggtgtcagtcgtccccaggacaaacggccaggatcacctgctctggagattcattgaccaaaagatatacttgttggtcaagcagaagtcaggccaggccccttgtactggtcatccatgacggccaggtcgacgacaccgtccgggactcccgtagacgagtacttctacgtcgccctccagtctacgacgggactaggtcggaccctaccgttgaactacgtcgaggtcggggacccgtagggtacggacggtagtaggaacgtcgtagtaccttaacgttagttttcggttaacgacctaaccacggtaacgtaggttacggttcggtcgtaagtcgggtaagggggttacgttacggggacgggtacgggtaaccgttaagggttccggtacccggttccggtttacggaccgtaaccggtacccggaacggtccgtacccggtcccccgttccgggtacccttaccgttcccgttaccccg

SEQ ID NO: 89948 - DNA, 732 bp, Homo sapiens
  misc_feature: GYAE6OF02JQ9T8.21.8.A08.1.454.CMB.1.raw
  modified_base (218)..(218): a, c, t, g, unknown or other
  misc_feature (218)..(218): n is a, c, g, or t
  modified_base (340)..(340): a, c, t, g, unknown or other
  misc_feature (340)..(340): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctcctatgagctgacacacgcccacccgtcggtgtcagtcgtccccaggacaaacggccaggatccacctgctcgnggagtattcattcgaccaaaagatattacttgttcggttccagcaagaagtcaggccacggcccctgtactcggtacactccgagtcggacggccgacggtcgacgacaccggtccggtacncccgtgagtacgtacttcctcgtcgccctaccgacgtccgtacgaacggggtacacggtacgggtccctaaccggtttacggaacttacgtaccggtaaggggtcccggggacccgtagggtaccgggtacgtaaggtagggaacgtacgtacggtacgttaacgttgtttacgggttaacaccgtaaccgaacgtaaccgtaggttacggttacggtactaggttacgggtaaggggttacgttccggggaacgggtaccgggtaacgttagggttaccggtaccgttccggttacggtaccggtaccggtacccggtaacggttacccgtccggttacccccgttcggtacccgtaccgtttacccgttcccggtacccccttacccccg

SEQ ID NO: 89949 - DNA, 703 bp, Homo sapiens
  misc_feature: GYAE6OF02H5G02.21.8.A08.1.454.CMB.1.raw
  modified_base (175)..(175): a, c, t, g, unknown or other
  misc_feature (175)..(175): n is a, c, g, or t
tcagtcgtcgctcgcacgaccggtgctcgatttagcatactctacagggggctgtgggctcaggaggcagagctctgggaatctcaccagtggcctggacccctctcctgcctcccctcctcactttctgcacagtctctggaggcctcctatgagctgacacagccacctggtntcagtcgtcccaggacaaacggcaggactcacctgctcgtggatattcattcgaaccaaaaagattatacttgttggtccagcagacgtcaggccaggccctgtactggtcatccatgagccagtcacgactacgtccgggatcccgtaggaagagtatttccgtacgtcgtcccctaccgacgtcctacggaacgggactagggtcccgaccctaccgttggtaaccttagtacgacgggtcggggaccccgtagggtacggaacgtagtacgaacggtcgtacgtaacttaacgtttaagtttacgttaaccgacaaccgtaacgacgtaaggttacggtacgggtacgtaggttacgggtagggggtttaacggtaccggggtacggggtaacggggtaaccgtaacgggtttaccggtaacccggtttccggttacgggtaccgtaaccggtacccgtaacgggtcccggttacccggtaccccccggttaccgggtacccgttacccgttccgtttaccccgg

SEQ ID NO: 89950 - DNA, 707 bp, Homo sapiens
  misc_feature: GYAE6OF02HSIQ1.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctgcacagtctctgacggcctcctatgagctgacacacgcccaccctcggtgtcagtcgtcccaggacaaacggcaggactccacctgctcgtggganattcattcgaccaaaagtatatacttgttcgttccagcaagagtcaggccacggccctgtactggtcatccagtcgagccagtcacgacacgtccgggactccgagagagtattcgtctcgcctacacgtctacggaggactaggtcggaccctacgtttgaactacgtacgacgggttcgggacccgtaggggtacggacgtagtacggaacggtctacgtaacgtttaacttacggttttacggttaaccgacctaaccgaacggtaacgtagggttaacgttcgggttacaacgggttacgggtaacgggggggttttacgtacgggggaccgggtaacggggtaaccggtaacgggtttaccggttaacccggttcccggtttaagggtacccgtaaccgggtaaccccggtaacggggtcccttccccgggtaccccccggttaccggggttaccctaccggtttcccgttacccccgg

SEQ ID NO: 89951 - DNA, 684 bp, Homo sapiens
  misc_feature: GYAE6OF02I45AH.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacagccaccctcggtgtcagtcgtccccaggacaaacggccaggatcacctgctctgganattcattgaccaaaagatatacttgttggtcagcagaagtcaggccaggccctgactggtcatccatgacgccagtacgacgacaccgtccggatcccgtagacgagtattcctctcgtccctaccaggtcctacgaaggggacctacggtcggtacccaaccgtttgaacttactcgacgggtcggggacccgtagggtacgggaacggtacgtagggaaacgtctaggtaaccttacgttacgtttacggttaaccgacgtaaccgaacggtaacgaagggttacggttacggtaccaaggttaccgggtaagggggttacggttaccggggtacgggaacggggtaacccgtaaggttacggtacccgggttacggtttaccgggtcgttaaccggacccggtaacgggtcccgtacccggtcccccggttcggtacccggttaccttcccggttaccccgg

SEQ ID NO: 89952 - DNA, 594 bp, Homo sapiens
  misc_feature: GYAE6OF02G2DAA.21.8.A08.1.454.CMB.1.raw
  modified_base (177)..(177): a, c, t, g, unknown or other
  misc_feature (177)..(177): n is a, c, g, or t
  modified_base (491)..(491): a, c, t, g, unknown or other
  misc_feature (491)..(491): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtntcagtcgtccccaggacaaacggccaggatcactgctctggagtattcattcgaccaaaaagatatacttgttcggttccagcaagaagtcaggccaggcccctgtactggtcatccagtgacggccagtccgaacgacaccgtccggggatccccgtgagagtacttctctcggccctcagctcgagggacaggtcggacctacgttcgactactcgacgggtcggggacccagggtacgggacgagtacggaacgtcgtcgtaacttacgttagtttacgttaccgctaaccgagacgtaggttaggtcgtnagttcgagggggttactcgggacgggacgggaactacggttcggaccgtcggttacggacacgaccgaaggccgtccgccccgttcggcctccgtcgttcccg

SEQ ID NO: 89953 - DNA, 692 bp, Homo sapiens
  misc_feature: GYAE6OF02JED4N.21.8.A08.1.454.CMB.1.raw
  modified_base (129)..(129): a, c, t, g, unknown or other
  misc_feature (129)..(129): n is a, c, g, or t
  modified_base (179)..(179): a, c, t, g, unknown or other
  misc_feature (179)..(179): n is a, c, g, or t
  modified_base (227)..(227): a, c, t, g, unknown or other
  misc_feature (227)..(227): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgacggcctcctatgagctgacacacgcccacccgtggtntcagtcgtccccaggaacaaacggccaggactcaccgtgctcgtgganttcattcgaaccaaaagtatatacgtttgtggtaccagacgaagacgtcaggccacggcccctagtactggtcactcagtcgacgcacgtcgacgacaccgtcggactccgtagagagtcttacctctcgcctcgacgtctacggaggactaggtcgccctacgttgactagtcgagggtccgggaccgtaggggtacgactagtacgaacgtcgtaacgtacttaactttagttacggtaccaccgtaaaccgtagggtaaaccgtaagggtttaccggtacggttacgtaacggttacggggttaagggggttaaccgttccgggaacggggtaaccggaaccgttacgggtttacccggaccggttttcccggttaggacccggtaaccgtaacccggtaccggtcccgttaccccggtcccccgttacgggttaccccttacccggttcccgttaccccgg

SEQ ID NO: 89954 - DNA, 656 bp, Homo sapiens
  misc_feature: GYAE6OF02FQDP4.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganattcattgaccaaaagaatatacttgttggttccagcagaagtcaggccaggcccctgtactggtcatccatgacggccagtcgacgacactccgggatcccgtgagagtacttctctcgcctccagctacgagggacaggtcggaccctacgttgacttatcgagggtcggggaccctagggtcgggaacgtagtaggaacgtcgtagtaaccttacgttagtttacgttaccgacgtaaccgacgtactaaggttacgttaggtaccgtaacgttacgggtaagggggttacttccggggacgggtaacgggtaaccgtaagggttccgtacccggttccggttacgggtacctaaccgggaccccgtaacgggtcccgtcccggtcccccgttacggttacccgaccgtttcccgttcccggttcccccgtcccccg

SEQ ID NO: 89955 - DNA, 736 bp, Homo sapiens
  misc_feature: GYAE6OF02IIUGN.21.8.A08.1.454.CMB.1.raw
tcagtcgtcgctcgcacgaccggtgctcgatttagcatactctacagggggctgtgggctcaggaggcagagctctgggaatctcaccatggcctcggaccccctctcctgcctcccccctcctctactttctgcacagtctctgaggcctcctatgagcctgacacacgcccacccgtcggtgtacaggtccgtaccccgaaggaaccgaaaacggccaaggactccaccgtgctcgtagggatacttcattacgaaaccaaaaagtaatacttacgtttggttacggtacccaggacaaggtaagtccgaacggccgaccggtcccctaggtaccttgggaccacgtccagtcggacggtccaggtaccgaacgacaccggtccgggaacttcccgagtagacgttattccgcgtcaccccgttacacgtaccgtacggaacgggtaactagggttacccgacccgttaccgttaggaccttaagtacgtacgggtccggggaccggtaacggtcgggaacgtaagtacggaacgtacgtacgtaacgttacttaagttacgtaccgacgtaccgaagtacgtaaggttacgtacgtacgtagtaccgggttagggtaccggtcgggaacgggtacgggtaacgtacggttaccgggtacgttcccggttaggacgaaccggtcccgaaggtccctacccggtcccccgtacgtacccgtcttacccggtcccg

SEQ ID NO: 89956 - DNA, 708 bp, Homo sapiens
  misc_feature: GYAE6OF02H8BX4.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggaccaaacggccaggatcacctgctcgtgganttcattcgacaaaagatatacttgttggtccagcagaagtcaggcaggccctgtactggtcactccatgaggccaggtccgacgaccacgtccgggacttcccgtaggagacgtattcctcgtcgccctcgacgtctcggaaggggtcaaggttccggaccctaccgttgaaccttagtacgtacgggtcggggacccctaggggtacgggaacgtagtcggaaacggtcgtacgtaacgttacgttaagtttcggttaaccgcgtaaccgacggtaacgtaacggttagggtcgtaccgtacggttaccggtaacggggggttacttaccgggggaacgggtaacggggtaacccgttaaggtttcccgggtaaccggttcccggttacgggttacccgtaacccgggtaacccgtaaacgggtccccgttacccggtaccccccggttaccgggttaccctaccccggtttccgtttcccccggg

SEQ ID NO: 89957 - DNA, 620 bp, Homo sapiens
  misc_feature: GYAE6OF02GMWYM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctcgtggatattcattgaccaaaaagatatacttgttggttccagcagaagtcaggccaggcccctgtactggtcatccatgacggccagtcgacgacacgtccgggatcccgtgacgagtacttcctcgtcgcctccagtcctacgacgggacaggtcggaccctacgttcgacttacgtcgtacgggtcggggacccgtagggtcggacgtagtacggaacgtccgtagtaacttacgttagttacggttaccgacctaaccgagtacgtaggtaggtcgtacgtagtacggtaggggttacgtcgggacgggacggtaccgtacggttcggtaccgttcggttacggtcgaccgacccgtacggtccgtccggtcccccgtcggtaccgtaccgtccgttcccgg

SEQ ID NO: 89958 - DNA, 605 bp, Homo sapiens
  misc_feature: GYAE6OF02GZ60P.21.8.A08.1.454.CMB.1.raw
  modified_base (480)..(480): a, c, t, g, unknown or other
  misc_feature (480)..(480): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgcccaccctggtgtcagtcgtccccaggaccaaacggccaggactccacctgctcgtggagtacttcattcgaccaaaaagtattatacttggttcggttccagacagtaagtcgacggccgacggccccgtagtactggtcatccagtcgacggccagtcgacgacaccgtccggactcccgtagagagtacttcgtctcgcctccacgctacggacgggacaggtccgcctaccttcgtaactacgtacgacgggtccgggcccgagggtcgggacgtagtacggaagtctagtaacttacttagtttacgtacncgacctagactagtagtagtcagtcggagggttcgtacgggacggacggtacgtacggtcgtaccggtcgttacggtacgacgaccgacggtccgtccgccccgttcggaccttccgtcctcccg

SEQ ID NO: 89959 - DNA, 565 bp, Homo sapiens
  misc_feature: GYAE6OF02FOLWX.21.8.A08.1.454.CMB.1.raw
  modified_base (456)..(456): a, c, t, g, unknown or other
  misc_feature (456)..(456): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctgtactggtcatccatgaggccagtcgacgacacgtccgggatcccctgagagattctctcgcctccagctcgagggacaggtcggcccaccgttgactatcaggtcggggcccgagggtacgggacgagtggaagcgtagaccttaactattgttaccgcaccagactagtagtcggtnagtcggtaggggtagtcgggacgggagggtaccgtaggttcgaccggttcgtacggtcgacggcccgaaggccgtccggtcccccgtcggtcctaccgtcgttaccccg

SEQ ID NO: 89960 - DNA, 648 bp, Homo sapiens
  misc_feature: GYAE6OF02GHRK8.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacaccccaccctcggtgtcagtcgtccccaggacaaacggccaggatcacctgctctgganattcattgaccaaaagatatacttgttggttccagcagaagtcaggccaggcccctgtactggtcactccatgaggccagtccgacgacaccgtccgggatcccgtagacgagtacttctctcgccctccgacgtcctcgagggacaggtcgccctacgttgactatcgaggtcggggcccagggtcggacgagtgaacgctagaccttacttattcgtaccgcaaccgagtaaccgaggttagtcggtactagtacgggtaacgggggttacttcggggacgggtaacgggaaccgtaacggtttcgggtaacccgttccggtttcgggtacccgtaccgggaaccccggtaagggtcccgttaccccgggtaccccccgttaccgggttacccacccggttttcccgtacccggtttacccccccg

SEQ ID NO: 89961 - DNA, 815 bp, Homo sapiens
  misc_feature: GYAE6OF02HXHD8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaccacacgcccaccctcggtgtcagttcgtccccgaaggaccaaaacggccgaaggactcacctgctcgtggatattcattacgaaccaaaaagtaattaattacgtttgttcggttaccagactaaggaacgtcaacgggccgaccgggtcccccttaggtaaccgttggtacctaactccgagttcggacgggccgtaaggtccggaaccgaacctaccggtacccggggtacttcccgtaggaacggtacgtactttcctcgtcggccccttaccgacggtccctacgggaacggggtactacggggtcgtaccctaccgttacggacttaacgtaccgtacgggggttccggggaccccggagggtacggaacgtagtacgggaacgtaccgtaggtaaccttaacgttaacgtttacggttaaccgacctaaaccgaacggtaacgttaacggttaacgggtcggtaccgtaagttaccggggtaagggggggtttaccggtacggggtaccgggggtaacgggtaacccgttaacggggtttccggtaacccggttcggttttacggaccggtaaccggtacccggtaacggtccggttccccggtacccccggttacggtaccccgttacccgttacccgtttcccccgg

SEQ ID NO: 89962 - DNA, 540 bp, Homo sapiens
  misc_feature: GYAE6OF02GGZ79.21.8.A08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagcatactctacagggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtggggggagcatggtccagccgtggggacggtccctgancctctcctgtgcaggcgtctggattcagtatcggcttcttgccatgcactgggtcccgccaggcctccgaggcgaaggggcgtgggaggtgggtgggcgtaattagtcgtggtatgagtggaagtgagagtatattatcacgtactcgtaggaacgggtcgattcacctatctccagacgacatacgaccaacaacacactgtactctacaatcgaccgctagagacgcgagacacgtactatgtacttacgtagtacgtagtcttggtactaggtcgggcacgggtacctggtaccg

SEQ ID NO: 89963 - DNA, 658 bp, Homo sapiens
  misc_feature: GYAE6OF02HRW7P.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctctatgagctgacacacgccaccctcggtntcagtcgtcccaggaccaaacggccaggactcacctgctctggatacttcattcgaccaaaaagatatacgttgttggttccagcagaagtcaggccaggcccctgtactggtcatccatggacggccagtccgacgacaccgtccgggaactccccgtgagagtacttctctcggccctccagcctacgaacgggacacggtcggaccctaccgttagaccttagtacgtacgggtccggggacccgagggtacgggaacgtagtacggaaacgtcgtacggaaccttacgtagtttacggttaaccgctaaccgtaacgacgtaaggttacggttacggtactaagttacggtaagggggtttacgttaccgggacgggtaacgggtaaccgtaggtttccggtaacccggttcgttcggtaccggtacgacccggaaggtccgtccggcccccgttcggtcctaccgtcccttccccgg

SEQ ID NO: 89964 - DNA, 724 bp, Homo sapiens
  misc_feature: GYAE6OF02G75OG.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtgganattcattcgaaccaaaaagtaattattacgttggttacggttaccagacaagtaagtcacggccacggtccccgtgtacgtggtacactacctagtaggacggaccaggtaccgaacgaccgtaaccgtcccgggacttccccgtaggaacgtagtactttcctacgtccgtccctaccgacgtcctacggaacggggacctacgggtcggacccgttaccgtttacggaaccttacgtacggtaacggggtcccgggggacccgtaaggggtacgggaacgtaacggtacggaacggtacccgttaacggaaccttacgtttaacgtttacggttaccgacctaacgaagtaacgtacgttaagcgggtactacggtacgggtaggggttacgtacgggtacgggaacggtaccgtaagggttccgtaacccggttcggttacggtaccgaccgtaccgtaccggtcgtacccggtccctacggtcctacgtccttcccgg

SEQ ID NO: 89965 - DNA, 704 bp, Homo sapiens
  misc_feature: GYAE6OF02GFQ7F.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgtgttccagcagatcaggccaggcccctgtactggtcatccagtcgaggccagtcgacgacaccgtccggggactcccgtagagacgtacttcctctcgccctccagctacgaggactagtcggcctaccgttgaactacgtcgaggtcggggcccgtagggtacgggacgtagtaggaacgtcgtacggtaaccttaacgttacgtttacgttaaccgtaccaacccggtaagaaccgtaacgggttaggttacgggtaccgtaaggttaccgggaggggggtttaacgttccgggggtaacggggaaccggggtaacccgttaagggtttaccgggtaacccggtttcccggttttacgggtaccggtaaccgggtaccccggtaacgggtcccggttaccccgggtacccccccggttccgggttaccccgttacccggttcccgtttcccccggg

SEQ ID NO: 89966 - DNA, 805 bp, Homo sapiens
  misc_feature: GYAE6OF02H4T4B.21.8.A08.1.454.CMB.1.raw
  modified_base (128)..(128): a, c, t, g, unknown or other
  misc_feature (128)..(128): n is a, c, g, or t
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgacggcctcctatgacgctgacacacgcccacccgtggtntcagtcgtcccaggacaacggcaggactcactgctcgtggatattcattcgaacaaaagtattattacgtttggttacggttccagtacaagacgtacacggccacggtcccctgtacgtcggtcactccagtggacgccagtccgacgacaccgtccgggactcccgtaggagactacgtttcctacgtcgtaccctcgacgtcttacggaacggctagggtaccggacccgttaaccgtttacggtaaacccttaggtaccggtacggggtaccgggggtaccccgtaaggggtacgggtaacgtaaggtacggtaacgtacgttacggttaaccgttacgtttaacgtttacggttaacccgaccgtaaccgaacgttaacgtaacgggttacggttacgggttaaccgtaacgggttaccggggttaagggggggtttaaccggttacgggggaacccgggttaaccggggtaaaccggttacgggtttaacccgggtaccccggtttaccggtttaccgggtacccggtaaaccgggtaccccgtaaccggggttacccgttccccgggtacccccccggttaccgggtttaccgtaccccggttaccgtttccccccggg

SEQ ID NO: 89967 - DNA, 610 bp, Homo sapiens
  misc_feature: GYAE6OF02ICWYA.21.8.A08.1.454.CMB.1.raw
  modified_base (222)..(222): a, c, t, g, unknown or other
  misc_feature (222)..(222): n is a, c, g, or t
  modified_base (346)..(346): a, c, t, g, unknown or other
  misc_feature (346)..(346): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggganattcattcgacaaaagtatatacttggttgttccagcagtaagtcaggaccacggcccctgtactggtcactccagtggacgcagtcgacgacacgtccgggactccgtgacgagtatcctctntccctcacgctcgaggacagtcgcctactgactagtcgacggtcgggaccgtagggtacggacgagtacggaacgtctacgtaacttaacgtttacgttaggttaccgacaaccgagaaccgtaggttacggtgtacgaagtcgggtaacggggtactcggggacggaacggggtaacctacggttacggtacccggttcggttacggtaccgacccggtaccgtacggcctccggccccgttcggaccctccgtcttaccccg

SEQ ID NO: 89968 - DNA, 651 bp, Homo sapiens
  misc_feature: GYAE6OF02J0DDA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgccaccctcggtgtcagtgtccccaggacaaacggccaggatccacctgctctggagtattcatgaccaaaaagattatacttgttcggttccagcaagaagtcgaggccacggtccctgtactggtcatccatgacgccagtccgacgacgactccggggaacttccccgaggaagtactacgtttcctcgtcgtccctacacggtctaccgaggggacctaggtccgacctaccgtttgaaccttagtacgacggtacgggacccgtaagggtggaacgtatacgggaagctacgacttacttagttacgtacgcacgacgataggtagtcgtaactgtcgggttagggtacgttcggaacgggtacgggtaacctaaggttccggtaacccggttccgttaacggggtccctaacgggtaccccgtaacgggccgttaccccggacccccggttcccgggttaacacccgttccgttaccccggg

SEQ ID NO: 89969 - DNA, 636 bp, Homo sapiens
  misc_feature: GYAE6OF02I4AQK.21.8.A08.1.454.CMB.1.raw
  modified_base (343)..(343): a, c, t, g, unknown or other
  misc_feature (343)..(343): n is a, c, g, or t
  modified_base (543)..(543): a, c, t, g, unknown or other
  misc_feature (543)..(543): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggaggccctcctatgagctgacacagcccaccctcggtgtcaggtcgtccccgaggaccaaacggccaggactcgacctgctcgtggagtacttcattcgacctaaaagatatacttgttgttccagcagatcaggccacggcccctgtactggtcactccagtcgacgccagtcgaccgacaccgtccgggatcccgtgganacgtacttcgtcgtcgtcctacgagtccgtacgaggactaggtccggcctaaccgttcgaaccgttagtaccgacgggttccgggaccgttagggtcggacgagtacggaacgcgttacgacctttacgtagtttacggttaccaccgtaaccgagaacgtagttacggtacggtcgagtcggaaggggttcgtccgggnggaacgtaccgtagttcggacccgttcggttcggtacgtccgacccgtaacggtcgtcccggtccccgtcggtcccgtaccgtccgttacccg

SEQ ID NO: 89970 - DNA, 603 bp, Homo sapiens
  misc_feature: GYAE6OF02JR2LX.21.8.A08.1.454.CMB.1.raw
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaaccggccaggactcacctgacctcgtggatattcagttcgacctaaaagattatacttgttcggtccagcagaatcaggccacggccctgtacctggtacatccagtgacgcagcacgacncgtcggntcccgtagagacgtacttcncgtcgcctaccganccgtcgaggtcagtcgcctaccgttgaacctgccgtacgggtcgggaccgagggtcggacgtagtacggtaaacgcgtacgtaccttaacgtacgtttacgttaacgccaacccgtagtaaccgaggttaacgtcggtacaacggtcggtagggttacgtacggaccggtagaccgtagttcggaccgttccgttaggacgtccgtaccgaggtccctacgccccgtacgtcctacgtcctaccg

SEQ ID NO: 89971 - DNA, 570 bp, Homo sapiens
  misc_feature: GYAE6OF02IIU85.21.8.A08.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggactcacctgctcgtggatattcattgaccaaaaagatatacttgttggtccagcagagtcaggccaggcccctgtactggtcatccatggacggccagtcgacacacgtccggatcccgngagagtattctctcgcctcgagtctacgagggacaggtcgaccctaccgttgactactcgacgggtcgggaccgagggtcggacgtagtaggaacgtcgtagtacttacgttattacgttaccgacaccgagtactagtaggtgtacagtcgtaggggtcgtcgggacggaggaccaacgtcgtaccgtcgtacggtcgaccgtaccgaacggcctccggccccgtcggacctccgtcctcccgg

SEQ ID NO: 89972 - DNA, 658 bp, Homo sapiens
  misc_feature: GYAE6OF02G5W1B.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatccacctgctcgtggagtacttcagttgaccaaaaagtaatatacttgttcggttccagcagaagtcaggccacggcccctgtaccgtggctactccagtgacggaccacgtccggaacgaccaccgtcccgggacttcccgtaggaagtacgtattccacgttcgccctaccgagcctcggaaggacagttcggacctaccgttagactagtcgtagggtcggggacccgtagggtcggaacgtagtaggaacgcgtacgtaacttacgttagtttacgtaccgcaaccgtagacgtaggtagtcgtacgagtacggtaggggttacgttcgggacggacggaccgtaaggttccggaccgtttaccggttcggtcgaccggtacccgaacgggtccgtcccggtacccccggttcggtaccctaccgttcccgttcccggtccccctaccccgg

SEQ ID NO: 89973 - DNA, 828 bp, Homo sapiens
  misc_feature: GYAE6OF02FUB9I.21.8.A08.1.454.CMB.1.raw
  modified_base (163)..(163): a, c, t, g, unknown or other
  misc_feature (163)..(163): n is a, c, g, or t
  modified_base (238)..(238): a, c, t, g, unknown or other
  misc_feature (238)..(238): n is a, c, g, or t
tcagtcgtcgctcgcacgaccggtgctcgatttagcatactctacagggggctgtgggctcaggtaggccagagactctgggaatcctcaccatggcctggacccctctcctgctcccctctcacttcctgcacagtctctgaggcctctatgagctgaccanacgccctaccgtcggtgtcacgtcgtacccgaaggacaaaccggcccaggactcgacctggcctacgtggaagtnttacgtagttgaacccgaaaaaggtaacttaacttaccgtttagggtttaccggttaccaggaccgtaaacgtaacggttcccaagggtccccaacgggtccccccgttagttaaccccgttgggttacctaaccttacccgtaagtcggtaacgggtcccctaaaggtttccccggaaaaccgaaccggaacccgttacccggggaaacttacccccgttaaggaaccggtaacggtaactttacccgttcccgttacggacccccgtttacccgaacggttacccggtttacgggaccgggggtaaaccgtaacgggttcccggggtacccctaaacccgttttcgggaaacccttaacgtaccgtacggggttacgggggacccccgaaggggttccggaacggtaacgttacgggaacgtcgtacggtaactttacgtagtttacgttaccgtacgactaacgtacgtagtagttagtactagtacgtacggggtactcggtacgtacgggtaccgtaggtacggtaaccgttcgtacggtacgacgtaccgaacgtcgtccgtacccgtcgtcacctacgtcccg

SEQ ID NO: 89974 - DNA, 643 bp, Homo sapiens
  misc_feature: GYAE6OF02H2QRX.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtcctctgaggcctcctatgagctgacacagcccacctcgatgtcagtcgtccccaggacaaacggccaggatcacctgctctgganattcattgaccaaaagatatacttgttcggttccagcagaagtcaggccacggcccctgtacgtggtcatccagtgacggcctaggtccgaacgaccaccgtccgggtaactccccgtaggaagagtactttcctctacgccctccgacgcctacgacgggtacctacgggtccggaccctaaccgttttggaaccttacgttcggacgggttccggggaccccgtagggtcgggacgagtacggaacggtctacggtaaccttaacgttagtttacgttaccgaccaaccgaagtactaaggtagtcgtacgagttcggtaggggtacgttcgggacggtacggtaccgtacggttcggtaccgttcgttcggacgtacgcccgaacggtccgtccgtcccccggtcggtcctacgtcccg

SEQ ID NO: 89975 - DNA, 630 bp, Homo sapiens
  misc_feature: GYAE6OF02H84TU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctctatgagctgacacacgccaccctcggtgtcagtcgtccccaggaccaaacggccaggatcacctgctcgtggatattcattgaccaaaaagtatattacgttgtttggttccagcaagagtcaggccacggcccctgtactggtacactccagtgacggccagtccgacgactaccgtccgggactccctgacgagtattcctcgttcgcctcgacgctacgacgggcagtcggacctacttgaactactcgagggtccgggacccgtagggtacggacgagtacggaagtcgtagaaccttaacgttagtttacgttaccgactaccgaagacgtaagtaggtcgtacgtagtacggtaaggggttacgtcgggacgggtacgggaccgtacgggttacgtaccgtcggttacggtcgaaccggtaccgaacggtccgtacccggtcccccgttacggtacccttacccgtacgttccccgg

SEQ ID NO: 89976 - DNA, 734 bp, Homo sapiens
  misc_feature: GYAE6OF02IGTJI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggatattcattcgaccaaaagatatacttgttggttccagcagagtcaggccacggcccctgtactggtcatccatgacgccagtccgacgacaccgtccgggactcccgtaggagtacgtacttctcgtacggcccttccgacgtcctacggaacggggactacgggtccggaccctaccgtttagaaccttaacgtcgtaacggggttaccgggggaccccgtaggggttacgggacgtaaggtacggaaacgtccgtaaggtaacctttaacgttacgtttacggtttaacccgaccgtaacccgaaggtaaccgtaacggttaagggttcggtaccgtaacgttaccgggtaaggggggtttaacttccggggaacggggtaacgggtaacccgttaagggttaccggtaccccggttccggtttacgggtacccgtaaccggtaccccggtaagggtcccgttcccgggtaccccccggttcgggtaccctacccggtttccgttaacccccgg

SEQ ID NO: 89977 - DNA, 626 bp, Homo sapiens
  misc_feature: GYAE6OF02FT3W7.21.8.A08.1.454.CMB.1.raw
  modified_base (175)..(175): a, c, t, g, unknown or other
  misc_feature (175)..(175): n is a, c, g, or t
  modified_base (452)..(452): a, c, t, g, unknown or other
  misc_feature (452)..(452): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtntcagtcgtccccaggacaaacggccaggactcacctgctcgtggatattcattgaccaaaagattatacttgttggtcagcagaatcaggccacggccctgactggtcatccatgacggccagtcgaccgacaccgtccggactcccgtagagagtacttctacgtcgccctccgtagcgtacgacgggacacggttcggaccctaccgttgaactactcgaacggtcgggccgtagggtcggacgtagtacggaagctagacttatatttcgtacncacgagacgtagttaggtcgtacgtagttacggtaagggggttagttaccgggacgggacgggtaaccgtagggttaccggtacccggttcgttacgggtccctaacgggacccgtaacgggcccgttacccggtcccccggttccggtaccgttacccgtccctttaccccgg

SEQ ID NO: 89978 - DNA, 697 bp, Homo sapiens
  misc_feature: GYAE6OF02FNQ3H.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctcgtgganattcattcgaccaaaagaatatacttgttggtcagcagagtcacggcacggccctgtactggtcactccagtcgaggccagtcgaacgacacgtccgggatcccgtagagtagtattcctacgtcgccctaccgagtacctacgagggactaggtccggaccctaccgttgaccgttagtccgtagggtccggggtacccgaaggggttacgggaaccggtagtacggaacgtccgtaacggtaccttaacgttagtttacgttaacccgaccgtaacctaacggtaacgtaaggtacggttagggtaccgtacgtaccgggtaacgggggttcgttaccggggacgggtaacggggtaccgttaagggttccggttacccggttccggttacggttaccgtaaccggtacccggtaagggtcccgttaccgggtcccccgttacgggtacccttacccgttaccgttacccccgg

SEQ ID NO: 89979 - DNA, 640 bp, Homo sapiens
  misc_feature: GYAE6OF02FWU1P.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagaatatacttgttggttccagcagaagtcaggccacggcccctgtactggtcatccatgacgccagtcgacgacacgtccgggactcccgtgagagtacttctctcgcccttccgagtcctacgacgggactaggtcggaccctaccttcggaaccttactacgaggtccggggacccgagggtacggacgtagtaggaacgtcgtacgtaaccttacgttagtttacggtttaccgacctaaccgaacggaacgtaggttaacggttcggtactacgttacgggtagggggttacgttacgggacgggtagggtacgtacgtaacggttacggtacccggttccgtttcgggtacctacggacccgtaacggccgttccggtcccccgtcggtccctacgttcccg

SEQ ID NO: 89980 - DNA, 599 bp, Homo sapiens
  misc_feature: GYAE6OF02GCH4W.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagaatatacttgttgttccagcagagtcaggccacggcccctgtactggtcactccatgacggccagtccgacgacaccgtccgggactcccgtaggagagtattctctcgccctcagctcgagggacagtcggccctaccgttgactactcgtagggtcggggcccgagggtcgggacgagtaggaagtcgtagacttacgttagtttcgttacgccacaagacgaaggtaggtcggtacagttcggtaagggggttacgtcgggacgggagggtaccgtaggttcggacccggttccgttaggtaccgaacggtacccgaaggtcctccggtcccccttcgggtcctaccgttccgttccccg

SEQ ID NO: 89981 - DNA, 596 bp, Homo sapiens
  misc_feature: GYAE6OF02FOX8G.21.8.A08.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacccgtgggtgtccaggtcgtccccaggacaaacggccaggactcacctgctctgganttcattcgaccaaaagatatacgttgttcgtccagcagaagtcaggccacggcccctagtactggtcactccagtgacggccaggtccgacgacaccgtccgggactccccgaggagtacgtactttcctcgtccgacccttaccgaggtccgtaccggaaggggtacctagggtccggaccctaccgttgaaccttacgtaccgtaggggtccggggacccgtaggggtcgggaacgagtacggaacgtcgtacgtacttactagttacgtacgcacagactagtagtcgtcagtcgaggggtctcggacggacgacgtagtcgaccgtcgtgcgacgccgagtcgtccgcccgtcgtctccgtcgtcccg

SEQ ID NO: 89982 - DNA, 595 bp, Homo sapiens
  misc_feature: GYAE6OF02FK972.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagaatatacttgttggttccagcagaagtcaggccaggccccctgtactggtcatccatgaggccagtcgacgacacgtccggggatcccgtgagagattctctggccctccagctcgagggcagtggccaccttgactatcaggtgggcccaggtggacgatgaagtcgtgactacgttattcgtacgacaccgagtacagttagtggtcagtcgagggggttattcgggacgggtacgggaccgtaaggttcggtacccggttaccgtttgggtacctacggaccccgtaagggtcccgttaccggcccccccgttcggggtcctaacccggttcccgttccggttaccccccggtccccccg

SEQ ID NO: 89983 - DNA, 575 bp, Homo sapiens
  misc_feature: GYAE6OF02GPMZ8.21.8.A08.1.454.CMB.1.raw
  modified_base (367)..(367): a, c, t, g, unknown or other
  misc_feature (367)..(367): n is a, c, g, or t
tcagtcgtcgctcgcacgaccggtgctcgatttagcatactctacagggggctgtgggctcaggaggcagagctctgggaatctcaccatggcctggaccccctctccctgcctcccccctcctcacttttctgcacagtctctgaggcctcctatgagctgacacagcccacccctcggtgtcagtgtcccccaggacaaacggccaggatcacctgctctggatattcattgacaaaagatatacttgtttgtcagcagaagtcagccaggcccctgtactggtcatccatgacggccagtcgaacgacacgtccgggatcccgtgagagtacttctctcgaccctcgacgtctacgacgggacnggtcgccgtacgttgaactagtcgtaggtcggggccgaggtcggacgagtaggaagtcctagtacgttactagtttcgttaaccgcaaccgtagaacgtagtacggtgtccagttcggaggggttatcgggacgggtacgtaccgtagttcgaccgttcgtcggtactaccggcgtacgtccgtcgccccgtgtcctacgttctcccg

SEQ ID NO: 89984 - DNA, 781 bp, Homo sapiens
  misc_feature: GYAE6OF02FFPR2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggcctaggatccacctgctcgtggagattcattgaccaaaagatatacttgttgtcagcagaatcaggcaggccctgtactgtcatccatgagccagtcgacgacacgtccgggactccccgtgagagatttcctactcgccctccgagtcctacgaggggacacggtcggaccctaccgtttagaaccttacgttacgaacgggtcggggccccgtaaggggttacgggaacgtagtacggaaggaccgtacggtaaccgtttaacgttaacgttttacggtttaacccggacgtaaacccgtaacggtaaacccgttaaggttaacgggttacgggtttaaccgtaacggtttaccgggttaaacggggggggttaactttacccggggggacgggggtaacccgggggtaacccggttaacggggtttaccggtaaacccccgggttttccccgggtttaacggggttaccccgtaacccgggtacccccggtaaaacggggttccccggtttaccccgggtaaccccccccggtttcggggtttaccccttaccccggttccccggtttaaccccccggg

SEQ ID NO: 89985 - DNA, 665 bp, Homo sapiens
  misc_feature: GYAE6OF02H6GO6.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtcggtgtcagtcgtcccgaggacaacggccagactcactgctcgnggagtatcattcgaaccaaaagatattacgttggttcggttccagtcagaagtcgacggccacggtccccctagtacgtcggtccactccagtggacggccgaggtcgaccgacaccgtaccgggactccgtaggaacgatacttctcgtcgcctcgagctacgaggctaggcgtcctacgtgactagcgtagggtcgggaccgtaggtcggactagagaactcgtataacgttacttaggttacgtaaccgacgaccaaggtacacgggttacggtcggtactaacggttcgggtaacgggggtttataccgggggtacggaacgggtaaccggtaaggtttccggtaaccggttcccggttacgggtaccgaccgggtaccccggaaggttcccgtacccggtacccccgttcgggtaacccttaccggtcccttacccccggg

SEQ ID NO: 89986 - DNA, 565 bp, Homo sapiens
  misc_feature: GYAE6OF02FQ9A9.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggagcatggtccagcctgggaggtccctgagcctctcctgtgcagcgtctggattcagtatcggctcctttgccatgcactgggtccgccaggctccaggcgaaggggctgggagtggggtggcgtattatcgtggtatgatgggaagtggagagtattagtttattcgaagtaccgtccgtaggaacggggcctaagttccaccgtatcctaccgaagtacgaactaacgtcgaacccaaacaaccactactagtactactacaaatcggacccgctaggacgacgcgacgacgacgctagtgtacttcagtacgagttctttggactaggttccgggactacggtacccgtggtacccg

SEQ ID NO: 89987 - DNA, 682 bp, Homo sapiens
  misc_feature: GYAE6OF02IDV9J.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccctcggtntcagtcgtccccgaggaccaaacggccaggactcacctgctcgtggatattcattgaccaaaagaatattacttgttgttccagcagagtcaggccgacggccctgtactggtcactaccagtcgacgccagtcgacgacctacgtcccgggacttcccgagacgacgtacttcctcgtcgacccttcgacgccttacggaacgggtactacggtccgaccctacgttagtactacgtcgacgggtaccggggccccgtagggtacggaacgtagtacggaacgtcgtagaaccgttatttacgttacgttaaccgacctaaccgaagtacgtaaggttacggttcggtacgtaggttacgggtaacgggggtttagtaccggggacgggtaacgggtacccgtaaggttaccggtacccgttcggttacggtaccgaccggtacccgaacgggtccctacccggtcccccggttacggtaccttacccgtccgttacccccgg

SEQ ID NO: 89988 - DNA, 800 bp, Homo sapiens
  misc_feature: GYAE6OF02HPDP9.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctctatgagctgacacacgcccaccctcggtntcagtcgtccccgaggaccaacggccaggactcacctgctcgtggatacttcattcgaaccaaaaagtaattagttactttggttacggttaccagtacaagtaacgtcgaacggtacccacggtcccctaggttaccgtggtaccactccagtacgggacggacctacggtaccggaaccgaaccgtaccggtacccggggtactaccccggtaggaaacgtaaccggttactttccgtcccgttacggtcccccttaccgaacgggtacctacgggaacgggggtacctacgggtacccgggaccccttaacccgtttagggaaccttacgtaccggtaacggggtaccggggacccggtaaggggtaccgggaacggtaagtacggaacggtaccgtacgtaacgttaaccgttagtttacggttaccgaccgtaaccgtaacgacggtaacggttaggtaccggtaccgtacggttacgggtaacggggttacgttacggggaacgggtaaccgggtaccgtaacggttccggtacccggttacggttacggtaccgaacggtacccgaacggtcccgtacccggacccccgttcggtaccctaccgttccgttccccgg

SEQ ID NO: 89989 - DNA, 649 bp, Homo sapiens
  misc_feature: GYAE6OF02IRM4C.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctctggagattcattgaccaaaagatatacttgttggttccagcagaagtcaggccaggcccctgtactggtcatccatgacggccaggtcgacgacacgtccgggatcccgtaggacgagtacttacgtccgtaggcccctccgaagtccgttacgaacggggacctacgggtcggaccctacccgttagaccttaacgtccgagggtcggggacccctagggtacggacgtagtagaacgctagtaacctacgttacgtttcggttaaccgctaaccgaacgacctaggttagttcggtactaagtccgggtaaggggtacgttacgggacggtacgggtaacctaggttacgtcccggttacgtcggttacgaccggtacccggtaacggtccgttacccggccccgttcggtactacccgtcgtttaccccgg

SEQ ID NO: 89990 - DNA, 797 bp, Homo sapiens
  misc_feature: GYAE6OF02JLTGS.21.8.A08.1.454.CMB.1.raw
  modified_base (114)..(114): a, c, t, g, unknown or other
  misc_feature (114)..(114): n is a, c, g, or t
tcagtcgtcgctcgcacgaccggtgctcgatttagcatactctacagggggcgtgtgggcgtcaggaggcgagagctctgggaatctcaccatggcctggacccctctcctcgntccccctcctccactttctgcacagtctctgaggcctcctatgacggcctgacacacgccaccctccggtggtcacgcggttcccgacggaacgaaaccgcccaagggacctaccgacctcgtcctggacggtattcgaacttaggtccaaaaacgttaaagtacttaaacttacgtttaggtttccctacggtacgtacgaaaggtctaagggaacccgtaggaccccggtccgtaacggttccggtacggtactacgtcccaagtcggacctttaaccggggacccgaacggtaccggtaccggtacccggacgttcccgggaaggtaccgtaccgtacgttcgttccgtaccgtccgtaccgtacgtaccggtacggtacgggtacggtaccgggtaccggtacccgtaccggttacgtaccgtacggtacgggtaccgggtacgggtaccgggtacgggtacgggtacgtaaggtacggtacgtacgtacgtaacgttacgttacgttacgtacgacgtacgacgtacgtaggtacgtacggtacgtacggtacgggttaacgggtacgggtacgggtacgggtaacggtacggtacggttaccggtacggtcggttgaccgtaccgtaccggaggtccggtccccggtacccggtccgtaccgtccgttcggtacccg

SEQ ID NO: 89991 - DNA, 659 bp, Homo sapiens
  misc_feature: GYAE6OF02IEOUF.21.8.A08.1.454.CMB.1.raw
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
  modified_base (391)..(391): a, c, t, g, unknown or other
  misc_feature (391)..(391): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtntcagtcgtcccaggacaaacggccaggatcacctgctcgtgganattcattgacaaaagatatacttgttgtccagacagagtcacggccacggccctgtactggtcactccagtcgacggcctaggtaccgacgaccaccgtccgggactcccgtagagagtacttctcgtcgcctaccagctacgacgggacagtcgccctaaccttgaacttntcgaggtcgggccgtagggtggaacgagtaggaacgcgtacgtaaccttacgttagttacgttaccgcgtaaccaacgtaacgtaaggttaacggttcggtaacgtacggtacgggtaacggggggttaacgttccggggacggggaacgggtaaccgtaagggttaccggtaacccggttccggtttacgggtaccgtaaccgggacccgtaacgggtcccttcccggtacccccgttcgggtaccctaccggttccgttccccggg

SEQ ID NO: 89992 - DNA, 711 bp, Homo sapiens
  misc_feature: GYAE6OF02H5XED.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccaccctcggtgtcagtcgtccccgaaggaccaaaccggccaggatccacctgctcgtggagacttcagttacgaaccgaaaaaagtaattacttacgttggttcggttacccagcaaggaacggtcagggccgacggtcccctagtaccgtggtacatccagtcggacgccaggtaccgacgacaccgtccgggactcccgtagagtacgtcttccgtccgtcgccctccgagtccgtacggacgggtacgacgtccggaccctaaccgttcgtaactacgtaccggtacggggtcccgggggtaccgagggtacgggaacggtagtacggaacggtcgtacgtaaccttaacgttacgttacgtaccgactaaccgacgtacgtaaggtaggttacgtactaaggtcgggtaaggggttcgtaccggggacgggtaacgggtacctaacgggttcgtacccggttcggttacggtacgaaccggtacccgtaggtaccgtcccggtaccccgttccgggtaccttacccgttcgttcccccg

SEQ ID NO: 89993 - DNA, 653 bp, Homo sapiens
  misc_feature: GYAE6OF02G6I9C.21.8.A08.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagcatactctacagggggtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacacgtccgggatcccgngagagtattctctcgcctccagctcgaggacaggtcggccaccgttgactacgtcgagggtcggggcccgtagggtacggacggtagtaggaagtcgtaggtaccttaaccgttagtttacggttaaccgaccaacccgaacgtaacaggttaacggttgggtacctaggtacgggtaagggggttacgttaccggggaccggggtaacgggtaaccgtaagggtttaccggtacccgggttaccgtttacgggtccgtaacggaccccgtaacgggccttaccggccccccgttcgggtccctaccgttccgttcccgttcccccgtcccccg

SEQ ID NO: 89994 - DNA, 731 bp, Homo sapiens
  misc_feature: GYAE6OF02GGR9M.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtntcagtcgtccccaggaccaaacggccaggatcacctgctctggatattcattgaccaaaagaatattacttgttggttaccagcagaagtcaggccaggcccctgtactggtcatccatgaggccagtcgacgacacgtccgggatccctggagatatttctctcgtcctccagcctcgaacgggtacaggtccggaccctaccttcgaacttactcgacggtcggggacccgagggtacggacgagtacggaacggtctacggtaaaccttaacgttacgttttacggttaaccgaccgtaaccggtaacggtaaccgtaaggttaacggttcgggtacgttaacggttacgggttaacggggggtttaaccgtttaccgggggaacggggtaaccggggtaacccggttaacgggtttacccgggtaacccggttttaccgggtttacgggtacccggtaacccgggtaacccccggtaacgggtacccgttccccgggttacccccccggttacgggttaccccgttacccggtttcccgtttacccccggg

SEQ ID NO: 89995 - DNA, 833 bp, Homo sapiens
  misc_feature: GYAE6OF02HD6WI.21.8.A08.1.454.CMB.1.raw
tcagtcgtcgctcgcacgaccggtgctcgatttagcatactctacagggggtcgtgtgggctcaggaggcagagctctcgggaatcgttcaccatggcctgggaccccgtctcctgcctccccctcctcgactttctcgcgacagtctctgaggcctccgtatgagctgacacagccaccctggtcgtcagtgtccccaggacaaacggccaggatccacctgctctggagtattcagttgaccgaaaagatatacttgtggttccgagcagaatcaggccaggcccctgtactggtcagtccatggtacggcctagtccgtacgacacgtccgggatccccgtgacgagtacttctcgtcgccctccgacgtcgtaccgagggtactaacgggttccggacccgtaaccgtttcggaacctttaagttaccgtaagggttccgggggaccccccgtaaggggtcgggtaaccggaacggttacggggaaaacgttccgttacgggtaaccgtttaaccgttaacgtttcggtttaaccggaccgtaacccgtaacggtaaccgttaagggtttacgggtttacgggttaccgttaacggttaccgggtttaaacggggggggtttaaacctttccccgggggtaacggggtaacccggggttaacccggtaacgggggttttacccggtaaccccggggtttccccgggttttaccgggggttacccgtaaaccgggtacccccgttaaacggggttcccggtaccccgggttaccccccccggttaccggggtttaccccgtaacccgtttccccggtttaccccccgggg

SEQ ID NO: 89996 - DNA, 610 bp, Homo sapiens
  misc_feature: GYAE6OF02GHEDR.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagccaccctcggtgtcagtgtccccaggacaaacggccaggactcacctgctctgganattcattgaccaaaagatatacttgttggttccagcaagaagtcaggccacggcccctgtactggtcatccagtgacggccagtcgacgacaccgtccgggactcccgtgagagtacttctctcgtcctccagctacgagggactaggtcggccctaccttgaaccttgtcgagggtcgggaccgagggtcggacgagtagaagcgtacgtaacttacttagtttcgttaaccgccaccgaagacgtaaggttagtacggtcaacgttcggtaagggggttattcgggacgggtacggaccgtaggttccgtacccggttcgttacggtaccgaccgtacccgaggccgttaccggtccccccgttcgtcccgttaccgttccgttccccgg

SEQ ID NO: 89997 - DNA, 590 bp, Homo sapiens
  misc_feature: GYAE6OF02F7BJ4.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctggtgtcagtgtccccaggacaaacggccaggactcacctgctctgganattcattcgaccaaaagatatacttgttgtccagcagaagtcacggccaggcccctagtacgtgtacatccagtgacggccaggtccgacgacaccgtccgggatcccgtagagagtacttctctcgcctccgagctcggaaggacacggtcgccctacgtacgtactactcgagggtccggggtacccgagggtacggacgagtcggaacgctacgtaacgttactagtttcgtacgacaccgagacgagtagtcgtcagtacggtaggggttcgtcgggaggacggtaacgtaggttcggacccgttcggttcggtacgacgtaccgaacggccgtccggtccccgtcggtccgtaccttcgtaccccg

SEQ ID NO: 89998 - DNA, 544 bp, Homo sapiens
  misc_feature: GYAE6OF02HQV6Q.21.8.A08.1.454.CMB.1.raw
  modified_base (172)..(172): a, c, t, g, unknown or other
  misc_feature (172)..(172): n is a, c, g, or t
  modified_base (450)..(450): a, c, t, g, unknown or other
  misc_feature (450)..(450): n is a, c, g, or t
  modified_base (524)..(524): a, c, t, g, unknown or other
  misc_feature (524)..(524): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgagcctctatgagctgacacagccacctcggtntcagtgtccccaggacaaacggccaggatcacctgactctggagattcaatttgaccaaaaagtaatatactttgttaggttccagcagaagtcaggccaggcccctgtacgtcggtcatccatgaggccagtcgacgacacgtccgggatccccgtagagagtattctactcgccctccgagtcctacgaacgggacaggtcggacccaaccgtttgaacttatcaggtcggggaccccaagggtggacgagtggaagctgacttactattgttacncacagacgagtagtgtcatcgaggggttactcggacggacggaccagttcgaccgtcttggtcagcccaaggcncgcccctcggtcactctccg

SEQ ID NO: 89999 - DNA, 629 bp, Homo sapiens
  misc_feature: GYAE6OF02JHTY5.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtntcagtcgtccccaggaaccaaacggccaggatcacctgctctggatattcattcgaccaaaagaatatacttgttggttccagcaagaagtcaggccacggcccctgtactggtcatccagtgacggcacgtcgacgactaccgtccggactcccgtagagtagtacttcctcgtccgtccctaccgagccttacggacgggacctagggttccggccctaaccgttcgaccgttactccggtaacgggtccggggacccgtaggggtacggaacgtaagtacggaacgtctaggaccttaacgttagtttacggttacgacctaaccgagacgtagttacgtcggtacacgtacgggtaggggttagtccgggaggacggtaacgagttcgaccggttcgttgtacgacgacccgaggcctccggaccccgtggtcctaccgtccttacccg

SEQ ID NO: 90000 - DNA, 809 bp, Homo sapiens
  misc_feature: GYAE6OF02GPAJJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacgcctctatgagctgacacacgcccacccgtcggtgtcacgtcgtacccccgaaggaccgaaaaccggccaaggactccacctgctcgtggagtattcattcgaaccaaaaagtatattacttgttacgtccagacgaagaagtacgacggccacggtcccctgtactggtacactaccgagtcggacggaccgtaaggtaccgaacgaccgtaaccggtcccgggtactccccggaggaacgacgtacttctacgtgactacctaccgtacgaccgtacgggaacgggtaccgtacggtccgggaacccttacccggtttacgaaccgtttaaccgtacccgggtaccgggggtaccggggaaccccggtaagggggtaacgggtaacgtaacggtaagggtaacccggtacgtaaaccggttaaaccgtttaacgtttaaacggttaccggttaaccgaacccgaaacgtaacggtaacgtaagggttacggtacgtaaccggaaggtttaccggggaaagggggtttaccgtacgggggaccgggtaaacgggtaaccgttaacgggtacccggttcccggttaacggttaccgggtaccaacccggtaaccgtaccggtcccggtaccccttccccggtacgttacccgtaccttaccccgg

SEQ ID NO: 90001 - DNA, 689 bp, Homo sapiens
  misc_feature: GYAE6OF02GBGXF.21.8.A08.1.454.CMB.1.raw
  modified_base (221)..(221): a, c, t, g, unknown or other
  misc_feature (221)..(221): n is a, c, g, or t
  modified_base (337)..(337): a, c, t, g, unknown or other
  misc_feature (337)..(337): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctcgtgganattcattcgacaaagatatacttgttggtcagcagagtcaggccaggcccctgtactggtcatccatgaggcctagtcgaacgacaccgtcgggactcccgtagagacgtattccncgtcgccgttccagcttacgagggactggtaccgcctaccgttgacctagtcgagggtcgggacccgtagggtcggaacgtagtacggaacgtaccgtagtaaaccgttacttaagttttaccggttaacccgacctaaccggtaacgaacgttacggttaggttacggttaacaacggttacggggtaaagggggtttaccgttaccggggaaccggggtaacgggtaccgtaaggtttccgggacccgttttaccggtacgggttaccaacccggtaacccggtaccggtcccggttaccccgtcccccggttacccgtaccgtttaccccgttccggtttacccccccg

SEQ ID NO: 90002 - DNA, 740 bp, Homo sapiens
  misc_feature: GYAE6OF02H2MTY.21.8.A08.1.454.CMB.1.raw
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtntcagtcgtccccaggacaaacggccaggatcactgctcngganattcattgaccaaaagatatacttgttggtccagcagaagtcaggccaggcccctgtactggtnactccatggagccagtcgacgacnccgtcgggacttccgngagagtacttctctcgccctccgagtcctacgagggacaggtccggaccctaccgtttagaaccttagtacgtacgggtcgggggccccgtaaggggtacgggaacggtagttaggaacgtccgttaggtaaccttaccgtttaagttacggtttaacccgacgtaaacccgtaagggtaaccgtaagggttaacggtttacgggttactaaacgggtttaccgggtaagggggggtttacgttaccgggggaacggggtaaccggggtaacccgttaaacgggttttcccgggtaaccccgggtttccggtttacgggtacccgtaacccgggtaaccccggtaacggtccccggttccccggtacccccccgtttacggggtaccccttacccggttacccgtttaccccccggg

SEQ ID NO: 90003 - DNA, 726 bp, Homo sapiens
  misc_feature: GYAE6OF02HBZWY.21.8.A08.1.454.CMB.1.raw
  modified_base (220)..(220): a, c, t, g, unknown or other
  misc_feature (220)..(220): n is a, c, g, or t
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcgggtgtcagtcgtccccaggacaaacggccaggatcacctgctctgganattcattgaccaaaagatatacttgttggttccagcagaagtcaggccacggcccctgtactggtcatccatgaggccagtcgacgacacgtccgggactcccgnggacgagtacttcctcgtcgccctaccacgtcctacggaagggacaggtcggaccctaccgtttacgaaccttacgtcgtacgggtccggggaccccgtaaggggtcgggaacgtagtacggaacgtcgtacgtaaccttaacgtttacgtttacggttaccgaccgtaaccgacggtaacgtaaggttaaggttacggttaccgtaaggttaccgggtaacggggggtttacggtttaccgggggaaccggggttaacggggtaacccgtaaggggtttaccggtaacccgggtttcccgggtttacgggttacccgtaccggtaacccccgggtaaggtcccggttccccggtccccccggttaccgggtacccttacccgttcccggtttacccccgg

SEQ ID NO: 90004 - DNA, 654 bp, Homo sapiens
  misc_feature: GYAE6OF02HFAZT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggactccacctgctcgtggatattcattcgaccaaaagatatacttgttggttccagcagaagtcaggccaggcccctgtactggtcatccatgacggccaggtcgacgacacgtccgggactcccgtgagacgtacttcctcgtcgccctccgagtcctacggacgggtactacggtccggaccctaccgttcgacttaacgtcgtacggggtcggggaccccgtaggggtacggacgtagtacggacgcgtacgtaacttacgttagttacggtaaccgctaaccgagtacgtaggttaaggtcggtactaaggtcggtaagggggttacgttccgggacgggtaacgggaccgtaggttcggtacccggttcggttacggtacgaccggacccgtaacggtccgtacccggtccccgtccggtacctacccgttccgttacccccgg

SEQ ID NO: 90005 - DNA, 624 bp, Homo sapiens
  misc_feature: GYAE6OF02IK9ZQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggatattcattgaccaaaagatatacttgttggtccagcagagtcaggccacgcccctgtactggtacactccagtgacggccaggtcgacgacaccgtccgggactcccgtgacgtacacttctctcgtcctccagctcgagggacaggtcgacctacttgactagtcgaggtcgggaccgagggtacggacgagtacgaacgcgtagtaccttacttacgttcgtacgaccaccgaagacgtaaggttaggtcggtacgtaacgtacggtagggggttacgttacgggacgggtaacgggtaccgtagggttccggtaccggttccgttcgggtaccgtaccggtacccgtaacggtcccgtacccggtcccccggttccggtaccgtaccgtcccgttcccgg

SEQ ID NO: 90006 - DNA, 718 bp, Homo sapiens
  misc_feature: GYAE6OF02J2VQA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctctggatattcattcgaccaaaagatatacttgttcggttcagcagaagtcacggccacggtcccctgtacgtggtcactccatggacgccagtccgacgaccacgtccgggactcccgtgagagtacttcctcgtcgccctccgacgcctacggacggactacggtcggaccctaccgttagaccttagtacgtacgggtccggggtacccgtaggggtcggaacggtagtacggaacgtccgtacgtaaccttaccgttacgtttacggttacccgaccgtaacctacggtaacgtacggttacggttacggtacctaggttaccgggttaagggggttacgttaccggggacggggtaaccggtaaccggttacgggttccggtaacccggttcccggtttacgggtacccgtaacccgggtaccccggtaacgggtccccgttaccccgggtaccccccggttacggttaccccgttacccggttcccgtttaccccccgg

SEQ ID NO: 90007 - DNA, 635 bp, Homo sapiens
  misc_feature: GYAE6OF02HTX6S.21.8.A08.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacacgcccaccgtcggtagtcagtcgtcccaggacaaacggcaggatcacctgctcgtggatacttcaagttcgaacctaaaaaagaattactacgtttgttcggttacaagacaagaagtcaggccacggccctagtactgtcatccagtcggacgccagtcgacgacacgtccgggactccgtagagtagtacttcnctcgcctcgacgtcgtacgaagggtcagtcggacctccgttagacctagtcgtacgggtcgggaccagggtacggacgagtagaacgtcgtagtaacttacgttattcgacgtacacgagtacgtagttagcgtactacggtacgtaggggtacgtcggacgggacggtaaccgtagggttacgaccggttccggtttacggcctaacgggtcccgaagggttccgtccccgggtaccccggtttaccgggtacccttaccgttcccgttacccccg

SEQ ID NO: 90008 - DNA, 683 bp, Homo sapiens
  misc_feature: GYAE6OF02IEEG2.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacagccaccctcggtgtcagtcgtaccccaggacaaacggccaggatcacctgctctgganattcattgaccaaaagatatacttgttggttccagcagagtcaggccaggcccctgtactggtacatccatcgaggccagtcgacgacactccgggactcccgtagagagtattcctctgcccctacagctacgaagggacagtcggccctaccgttgacttactcgacggtcggggaccccgtagggtacgggacgtaagtaggaagtccgtacgtaaccgttaaccttaagttacgtttaaccgactaacccgaacgtaactaacgggtacgttcgggtactaacggttacggtaagggggttaacgtttccggggaacgggtaacggggtaacccggtaacggttaccggttaacccggttcccggtttacgggtaccggtaaccggtaaccccgaacgggtcccgttaccggtcccccccggttacgggttaccccttaccgtaccgtttacccccggg

SEQ ID NO: 90009 - DNA, 680 bp, Homo sapiens
  misc_feature: GYAE6OF02G4X65.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaacggccaggactccacctgctcgtggagtattcagttcgaaccaaaagaatacttacttgttggttccagcaagaagtcaggccaggcccctgtactggtcatccatggacgccagtcgacgacacgtccggactcccgtgagtagtacttctctcgcctccgacgtcctacggagggactacggtcggaccctaaccgttacgacttacgtcgtaacgggtccggggacccgtagggtacgggaacggtagtacggaaacgtcgtacggtaacttaactttagttacggttacgaccgaaccgaagaaccgtaaggtacggttacggtacgtacgttacgggtacggggttaacggttcggaacggggtacgggaaccgtacggttaccggtaaccggttccggttacggtacgaaccggtacccgtaaccggtccgttacccggcccccgttacgggtacccttaccgtccgttaccccgg

SEQ ID NO: 90010 - DNA, 635 bp, Homo sapiens
  misc_feature: GYAE6OF02F8LU0.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctcccccctcctcactttctgcacagtctctgaggcctcctatgagctgacacagcccaccctcggtgtcagtgtccccaggacaaaacggccaggatcacctgctctggagattcattgaccaaaagaatatacttgttggttccagcagaatcaggccaggcccctgtactggtcatccatgaggccagtcgacgacactccgggactccctgagagattctctgcctccagctcgagggacaggtcggacccaccgtttagaccttatacgaacggtcgggggaccccaggggtacgggaacgtagtaggaaagcgtagtaacctacttaagtttacgttacaccgaaccaagaacctaggtaacggtggtacgaagtacggtaagggggttaacgttacgggacgggtaagggaacccgtaaggttacgtaccggttccgttacgggtcgaacggtacccgaacggtccgtaccggtcccccgtacggtaccctaacgtcccgttaccgttcccccgtacccccg

SEQ ID NO: 90011 - DNA, 772 bp, Homo sapiens
  misc_feature: GYAE6OF02JEGRH.21.8.A08.1.454.CMB.1.raw
tcagtcgtcgctcgcacgaccggtgctcgatttagcatactctacagggggggagaggggagcccagcactagaagtcggcggtggtttccattcggtgatcagcgactgaacacagaggactcaccatggagtttgggctggagctggggtttttcctccgttcgctcttttaagacggttgtccagtgtccaggccgccaacgtggtgggagtccgtggggggacggcgagtgggttcccacgtcccgtggggacggtcccgtggacgccctcgtcctggtgcgtaggcgttcgtggatttccgaggttactaccggtcttccgtttgccctagtcgaccacgttcggtacccgccgtaggccgtccgaggtcgaaggggcctgggacgggttgggtcggaccgtagtttacgtcgttagggtagtacgtacggtagggtaacggtaggaggaacgtaacgttacgttttacgttaccgaagtaaccgttaccggtgggtaaaccggggccgtaacgtttaccgaaccgtacgttaccgtacccgaaggtaacgaacgtaattacgaacctaaacctaaacgaacctacgttacgttaacttacttaacgaaacttcgggaacccgtaccgttaggaacgtacggaccgggtaacggtaaccggacggtaccgttaggttacggtaacgtttaacgacggttacgtaaccggttctttacggtacgtaccggttccgggaccgtaacggggaacccgttcgggtaacccg

SEQ ID NO: 90012 - DNA, 608 bp, Homo sapiens
  misc_feature: GYAE6OF02GE62B.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctcggtgtcagtcgtcccaggacaaacggccaggactcacctgctcgtggatattcattgaccaaaagatatacgttgttcggttccagcagaagtcgaggccacggcccctgtactggtcatccagtggacggccaggtcgacgaccaccgtccgggactcccgtagagagtacttctcgtcgccctcagcctacgaggacagtcgcctacgttgactagtcgagggtcgggacccgagggtcggacgtagtaggacgtcgtacgtaacttacgttagtttacgtaccgacaaccgagacgtagtacggtcgtacaggttacggtaggggttactcgggacgggaacggtacgtaggttccggtaccggttcgttacggacgtaccgacccgaaggtcccgtccggtccccgtcggtcctaccgttccgttccccg

SEQ ID NO: 90013 - DNA, 514 bp, Homo sapiens
  misc_feature: GYAE6OF02FG5IE.21.8.A08.1.454.CMB.1.raw
  modified_base (457)..(457): a, c, t, g, unknown or other
  misc_feature (457)..(457): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatcccctgagagattctctgcctccagctcagggacaggtggcccacctttgactatcagtcggggcccagggtcggacgatgaagctgacttactatttgttacgcaccagacagtagtggtcagtcgaggggtattcgggnggagggaccagtcgaccgtcgttggcagcccaaggctcgcccctggtccactctccg

SEQ ID NO: 90014 - DNA, 657 bp, Homo sapiens
  misc_feature: GYAE6OF02H13N9.21.8.A08.1.454.CMB.1.raw
  modified_base (612)..(612): a, c, t, g, unknown or other
  misc_feature (612)..(612): n is a, c, g, or t
tcagtcgtcgctcgcacgaccggtgctcgatttagcatactctacagggggtgggctcaggaggcagaactctgggtgtctcaccatggcctggatccctctacttcctccccctcctcactctctgcacaggctctgaggcctcctatgagctgacacacgcccaccctcggtgtcagtcgtccccgaggacagaccggccaggactccaccgtgctctgcagataggactcgaaccaaaagtaatagtgtactttagttaccggaaccaagagacgcgacggccgacgcccttgtagttagtgtaactaataagtaaaacgacacgtagacggaccgcctagaagacgtaccttccgaggacgtcgtacttccgtcgacggtcctacgagtcgtacgagggactacgacgtacgtcgttaacgtcgtaactacgtacgtacgtacgaacgtacgaggaccgagggacggagaggtctagtacttacgttagacgtaactaaacgtagtaacgagtaaggtaacgtaacggttactacgggttagggttacggtttcgggacggggacgggtaaccgtacggaacggtccggtagtaaccccggttacggnggtacccgaccggaccggtaccgtccgtcccggtccccgttacgg

SEQ ID NO: 90015 - DNA, 700 bp, Homo sapiens
  misc_feature: GYAE6OF02J0GM9.21.8.A08.1.454.CMB.1.raw
  modified_base (235)..(235): a, c, t, g, unknown or other
  misc_feature (235)..(235): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagcctgacacacgccccacccgtcggtgtcagtccgtaccccgaggaaccgaaaccggccgaggtactccaccgtgccttcgngggatacttcagttcgaaccgaaaaagtatacttacgtttggttcggtccagcagaagtcgacggccgacggtcccctgtacgtgtcactccagtcggacgccgacgtaccgaaccgaccgaccgtaccgggtacctcccgtaggacgtatacgttctcgtccgcctcgacgtccgtacggaacggacgtacggtccggaccccttacgtcgtaacttagtccggtaacgggtccggggacccgtagggtacgacgtacgacggacgtcgtactacgttaacgttgttacggtaccaccgacctaggtacgtaggttacggtagtactacggtgggttaacgggttacgtcgggaacgggtacggtaacgttagtccggtaccggttcggttcgggaccgtacggtaccccggtacggtcccgtcccgtaccccggttggtacccttaccgtcccgtttaccccg

SEQ ID NO: 90016 - DNA, 657 bp, Homo sapiens
  misc_feature: GYAE6OF02IY3V7.21.8.A08.1.454.CMB.1.raw
  modified_base (105)..(105): a, c, t, g, unknown or other
  misc_feature (105)..(105): n is a, c, g, or t
tcagtcgtcgctcgcacgaccggtgctcgatttagcatactctacagggggctgtgggctcaggaggcagagcgtctgggaatctcaccatggcctggacccctntcctgcgtccccctcctcactttctggcacaggtctcttgacggcctcctatgagctgactacacgccgaaccctgggtcgtcaacggtcgtaccccgaggacaaaccggccaggatccaccgtgcttctggacacttcattcgaccaaaaagatatacgttgttcggttccaggcaaggaagtcagccaggcccctgactggtcatccatgacggccagtcgacgacacgtccgggatcccgtagagagtacttctctcgccctcagctacgagggaccaggtcggaccctacgtttcgaacttactcgtacgggtcggggacccgtagggtcgggacgtagtaggaagtccgtacgaacttaacgtagtttacggttaaccgccgtaaccgaagaccgtaaggttaggtcggtactagtcggaaggggggttaacttcggggacgggtaacggggtaaccgtaaggttcgaacccggttccgttacggccgtaacggtacccgtaagggtccgtccgacccccgttggtaccctaccgttccgttcccgg

SEQ ID NO: 90017 - DNA, 714 bp, Homo sapiens
  misc_feature: GYAE6OF02FU7HV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgaggccagtcgacgacactccgggatccctgagagattctctgcctccagctcagggacagtcggccacgttgactatcgaggtcggggcccctagggtcgggaccgagttaggaacgtcgtacggtaacttaacgttagtttacggtttaaccggcctaacccgtaaggtaaccgtaaagggttaacgggtttcgggtaccgttaacggttacccgggtaaagggggggggtttaactttaccgggggtaccggggtaaacggggggtaaccccgttaaggggttttaccgggaaccccgggttttcccggtttacgggggttaccctaaccgggtacccccgtaaaggggtcccggttacccgggtaccccccccggttaccgggttaccccgttaaccccgttccggttttaccccccgggg

SEQ ID NO: 90018 - DNA, 682 bp, Homo sapiens
  misc_feature: GYAE6OF02JL8P8.21.8.A08.1.454.CMB.1.raw
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcaggtgtccccgaggaccaaacggccaggactcacctgctcgtgganattcattgaccaaaagaatatacttgttacggttccaggcaggagtcacggccacggcccctgtactggtcataccngtgacgccgagtccgaacgacacgtccggactccgtgagagtacttctcgtcgtacctccgacgtctcggaggactacggtcggtaccctacgttgaacctacgtaccgacgggtcggggacccgagggtccggaacggtaacgttacggaacgtaccgtacggtacctttaaaccgttgtttacggttaaccgtacctaaccgaacgtaacgtagggttaacgtcggtactaacggttacgggaagggggtttaacggtcgggaacgggaacgggtaccgttacggttacggtacccggttcgtttaccggtacgtaccggacccgacgtcccggtacccggttcccccggtacgggtaccctccggttcccgttccccg

SEQ ID NO: 90019 - DNA, 785 bp, Homo sapiens
  misc_feature: GYAE6OF02IP980.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctcccccctcctcactttctgcacagtctctgaggcctcctatgagctgacacagcccaccctcggtgtcagtcgtccccaggaccaacggccaggactcacctgctctggagtattcattgacctaaaagatatacttgttggttccagcagaagtcaaggccaggcccctgtactggtcagtccagtgacggccacgcgacgacacgtccgggacttcccgtgagtagtactttctcgtcgtcctaccgagcccgttacgaacgggacgtcggtaccggtaccctaaccgtttacggaaccttacgtaccggtaacgggggttccggggaccccggtaacgggggttacgggaaacgggtacggttagggaaaccgcggttaacggtaaacccgttttacgtttaacgtttacggtttacccgacccgtaaaccgtacggtaaacctacggggttaaggttacggtaaccgttaacggttaccgggtaaaggggggttttacgggttcccggggtaaggggtaacccgggttaaaccgtaccggttaacgggttacccggttacccggtttaccggttaccggtaccgtaacccggtacccgggtaccgttaccccggtccccggttccccggtaccgttacccgtcccgtttaccccggttccccctttcccccgg

SEQ ID NO: 90020 - DNA, 540 bp, Homo sapiens
  misc_feature: GYAE6OF02GRQV5.21.8.A08.1.454.CMB.1.raw
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtcccccaggacagacggccaggatcacctgctctgcagatggactgaccaaagaaatatgcttattggtaaccaacagaagccgaggccacggcccctgtgttagtgataataataaagacactgagacggccctcagagatcccgtgagcgaattctcgtgggctaccgagctcgacgggacaggcagtcacgttgacttatcaggtagaacgtcgaggcagaggacgaggctagacttatntagacaaangtagacaaggtagtaggtactgagttgggtgtacgggacgggacgggaacctaggcctacggaccggtaccgtaggtaccgaccgccggtaaggccctaccccggg

SEQ ID NO: 90021 - DNA, 684 bp, Homo sapiens
  misc_feature: GYAE6OF02FMXMN.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtntcagtcgtccccaggacaaacggccaggatcacctgctctggatattcattgaccaaaagatatacttgttgtcagcagagtcaggccacggcccctgtactggtcactccatgacgccagtcgaacgacaccgtccggggactcccgtaggaacgacgtattacctcgtcgtccctccgaacgctacgaaggggactaagggtcggaccctaaccgttcgaaccttatacgtaacgggtccggggtacccgtaggggtacgggtacggaagtacgaaacgtccgtacggtaacctttaacgtaatttacggttaaccgtaccgtaaccaacggacgtaaggtaacggttcggtacgtaagtaccggtaagggggtacgttaccgggacgggtaacggggaacccgtaggttacggtaaccggttccggttacggttaccgaacggtacccgaacggtccgtacccggtacccccgttcgggtacccgtaccgttccggttaccccgg

SEQ ID NO: 90022 - DNA, 553 bp, Homo sapiens
  misc_feature: GYAE6OF02F7BJ1.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcactgctctgganattcattgaccaaaagatatacttgttgttccagcagaagtcaggccaggcccctgtactggtcatccatgaggccagtcgacgacactccgggatccctgagagatttctctcgccttccgagtctcgagggacaggtcggcctaccttgactatcaggtcggggccagggtcgacgagtgaagcgtagacgttactacgttgttaccgcgaccagactaggtagtgtacgagtgaggggttacttcgggacggacgggaaccgtagttcggaccggttcgttaggtccgacgacccgacggcgttccgccccgtggtccctacgtccttcccg

SEQ ID NO: 90023 - DNA, 791 bp, Homo sapiens
  misc_feature: GYAE6OF02G71EU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccacccgtcggtgtcaggtcgtccccgaaggaaccgaaacggccaggactccaccgtgctcgtggagacttcattacgaaccgaaaaagtaattacttaccgtttaggtttcggtttaccaaggtaccaaggtaaaggttccgaacggggaccccgaaccgggtccccccttagggttacccgttgggtacctaacgttccccgagttacgggaaccgggtacccgtaacgggttacccgggaaccggaaaccctacccgggttccccgggggtaacttcccccggtaggaacggtacggtaactttccttcgtaccgtccccttaccgacgtccgtaccggaaggggtaaccgtgggtaccgggaccccttaccgttacgtaaccgttactcgacggggtccggggaccccggtaagggtcgggaacgtagtaggaacgtacgtaggtaccttaacgttagtttacgtacgaccaacgacgaacgtagttacgggtactaccgtagtgggtaaggggttacgtcgggacggacggggtactacgggtcgtacccggttcgtcggtacgaccgaccggacggtccgttccggtaaccccgtggtaccctacgttccttaccccgg

SEQ ID NO: 90024 - DNA, 815 bp, Homo sapiens
  misc_feature: GYAE6OF02I3NJ8.21.8.A08.1.454.CMB.1.raw
  modified_base (515)..(515): a, c, t, g, unknown or other
  misc_feature (515)..(515): n is a, c, g, or t
tcagtcgtcgctcgcacgaccggtgctcgatttagcatactctacgagggggctgtgggctcaggaggcaagagctcgtgggaatctcaccatggcctcggacccctctcctcgcctccccctcctctactttctgcactgtctctgacgcctcctatgagctgacacacgcccacccgtcggtgtacagtcgtccccgaggaaccgaaacggccaaggactccacctgcctcgtggagtattcagttcgaaaccaaaaagtaattacttaccgtttggtttacggttaccctaggaccgaaaggtaacggttaccgaacgggccccgaaccgggtcccccgttacggttaaccgtacgggttccaacgttaccctaaaggtcggaacggacccgtacgggttaaccgaaccggtaaccgaacccggttcccggggtaacctttccccgaagggtaacgtaacggttacttcctttacgccctcccgttaccgacggtccgtacgaacgggtacncgtaccggtacctaaccgtttcgaaccgtacgtaccggtacgggtaccgggggtaccgaacggggttacggaaccgttagacggtaaccggtacgtaccgtaacgttacctttaagttcgttacgacccacgagtacgtagttagcgtacgtaacgtacggggtacggtaacggtccgggtagggaaccggtaacgttaccgttacgggtcccgtaccggttaggttaccggaaccggaccgtaacgggttcccttcccggccccggttaaccggtccttaccgtcccggtttaaccccg

SEQ ID NO: 90025 - DNA, 587 bp, Homo sapiens
  misc_feature: GYAE6OF02GMUAI.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatccactgctcgtggagacttnattcgaaccaaaaagtaattattacgtttgtttggttccagcagaagtcaggccaggcccctgtactggtcatccatggacggcagtccgacgacacgtccgggactacccgtggagacgtattctcgtcgtccctcagctcgaagggacaggtcggcctacctcggacttacgtacgaggtcggggaccagggtcggacgtagtgacgtctgtaactagtatttgtaccgcaccagactaggtagtgtactcgtggtaggggttcgttcgggacgggaacggacgtaagggttcgaccgttccgtaggtccacgaccgtacgccgtccgccccgtcgtcctactccgttaccgtcccgtcccc

SEQ ID NO: 90026 - DNA, 644 bp, Homo sapiens
  misc_feature: GYAE6OF02I8C7W.21.8.A08.1.454.CMB.1.raw
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggacggcctcctatgagctgacacacgcccaccctcggtgtcagtcgtcccaggaaccaaaccggccaggactcacctgcctgtggagtattctatcgaaccaaaaagaatattacgttgttcggttaccagacaagaagtccaggcccacggtcccctagtacgtgtcactccgatggacgccgagtcgaacgacacgtcccggtatcccagaagacgtacttctcacgtccctacacgtcacggagggacnggtcgtaccctacgttnaactactcgtacggtcgggacccgacgggtggaacgacgtacggaagtccgtagtaacttaactacgttacgttaccgaccgtaccacggacaggttaggtgtacgtactacgggtagggttacgtacggtaccgggacgggtaaccgtaggttcgtaccgtcggttacggtccgtaccgtaccgaacggttccgtcccgttaccccgtcggtccctacggttccttaccccgg

SEQ ID NO: 90027 - DNA, 711 bp, Homo sapiens
  misc_feature: GYAE6OF02JX39V.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccacctcggtgtcagtcgtcccaggacaacggccaggatcactgctctgganattcagttcgaccaaaagatatacgttgttcgttcagcagagtcaggccaggccctgtactgtcatccatgaggcagtcgacgacacgtccgggactcctggaagcgtagttcctctcggcctcgagtcctacggacggacacggtcgacctacgttcgacttagtcgaggtcgggacccgagggtacgtaacggacgttagaacggtactacggtaaccttacgttaacgtttacgggttaaaccgcctaaaccggtagtaaaccgtaagggttaacggttacgggtaccgtaagggtttaaccgggtaacgggggggttacgttacccggggtaccggggtaacggggtaaccggttaacggttacccgggttacccggttaaccggggttttccggaaccggtaaccggttaccccggtaaacgggtccccgttaccccgggcccccggtttcccgggttaaccgtccccggtttcccggtttaaccccggg

SEQ ID NO: 90028 - DNA, 800 bp, Homo sapiens
  misc_feature: GYAE6OF02ILFPE.21.8.A08.1.454.CMB.1.raw
  modified_base (104)..(104): a, c, t, g, unknown or other
  misc_feature (104)..(104): n is a, c, g, or t
  modified_base (437)..(437): a, c, t, g, unknown or other
  misc_feature (437)..(437): n is a, c, g, or t
tcagtcgtcgctcgcacgaccggtgctcgatttagcatactctacagggggctgtgggctcaggaggcagagctctgggaatctcaccatggcctggacccctntcctgctcccctcctcactttctgcacagtctctgaggcctcctatgagctgacacagccacctggtgtcagtcgtcccaggacaaacggccaggatcacctgctcgtggatacttacattacgaaccaaaaagtactattacgttgttacggttccaaggtactaagaacgttcgaacggtcccgaacggtcccccttaggttaaccgtacggttaccaacgttcccaaggttcggggaaccggtcctaaggtaccgaaccgccgtaacccggttcccggggatttccccgaggaacggtacgtaccgtttccgtacctcggtccctaccgngtacccgtacggaacgggtactaagggttccggtaccctacccgtttagggaacccttagtaccggtaagggtccggggtacccgtaagggttcggaacgtaggtacggaacgtacggttacgtaaccgttacttacgttacggttaaccgacctaaccgaggtaaccgtaggttaccgttaggtaccgtaagttaccgggaaggggtttaacggtacgggtaaccgggtagggttaacctaccgggttaacggtacccggttttccggttacgggttaccggaccggttaaccccggtacggttacccgttccggtaccccccggttacggggtaccttacccgggtttaccgttaccccgg

SEQ ID NO: 90029 - DNA, 739 bp, Homo sapiens
  misc_feature: GYAE6OF02GD04U.21.8.A08.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (326)..(326): a, c, t, g, unknown or other
  misc_feature (326)..(326): n is a, c, g, or t
  modified_base (396)..(396): a, c, t, g, unknown or other
  misc_feature (396)..(396): n is a, c, g, or t
  modified_base (447)..(447): a, c, t, g, unknown or other
  misc_feature (447)..(447): n is a, c, g, or t
  modified_base (726)..(726): a, c, t, g, unknown or other
  misc_feature (726)..(726): n is a, c, g, or t
tcagtcgtcgctcgcacgaccggtgctcgatttagcatactctacaggggcgtggtgggcgtcgaggaggcgagaggcgtcgtgggaagtcgtcaccagtgccgtcgggacccctccgtccctgtcctccccctcctcctacctttcctggccacacgttctcctgaggcctcctagtcgagtcctgaccgacncgaccncccgtacggtcggtcagtcgttcccccgagaacaacgggccaggactcgaccngcgtccaggancgtactnttgaccaaagaattaatacttgtcgttacgagtacgaggtaatacgtacggaccncgggtacccccgtgtaaccgtggttccactccggatggaacggtcctaggcgaacgacacgccggtaccncctaggagacgtcttggacctcgtcctccgactccgttacgaccggtaacngggtcaccccggttacttcgaactctcggtacgtacggggtcccgacgggttacggcgggtaacgtaggtacggttacgacgttaacggttaccgtagtttaccgggtttaaccgtacgaacccggtcgtaaaccgtagggtaaccgttcggggtaacctcgggtaacgggttaccgggggagttacggggtaccggaacggggtccgggtaagtaccggtccgtaacggtttcggaccgtccgaaggttcccgcggttaccggcccctacgggttccnccgttcgtacccg

SEQ ID NO: 90030 - DNA, 643 bp, Homo sapiens
  misc_feature: GYAE6OF02J28ZE.21.8.A08.1.454.CMB.1.raw
  modified_base (220)..(220): a, c, t, g, unknown or other
  misc_feature (220)..(220): n is a, c, g, or t
  modified_base (255)..(255): a, c, t, g, unknown or other
  misc_feature (255)..(255): n is a, c, g, or t
tcagtcgtcgctcgcacgaccggtgctcgatttagcatactctacaggggctgtgggctcaggaggcagagctctgggaatctcaccatggcctggacccctctcctgctccccctcctcactttctgcacagtctctgaggcctcctatgagctgacacagcccaccctcggtgtcagtgtccccaggaccaaacggccaggtatcacctgctctgganattcattgaccaaaagatatacttgttgttcaagnagagtcaggccacggcccctagtacgtcggtactactccagtcggacggccaaggtccgaacgacctaccgtccgggactcccgtgagacgtacttctccgtcgcctccgagtcctacgacgggaactcggtcggacctaccgttgaaccttagtaccgaggtcggggacccgtagggtcgggaaccgtagtacggaacgtcgtaacggtacttaacttaacgttacgttaccgacgaaccgtacggaacgtaggtacgtcggtactaggtacggttaacggggttacgtcggggacggtaacgggtaccgtacggttcgtacccggtcggttacgcgtacgtaccgaacggcgtaccgccccgttacggtccgaccttcgttcccgg

SEQ ID NO: 90031 - DNA, 568 bp, Homo sapiens
  misc_feature: GYAE6OF02HBLHE.21.8.A08.1.454.CMB.1.raw
  modified_base (423)..(423): a, c, t, g, unknown or other
  misc_feature (423)..(423): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggaggcagtggtccagccgtgggacggtccctgacgcctctcctgtgcagcgtctggattcagtatcggcttcctttgcctatcgctacgttcgggtcccgccgaggtcctaccgagggccgaagggggctgggaggtgggtggcgtattatcgtggtatgagtggagtgagagtattattatcgaagtcgtccgtaggaacgggcctattccactntcacagagacaatcgaaccaacacacactgtactctacaatcgaccgctagacgacgacgagacacgtctagtacgtagttacgtcgtaacgtcgttcgtttaggcgtagggttccgggacccgtacgggtacccttggtacccg

SEQ ID NO: 90032 - DNA, 671 bp, Homo sapiens
  misc_feature: GYAE6OF02IPF5Z.21.8.A08.1.454.CMB.1.raw
  modified_base (128)..(128): a, c, t, g, unknown or other
  misc_feature (128)..(128): n is a, c, g, or t
  modified_base (173)..(173): a, c, t, g, unknown or other
  misc_feature (173)..(173): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttcngcacagtctctgagcctctatgagctgacacagccaccctcggtntcagtcgtcccaggacaaacggccaggactcacctgctcgtggatattcattcgaccaaaaagatatacttgttgtaccagcagagtcaggccaggtcccctgtactggcatccatggacgcctagtccgacgaccacgtccggggacttccccgaggaacgagtacttccgtccgtcgtacccctactaacggtccttacggaaggggtaccagttcggaccccttacgttagaccttagtccgtagggtacggggccccgtagggtcgggacgtagtacggaacgtcgtagtacttacgttacgttacggttaaccgtcaccgacgtacgtacggttagttaccggtagtacgtacgggtacgggggttacttacgggacgggtacgggtaaccgtacggttacggtacccggttccggttacggtaccgaccggttacccgacggtcccgtccggtacccccgttccgggtaccctaccggttccgttaccccgg

SEQ ID NO: 90033 - DNA, 770 bp, Homo sapiens
  misc_feature: GYAE6OF02I0SIZ.21.8.A08.1.454.CMB.1.raw
tcagtcgtcgctcgcacgaccggtgctcgatttagcatactctacagggggctgtgggctcaggaggcagagctctgggaatctcaccatggtcctggacccctcgtcctgcctccccctctcactttcctgcacagtctctgaggccttcctatcgagctgacacaggcccacccgtcggtgtcagtcgtccccgaaggaccaaacgggccaggtactaccacctcgcctacgtcgggatattcagttcgaaccaaaaagattacttacttgttacggttccaagctagtacgtacgacggccaccggtccccgtagtaccgttcggtctacctccgagtcggaccggccacggtaccgaacgaccgaccggtaccgggtactccggtaacggataacgtacttctcggtccgccctaccgtagggtctacgggaaggacgtacggccggtaccctaccgttaggacttacgtacggtacgggtaccgggaccgtagggtacggacgtaggtacgacgtcgtagttaccttaagttacgttacggtaccgacgtaaccggacttaaccgtagggttaacgttcggtaacgttaacggtacgggggtttacggggtttacggtaccggggaccggggtaaccgggtaaccgtttaacgggtttcccggtaacccggtttcggttcgggttaaccaaccgggtaccccgtagggtcccgtacccgggttccccgggttaacggtccccttaccggtccccgtttaccccgg

SEQ ID NO: 90034 - DNA, 635 bp, Homo sapiens
  misc_feature: GYAE6OF02GW48X.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttggttccagcagaagtcaggccacggcccctgtactggtcactccagtgaggccaggtcgacgacacgtccgggactcccgtagagagtactttctcgtcgcctccagtctacgagggacaggtcggcctaccgttgactagtcgaggtcggggacccgtagggtcggacgtagtacggaacgtccgtagaaccttacgttacgtttacgttaaccgacaaccgtaagactaaggtacgttcggtactaggtacggtaaggggttacgttacgggacggggtaacggaaccgtagggttccggacccggtttccggttcggtaccgaccggtacccggaaggtcccgtcccggtaccccgttacgggtacctacccgtccttacccccgg

SEQ ID NO: 90035 - DNA, 761 bp, Homo sapiens
  misc_feature: GYAE6OF02IYDPJ.21.8.A08.1.454.CMB.1.raw
  modified_base (173)..(173): a, c, t, g, unknown or other
  misc_feature (173)..(173): n is a, c, g, or t
  modified_base (282)..(282): a, c, t, g, unknown or other
  misc_feature (282)..(282): n is a, c, g, or t
tcagtcgtcgctcgcacgaccggtgctcgatttagcatactctacagggggcgtgtgggcgtcgaggaggcagagctctgggaatctcaccatggcctggacccctctcctcgctccccctcctcacttctgtcacagtctcacgtacggtcctacctatcgagctagacacncgacccgaccgtcggtcgtcgagtcgtaccccgagggtaaccaaacgggtcccgaaggtactccgactggcctcgtagggatacgttacaagttccgaacctaaaagtntacttacgttgtacgtacagtacgagtacgtcgacggcctacggccccgttgtaaccgtcggaacctagacccgtgtacggacgccgtaaggtccccgtaaaccggacttaccgggtacccggtaccttcggacgtacgtattaccgtcgtaccgttccgtccctacggcgtacccggtaggccggactacggggttccacccttacgggtaacttacccgtagtacggtaccggtacgggtaccggtaacgggtacggtaacggtacggtaacgtacggtaccgtaacgtaaccggttaacttaccgttacgttaccgtaacgtaccgacggtacgtagtacggtagtaccgttaggaacgttacggtacggtacggtacgggtaaccggtagggtaccggtaacggttaccggtacggttaccgtcggtaaccgaccggacgtacggtcccgtcgtacccgtaccgtctacgtcccg

SEQ ID NO: 90036 - DNA, 630 bp, Homo sapiens
  misc_feature: GYAE6OF02FUQ0I.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttccagcagaagtcaggccacggcccctgtactggtcatccagtgaggccagtcgacgaccacgtccgggactcccgtggacgagtacttctcgtcgcctccagtctacgacgggacaggtcgcctacttcgactatcgtacggtcgggaccgagggtcggacgagtacgaacgtcgtacgtacttacgttacgtttacgttaccgacctaaccgtaacggacgtaaggttaggtcggttacgtagtcgggtaagggggttacgtaccggggacgggtaacgggaccgtacgggttcggtaccggttccggttacggtacgtaccggtcccggtaaggtccgtccggtcccccgttcggtcccgtaccgttccgttccccgg

SEQ ID NO: 90037 - DNA, 695 bp, Homo sapiens
  misc_feature: GYAE6OF02HZ2LA.21.8.A08.1.454.CMB.1.raw
  modified_base (129)..(129): a, c, t, g, unknown or other
  misc_feature (129)..(129): n is a, c, g, or t
  modified_base (226)..(226): a, c, t, g, unknown or other
  misc_feature (226)..(226): n is a, c, g, or t
  modified_base (364)..(364): a, c, t, g, unknown or other
  misc_feature (364)..(364): n is a, c, g, or t
tcagtcgtcgctcgcacgaccggtgctcgatttagcatactctacagggggctgtgggctcaggaggcagagctctgggaatctcaccatggcctcggacccctctcctgcctccccctctcactttcngcacagtctctggacgccctcctatgagctgacacacgcccaccgtcggtgtcagtcgtcccgaggaccaaacggcaggctcaccgtgctcgtgganttcattcgaaccaaaagatatacgtttgttcggtaccagcagtaagtcgacggccgacggtcccctgtacgtggtacactccagtcggagccgagtacgacgacctaccgtacgggactaccgaggagacgtacttcncgtacgtccctcgacgtcgtacgaacggggtacacgggtcggacccttaccgttagaaccgtagtacggacggtccggggtaccgtagggtcgggacgtaagtcggaacgctagtaaccttaagttacgttacgttaccgacgtacctaacggtacgtacgggttacgtcggtacctaggtacgggttagggtacggtcgggaacgggtaccgggtaacgtacggttaccggtaccgtttacggttacggtaccgaccggttaacccgtagggtaccccgttcccggtaccccgttaccgggttacctacccggttcccgttacccccggg

SEQ ID NO: 90038 - DNA, 753 bp, Homo sapiens
  misc_feature: GYAE6OF02I65OM.21.8.A08.1.454.CMB.1.raw
  modified_base (289)..(289): a, c, t, g, unknown or other
  misc_feature (289)..(289): n is a, c, g, or t
  modified_base (624)..(624): a, c, t, g, unknown or other
  misc_feature (624)..(624): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctgcacagtctctgacggcctctatgagctgacacacgccacctcggtgtcagtcgtccccaggactaacggccaggactaccaccgtgctacgtacggatacttaccagtttcgaaccaaaaagtaattactaccgtttggttcgtccgtagcaagtacggtnacggccgacggtcccctaggtaccgtggtaccacgttccaatcggacggtacccaggtacgtaaccggaacctaaccggtccggggtaaccctccgtaagggtacggaacgttccgtttccttcgccggtaccctccggaagtcctacgggtaacgtaccggtaaggtcgggtaccccaccggttttagacctacgttaccgagggtacccggggtaccggacgggtaggggtaacctaagggttaacggaacggtaccgtacgaaccgtttaacgttacgtttacggttacgaccgtacctacggaacgtaaggtacggttacggtgtaaccgngggttaacgggtacgggttcggacggggaacggtaacgtacggttacggtaccgttcggttacggtacgtaacggttacccgaacgtccggtaccgtccccggtcgtacccgttcgtcccgttacccgg

SEQ ID NO: 90039 - DNA, 739 bp, Homo sapiens
  misc_feature: GYAE6OF02JN8BU.21.8.A08.1.454.CMB.1.raw
tcagtcgtcgctcgcacgaccggtgctcgatttagcatactctacaggggcgtgtggcgtcaggaggcagagctctgggaatctcaccatggacctcggacccctctcctcgctccccctcctcgactttctgcacagtctctgaggcctcctatgagctcgacaccagccaccctcggtggtcacgtaggtcccccaggacaaaccggtccaagggatccgacctgccttccgtggatacgttcatttcgaccaaaagtatatactttgtggttacccagtacacgtaaacgtctaacggcctaacggtcccccgttaggttaccgtaggttcccgtaacttaccggcgttaacgggccggtaccgtacggtttaccggaaccggttaaccgtacccgggttacccggggtaaccttccccggttaggaaacggtacgtacgtttccaacgttccggtacctccgacgtactaccggaggaacgtcggtacgtaccggtaccctttaggactttacgtacgacggtacgggaccgtacggtacggacggtagtacgatacgtacgtacgtacgttagttcgtaaccgtcaactaccgtacgacgttacgttcgcgtacgtacgtagggttacgtacggtaacgggcgtaaccgtacggttacgtacccgttcggtacggtactaccggtaccgaacggttcccgacgtcccccgtaacgttccgtactcccgtaccgg

SEQ ID NO: 90040 - DNA, 679 bp, Homo sapiens
  misc_feature: GYAE6OF02IK8RP.21.8.A08.1.454.CMB.1.raw
  modified_base (130)..(130): a, c, t, g, unknown or other
  misc_feature (130)..(130): n is a, c, g, or t
  modified_base (345)..(345): a, c, t, g, unknown or other
  misc_feature (345)..(345): n is a, c, g, or t
tcagtcgtcgctcgcacgaccggtgctcgatttagcatactctacaggggggcgtgtgggctcaggaggcagagctctgggaatctcaccatggcctggacccctctcctgctccccctcctcactttcngcacagtctctgacggcctcctatgagctgaccacagcccaccctcggtctccagtcgtcccaggacaaacggccaggatcacctgctctggatattcattgaccaaaaagatatacttgttcgtccagcagaagtcaggccaggcccctgtactggtcatccatcggaggccagtccgacgacaccgtccgggactcccgtagagacgtattcncgtcgccctccgagcctacgacgggacaggtcggaccctacttagactagtccgagggtcggggccccgtagggtcggaacgtagtacggaaacgtcgtacgtaaccttaacgtttacgtttcgttaaccgctaacccgaaggtaaccgtaggttaacggttcggtacgtaacgttccgggtaaggggggtttaaccttcggggacggggttaacggggaaccgtaacggttaccgggtacccgttacggttacggtaccggaacccggtaccccgaaagggtcccctacccgggtccccccgttacgggtacctcccgttaccgttcccccgg

SEQ ID NO: 90041 - DNA, 619 bp, Homo sapiens
  misc_feature: GYAE6OF02GM2XV.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagatatacttgttgtccagcagaagtcaggccaggcccctgtactggtcatccatgagccagtcgacgacactccgggactccgtgagagattctcgtgccctcgagcctcgagggacaggtcggaccctacgttgaactagtcgaggtcggggacccagggtcggaacgagtacggaagcgtgaaccttaacgtatttacgttaaccgcaaccgtaaggaaccgtaagtaggttcgtacgtaagttcggtaagggggttactaccgggacggggtaacgggaccgtaaggttccggaacccggttccggttacggtaccgtaaccggtacccgaaggtccgtcccggtacccccgtccgggtaccctaccgtccgttaccccg

SEQ ID NO: 90042 - DNA, 518 bp, Homo sapiens
  misc_feature: GYAE6OF02FFI00.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcacttttctgcacagtctctgaggcctcctatgagctgacacagcccaccctcggtgtcagtgtcccccaggacaaacggccaggatcacctgctctggagattcattgaccaaaaagaatatacttgttggttccagcagaagtcaggccaggccccctgtactggtcatccatgaggccagtcgacgacactccgggatccctgagagattctctgcctccagctcagggacagtggccacctttgactatcagtggggcccagggtggacgatgaagctgactactattgttacgcaccagacagtagtggtcagtcagggggtatcgggcgggagggaccagtgaccgtccgttggtcagcccaaggcctcggccccctcggtcactcgtccg

SEQ ID NO: 90043 - DNA, 654 bp, Homo sapiens
  misc_feature: GYAE6OF02GX1HH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcactgctctggatattcattgaccaaaaagatatacttgttggttccagcagaagtcaggccaggcccctgtactgtcatccatgaggccagtcgacgacacgtccgggatcccgtgagagacttctctcgccctccagctcgacgggacaggtcggccctaccgttgactacgtcgagggtcggggaccctagggtcggaaccgtagtacggaacgtcgtagtaaccgttaacttagttacgttaccgccaacctagaacgtaggttaggtggtcctaaggttcgggtaaggggggtttacttccgggggacgggtaacggggtaacccgttaagggtttccggaacccgggtttccgttacgggtacccgtaacgggtaccccgtaacgggtcccgtaccccggttccccccgttcgggttaccctaccgttcccgtttaccccgg

SEQ ID NO: 90044 - DNA, 994 bp, Homo sapiens
  misc_feature: GYAE6OF02IJD69.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacctcggtgtcagtcgtcccgagaccaacggccaggactccacgtgctcgnggatacttcattcgaaccaaaaagtattagttacgtttggttcggttacccaggaccgaaaggtaacgttccgacggtaccgacgggtcccccctaggttacgtaccggttcctaacttcccgtaacgttacgggaacgggaccctaagggttccggaaccgtaacccgtacccggttacccggggtaaccttcccccgttaaggaacggtaaccggttacttttcccggtacccgttcggtaccccgttaccccgacgttacccggttaaccgggtaaccgggggtaaaccgtacggggttaccccgggtaaccccgtttaaccccggtttacgggtaaacccgtttaaccgtttaccggggtaaaccggggttacccgggggggtaccccgggttaagggggttaccgggtaaacccgggttaaacgggttaacgggtaaaaccggggtttacccggttaaacggttaaacccggttttaaccggtttaaacgttttaccgggttaaaccccgttaccgtaacccggtaacggtaaccgttaacgggttaacggttacggttacccgtaacgtttaccggggtaaacgggggtttacggttaccggggtaaccgggtaaccggggtaacccgttaacgggtttaccggtacccggttaccggtttaccgggtacccggtaacccggtacccggaaacgggttcccgttaaccccgggtccccccggttaaccgggttaccccgttacccggtttacccggtttaccccccgg

SEQ ID NO: 90045 - DNA, 698 bp, Homo sapiens
  misc_feature: GYAE6OF02JV699.21.8.A08.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgacgctagacacacgcccacccgtcggtntcagtcgtccccaggacaacggccaggatcacctgctcgtggagtattcgattcgaaccaaaaagaatatacgttggttggttccagcaagaagtcaacggccaggccccttagtacgtggtcactcgatcggacggctacgtcgaccgaactacgtaccggactccgtggaagagtaccttctacgtcgcctacgacgtcgtacggaggacacggttcgaccctacgtttagaactgtaccggtagggtaccggggacccgtagggtacggacgtaagtacggaacgtccgtacgtaacgtttaccgttaacgttacggttaaccgaccgaaccgtaacgaacgtaggtacgttcggttacgtaacgttcgggtaacggggttacgtccgggtaacgggtaacggtaccgtacgggtttaccggtaccggttcggttaaccggtacggaacccgaccggttacggtacccgtcccgggtaccccttacgggtccctaccggttaccgttcccccgg

SEQ ID NO: 90046 - DNA, 673 bp, Homo sapiens
  misc_feature: GYAE6OF02GNNYS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcactgtctcgtgaggcctcctatgagctgacacacgcccaccctcggtgtcagtcgtccccaggaccaaacggccaggatcacctgctctggagtattcattacgaaccaaaaagtaatattacgtttgtttcggttccagtcagaagtcgaggccacggcccctgtacttggtcatccagtggacggccaggtaccgacgacaccgtccgggactcccgtagagacgtacttcctctcgccctccgagcctacggagggacctaggtccgaccctaccgttcgactagtcgacgggtcgggacccgtagggtcggacgtagtacggaacgtcgtacgtaccttacgttagtttacgttaccgtacaccgtagaacgtaggttacgtacggtacacgttacgggtaagggggttctacggggacggtaacgggaaccgtacgggttaccggacccggtttccggttacggtacccgaaccggtacccggaacggtcccgtcccggtcccccgttacggtcccgtaccgttcccgttaccccgg

SEQ ID NO: 90047 - DNA, 775 bp, Homo sapiens
  misc_feature: GYAE6OF02I77GI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggactcacctgctcgtggatacttcattcgaaccaaaagaatacttacttggttcggttccaggcaagtaagtcgaggccacgggtcccccttggtaaccgttgggacctactccgtaattgggaacggtcccgtaaggttaccggtaaccggaacctaaccgtcccggggacttaccccgtggaacgtacgtactttcctacgtccggtccctacccgacgtcctacggaaggggtactacggtaccgggcccctaaccgtttacggaaccttagtaccggtacgggtacgggggtccccgtaagggtcgggaacgtaacgtacgaaggtaccgtacgtaaccgttaacgttagtttacggtttaaccgaccgtaaccgaacggaaccgtaagggttacggttacggttaccgtaaggttccgggtaaggggtttacggttaccggggtacggggaacgggtaaccggtaaggttccggtacccggtttccgttcgggttacgtaaccggtacccgaacgggtccgtaccgggtccccccgttacgggttacccgtaccgttcccttacccgg

SEQ ID NO: 90048 - DNA, 701 bp, Homo sapiens
  misc_feature: GYAE6OF02G1QZJ.21.8.A08.1.454.CMB.1.raw
  modified_base (231)..(231): a, c, t, g, unknown or other
  misc_feature (231)..(231): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacacgcccacccgtggtcgtacagtcgtaccccgaggaacaaaccggccaggactccacctgctcgtggatntcatcgaccaaaagatattacgttgttcgtacagacagaagtcacggccacggtccctagtacgtggtacactccagtcggacgccgtagtaccgaccgaccgtaccgtccgggactcccgtagacgtagtacttccgtcacgtccctcgacgtccgacggacgggactagggtccgtacccgtaccgttacgacctagttccggagggttccgggaccggtagggtacggacgtacgtagaacggtcgtacgtaacttacgttacgttacggttaccaccgaacgtacgtaagtaggttagttacggtacgtacggtaccgggtaggggttaccgtacgggtaccggggaacgggtaaccgttacgggtaccggttacccgttacggttacggtaaccggtacccggaccgtaacggttcccgacccggtacccccggttcggtacccgttaccgttcccggttccccg

SEQ ID NO: 90049 - DNA, 725 bp, Homo sapiens
  misc_feature: GYAE6OF02FQII2.21.8.A08.1.454.CMB.1.raw
  modified_base (441)..(441): a, c, t, g, unknown or other
  misc_feature (441)..(441): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctctatgagctgacacagccaccctcggtgtcagtcgtccccaggacaacggccaggatcacctgctcgtggagtacttcagttcgaaccaaaaagtataactaccgtttgttcggttaccagcgagtaagtcgaggccacggtcccctagtcgtaggtcctacgtccagtcggacggtccaggtccgacgaacgtacgtccgggacttcccgtaggagagtacttccgtcttcggccctaccgacgtcctaccggaaggggtactacggtccgggaccctaccgtttacggacttaacnccggtaagggtccggggtaacccgtagggtacggaacgtaacgtaggaaaccggtcgtacgtaacttacgtttagtttacgtaccggcctaaccggtaagaccgtaaggttacggtacggttacgaacggtttcggggtaacggggggttacgttcgggggaacgggtacggtaacgtaacgggtttccgtacccggttcgttacgggtaccaccggtaaccggacggtacctcccgggtccccttcgggtaccttaccgtccgttcccgttacccctccccgg

SEQ ID NO: 90050 - DNA, 634 bp, Homo sapiens
  misc_feature: GYAE6OF02FO0T7.21.8.A08.1.454.CMB.1.raw
  modified_base (326)..(326): a, c, t, g, unknown or other
  misc_feature (326)..(326): n is a, c, g, or t
tcagtcgtcgctcgcacgaccggtgctcgatttagcatactctacagggggctgtgggctcaggaggcagagctctgggaatctcaccatggcctggacccctctccttctcccctcctcactttctgcacagtctctgaggcctctatgagctgacacagccaccctcggtgtcagtgtccccaggaccaaacggccaggatcacctgctctggagattcattgaccaaaagatatacttgttggttccagcagaagtcaggccaggcccctgtactggtcatccatgacggccagtcgacgacacgccgggatccctagagagnttctctgcctcagctgacggacaggtcgcctacgttgactatcgaggtcgggccctagggtcggacgagtaggaacgtcgtagacttacttagttcggttaccgccgaaccgagtaccgtaggttacggtacggttcagttcgggtagggggtttacgttccgggacgggaacggggtaaccgtaggtttccgaacccggttccggttacgggttacccggaaccggtacccggtaacgggttcccgtacccggtccccccgttacgggttaccctaacccggtttccgtcccggtttacccccccgg

SEQ ID NO: 90051 - DNA, 700 bp, Homo sapiens
  misc_feature: GYAE6OF02G7YDB.21.8.A08.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctcggtgtcagtcgtccccaggaccaaacggccaggactcacctgctcgtgganattcattcgaccaaaagtaatatacttgttggttccagcagaagtcaggccacggcccctgtactggtcatccatgacggccagtcgacgacacgtaccgggactcccgtggacgagtacttcctctcgcctaccgagtcctcgacgggacacggtcggccctaccgttacgaacttacgtaccgagggtccggggacccgtaggggtcgggaacggacgtaggaaacggtcgtacgtaaccttaacgtttaagtttacggttaaccgcctaaccgaggaaccgtaaggtacggttacggtacctaaggttacggtaacgggggggtttacgttaccggggacggggtacgggggtaaccctaagggttttaccggacccggtttcccggtttagggttacccgaaccggtaccccgaaacgggtccgtacccggtaccccccggttcgggtacccgtacccttccgttaccccgg

SEQ ID NO: 90052 - DNA, 703 bp, Homo sapiens
  misc_feature: GYAE6OF02IH12D.21.8.A08.1.454.CMB.1.raw
  modified_base (104)..(104): a, c, t, g, unknown or other
  misc_feature (104)..(104): n is a, c, g, or t
  modified_base (128)..(128): a, c, t, g, unknown or other
  misc_feature (128)..(128): n is a, c, g, or t
  modified_base (149)..(149): a, c, t, g, unknown or other
  misc_feature (149)..(149): n is a, c, g, or t
  modified_base (159)..(159): a, c, t, g, unknown or other
  misc_feature (159)..(159): n is a, c, g, or t
  modified_base (217)..(217): a, c, t, g, unknown or other
  misc_feature (217)..(217): n is a, c, g, or t
  modified_base (295)..(295): a, c, t, g, unknown or other
  misc_feature (295)..(295): n is a, c, g, or t
tcagtcgtcgctcgcacgaccggtgctcgatttagcatactctacagggggctgtgggctcaggaggcagagctctgggaatctcaccatggcctggacccctntcctgcctccccctctcactttcngcacagtctctgagcctctangagctgacanacgcccaccgtcggtgtcagttcgccccgaaggacaacggccaggactcgacctgctntaggatattcattgaccaaaaaggtatatacgttgtcggtccagacagaagtcagtccaggcccctgtactggactanccagtcgacgccagtacgacgaactacgtccggacttcccgagaggactattctcgtgcacgtccgagtcctacggacggaactaggtccggaccctaacgttcggtactacgtccggtaacggtccggggtaaccccgaggggttacggtaacgaaggttacggaaccgtacgttaacgaaaccgttttaaccgtagtttaccggttaaccgtaccgaaaccggtaacgtaaacccggtaaggttacggtacgggttaccctaaggttaccggttaagggggttaccgttaacggggaccgggtaacggtacgtaacggttccggtaaccggttaccgttcggaaccggacgtaccccgggtaacgttccgaccccggttacccccggcgttacccgtctaccccgg

SEQ ID NO: 90053 - DNA, 574 bp, Homo sapiens
  misc_feature: GYAE6OF02GYM2Y.21.8.A08.1.454.CMB.1.raw
  modified_base (218)..(218): a, c, t, g, unknown or other
  misc_feature (218)..(218): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcacggccacggcccctgtactggtcatccatgacggccagtcgacgacacgtccgggatccctgagagtacttctctgccctcgagtcctacgagggactaggtcggaccctaccgttgaacttactcgtaacgggtccggggacccggtaggggtcgggaacggtagtaggaacgtcgtcggtaacttacttaagtttcgtacgccaaccagtacgagtagtggtacagtcgaggggttntcggnggacggacgagttcgaccgttcgtacgtcacgtaccaggctccgtaccccgtcgactacgtcttcccg

SEQ ID NO: 90054 - DNA, 722 bp, Homo sapiens
  misc_feature: GYAE6OF02HFZ3Y.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatccacctgctcgtggagattcattcgaaccaaaagaatatacttgttcgttccagcaagaagtcgacggccacggcccctgtacgtcggtcactccagtgacggtccaggtaccgacgacgtaccgtccggtactcccgtgacgagtacttccgtcgtcgtccctccgacgtccgtcggaagggtacctacgggtccggaccctacccgttgtaaccgttactacggtacgggtcccggggacccggtaaggggtcggaaccgtaaggtacggaaacgtccgtacgtaaccgtttaacgtttaacgtttaccggttaaccgcccgtaaaccgaacggtaacgttaacggttaggtacggtactacggttacggggtaaggggttacggttcggggaacgggtacggtaaccgtaacgggttccgtacccggttcggttccggtacgaccggtaacccggtaacggtcccgtcccggtcccccgttaccggtacccttacccgttccttacccccgg

SEQ ID NO: 90055 - DNA, 845 bp, Homo sapiens
  misc_feature: GYAE6OF02IG95B.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccaggaccaaacggccaggactccacctgctcgtagggatacttcagttcgaaccaaaagatacttacgttgttgttacaagcaagagtcaggccacggcccctgtactggtcactccagtcggacggccagtcgacgacaccgtcgggactcccgtagacgtagtacttcctctcgccctacgacgtccgtcgaagggactacgggttaccggaccctacccgttttagaaccgttacgtaccggtacgggttaccggggaccccggtaaggggttcgggaacggtaaggtaacgggtaacggtaccgttacggtaaccgtttaacggtttaacgtttaccggttaacccgtaccgtaaacccgtaacggtaacggtaacgggtttacggttacggggttaaccgtaacgggtttaacgggggtaacgggggggttttaaccgggttaccggggggtaacccgggggtaaccgggggttaaacccggttaacggggttttaacccgggttaaccccgggggtttttcccgggtttaaccgggtacccggtaacccgggttaaccccggtaaaccggggtccccgttaaccccggggtcccccccgggttacgggtttacccccgttacccggtttccccggtttacccccccggg

SEQ ID NO: 90056 - DNA, 732 bp, Homo sapiens
  misc_feature: GYAE6OF02HHK03.21.8.A08.1.454.CMB.1.raw
  modified_base (233)..(233): a, c, t, g, unknown or other
  misc_feature (233)..(233): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacagcccaccctcggtcgtcaggtcgtcccccgaggaaccgaaaaccggccgaggactccacctgctcgtgganattcattgaccaaaagaatatacttgttggttaccagcaagaagtcacggccacggcccctgtacctggtacactccagtcggacggaccgacgccgacgaccgaccgtaccgggactcccgtagacgtacgtctttccgtcgtccgccctccacgccgtacggaacgggactcggtaccggccctaccgttacgaaccttacgtacggtacgggtcggggaccccggtagggtacggaacggtaacggtagaacgtgtacgaacttaaccgttagttaccgttacgaccgtaaccgacggtaacgtacggtaaggttcgtacgttaacggtacggggtaacggggttaacggttccggggaacggggtaaccgggtaaccggtacgggttaccggtaccccggtttaccggttacgggtaccggaccggtaacccggaaccggtcccgttaccccgggtcccccttaccgggtaccctaccggttcccgttaccccgg

SEQ ID NO: 90057 - DNA, 800 bp, Homo sapiens
  misc_feature: GYAE6OF02I62US.21.8.A08.1.454.CMB.1.raw
  modified_base (131)..(131): a, c, t, g, unknown or other
  misc_feature (131)..(131): n is a, c, g, or t
  modified_base (146)..(146): a, c, t, g, unknown or other
  misc_feature (146)..(146): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (538)..(538): a, c, t, g, unknown or other
  misc_feature (538)..(538): n is a, c, g, or t
tcagtcgtcgctcgcacgaccggtgctcgatttagcatactctacagggggctgtgggctcaggaggcagagctctgggaatctcaccagtcggcctcggacccctctcctgcctcccctctctactttcngcacacgtcctctgngccctctatgagcctgaccacgtacgccccgtacccgttcgggtgtccgtaggtcctaccccgagaaccgaaacggccgaagacnccnccgtgctcgnggatcttactacgtactaaccaaaaggtacttaacgttcgttggtcggttaccaggacgtagtaacggtcgacggaccgtacggtaccccgttagtaccgttcggtacctacgtaccggagtcggaaccgtcccgttaaggccgtaaccgccgacccggttacccgggataccccgttaggaacgtaacgttgtccgttccgaccgtcctaccgacgtcccgtaaggtaccgacggtccggttaccgcccttaccgtacggtctaacgccgggtaccgggtccgggtaccccgnggggttacgtaccggtagggaacctaccggaccttaggtaaccgttaacgtttacggttaccgttcgaacccgaagacccggttaagaagttaccgggttagtacgttaccggaggggttacggggtttccggacgggtaacggtaccggggtaccgttaacggttcccggtacgtcccggttacgggttacgaaccccggtcgtaaccgggcccgtttaccggccccgtacgttcccgtacggtaccccgtttcccccggg

SEQ ID NO: 90058 - DNA, 702 bp, Homo sapiens
  misc_feature: GYAE6OF02HEY6A.21.8.A08.1.454.CMB.1.raw
  modified_base (184)..(184): a, c, t, g, unknown or other
  misc_feature (184)..(184): n is a, c, g, or t
tcagtcgtcgctcgcacgaccggtgctcgatttagcatactctacagggggctgtgggctcaggaggcagagctctgggaatctcaccatggcctggacccctctcctcgcctcccccctcctcactttctgcacagtctctgacggccctcctatgagctagacacacgcccacccgtcggtntcagtcgtaccccgaggaccaacggccaggactcacctgctcgtaggagtacttctagttacgaaccaaaaagtaacttattacgtttggttacggtttaccaggaccaaggtaacgtcgaacggccgacgggccccctagtacgtggtaccactccagtggacggccaggtccgaacaccaccgtccggacttcccaggagagtacttctcgtcgtcctccagtctcggaacgggactaggtccggtaccctacgttacggtaccttagaccggtaggggtccggggaccccggtagggtcgggaacgtagtaacgaacgtctacggtacttacgttacgtttacgtaccgacctaccgacgtacgtacggttaggcggtagacggtacggggtagggggtttacgtacgggacgggtagggaccttacgggttacggaccggttcccgttaggaccgaccggaccgtacgggtcctacccgtaccccggtcggttcccgtaccgttccttccccgg

SEQ ID NO: 90059 - DNA, 634 bp, Homo sapiens
  misc_feature: GYAE6OF02JXA9A.21.8.A08.1.454.CMB.1.raw
  modified_base (352)..(352): a, c, t, g, unknown or other
  misc_feature (352)..(352): n is a, c, g, or t
  modified_base (593)..(593): a, c, t, g, unknown or other
  misc_feature (593)..(593): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgccaccctcggtgtcagtcgtccccaggacaaacggcaggactcacctgctcgtggagattcattcgaccaaaagaatatacttgttggttcagcagagtcacggccgacggcccctggtaactggtcactccgatgacggcctagtaccgaacgacacgtccgggactccctgacgagtactcgtacncgccctcacgtcacgacgggacgtacggtcggccctaccgttagactacgtcgtagggtccggggacccgtagggtacggaacgtagtacggaacgtcgtacgtaacttacgttactttacggttacaccgtacacggactagggttaagtcggtacgtaacgtcgggttaagggtacgttcggggtacggacgggtaaccgtagttcgggtacccgtcgttcgggtacaccggtacccgnggtacccgtcgcccccggtggtccctacttcccgttacccg

SEQ ID NO: 90060 - DNA, 651 bp, Homo sapiens
  misc_feature: GYAE6OF02IH8MP.21.8.A08.1.454.CMB.1.raw
  modified_base (173)..(173): a, c, t, g, unknown or other
  misc_feature (173)..(173): n is a, c, g, or t
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctgcacagtctctgacgcctctatgagctgacacacgccacctcggtntcagtcgtcccaggacaacggccaggactcacgtgctcgtgganattcatcgaacaaaagatactacgttgttcgtccagcaagacgtcacggcacgtccctgtactggtcactccatcgacggtccaggtccgacgacgtaccgtccgggtactccgtaggaacgtagtacttctcgtcgcctaccgacgtcttacggacgggacctagggtccgaccttaccgttacgaccgttagtacgacgggttacggggacccgtagggtacggacgtagtacgtaacgtctacgtacttaacgttgttacggttaccgcctacgacgtagtacgtaggtcggtactaaggtcgggtaggggttacgcgggacgggacggtaaccgttacggtaccggtaccgttcggttacggaccgtaacgtacccgtaacggtccgttccccggtacccgttaccgggtctaccggttccgttaccccg

SEQ ID NO: 90061 - DNA, 580 bp, Homo sapiens
  misc_feature: GYAE6OF02FIDMF.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatccacctgctctggagtattcattgaccaaaagaatatacttgttggttccagcagagtcaggccacggccccctgtactggtcatccatgacggccagtcgacgaccacgtccgggactcccgtagagagtacttctcgtcgcctccagctacgacgggacagtcgccacttgactatcgaggtcgggccgagggtggacgataggaagctagacttacgtattcgtaccgctaccgagactaggtgtggtactagtcggtagggggttactcggggacgggtacggaaccgtaggtcggtacccgttcggttcggtacgaccgtacccgaacggtccgtccgacccccgttcgggtccctacgttcctcccg

SEQ ID NO: 90062 - DNA, 743 bp, Homo sapiens
  misc_feature: GYAE6OF02H6RKJ.21.8.A08.1.454.CMB.1.raw
  modified_base (129)..(129): a, c, t, g, unknown or other
  misc_feature (129)..(129): n is a, c, g, or t
  modified_base (134)..(134): a, c, t, g, unknown or other
  misc_feature (134)..(134): n is a, c, g, or t
  modified_base (495)..(495): a, c, t, g, unknown or other
  misc_feature (495)..(495): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacngtctctgaggccctcctagtgagctgacacacgtcccacccgttcggtgtacctaggtcgtcccccgaaggaaccaaaacggccaagggactccaacccgtgccgttcgtagggatactttaccgagttacggaacctaaaaaagtattaacgttaacctttggtttacggttcccaggaccgaaggtaacgtcgacggtccacgggtccccctaggttaccgtggtacactcctagtggaacggcctaggtaccgaccgaccgtaccgtccggggaacttcccgtagaagacgtcttccgtactcggcccttacgacgtcgtacgaagggtccagtcggaccctcgttagactagtacgngggtccgggtcccgtagggtacggacgagtagaacgtctaggtaaccttagttacgttacgttacgcctaaacgacgtacgtaagtggtgtacgaaggttcgggtaaggggttacgtacgggacgggtaaccggtaccgttagggtttccgtacccgggttccggttacggtacgtaaccggtaaccccgacgggttcccgttccccggaccccgtttggcccgttacccgtttcccggtacccccgg

SEQ ID NO: 90063 - DNA, 699 bp, Homo sapiens
  misc_feature: GYAE6OF02IH0K2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcactgctctggagattcattgaccaaaagatatacttgttggttccagcagaagtcaggccaggcccctgtactggtcatccatggacggccagtcgacgacacgtcccgggatcccgtagagacgtattctccgtcgccctaccgagtccgtacgaacggggacctaaggtccgggaccctaccgtttcgaaccttagtacgtacgggtccggggaccccgtagggtacgggacgtaagtacggaacgtccgtagtaaccgttaacgtttagttacggttaaccgccgtaaccgaacggactaggttaacggtggtacgtaacggttaccggtaagggggttacgttacgggacgggtaacgggtaaccgtaacgggttcggtacccggttccggttacgggtccgtaacccggtaccccggtaaacgggtcccgttaccccggttccccccggtacgggttacccgttcccgttacccgttacccccgg

SEQ ID NO: 90064 - DNA, 678 bp, Homo sapiens
  misc_feature: GYAE6OF02F7O2O.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtgganattcattgaccaaaagaatatacttgttggttccagcaagaagtcaggccacggcccctgtacctgtcatcatgacggccagtcgacgacacgtccggactccctggagagtattcctctcgccctccagccgtacgagggactaggtcggccctacgttcgaactagtcgacgggtcggggcccgaggggtcggtaacgagtaggaacgtcgtacgtaccttaacgttacgtttacgttaccgacctaaccgacggtaacgtaagttaggttacggtacgtacggttacgggtaaggggggttacgttaccggggacggggtaacgggtaaccgtacgggttaccggtacccgggtttccggttacgggttacccgaaccggtacccggaacgggtcccgttacccggtaccccccggtttccgggttaccctacccgtttcccgtttcccccgg

SEQ ID NO: 90065 - DNA, 587 bp, Homo sapiens
  misc_feature: GYAE6OF02GXQNN.21.8.A08.1.454.CMB.1.raw
  modified_base (338)..(338): a, c, t, g, unknown or other
  misc_feature (338)..(338): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaaggatcacctgctctggagattcattgaccaaaagaatatacttgttggttccagcagaagtcaggccaggcccctgtactggtcatccatgagccagtcgacgacacgtccgggatcccgtggacgagactttacncgtcgcccttccagtctacgagggcaggtcgccaccttgacctatcgaggtcgggcccagggtcggacgtatgaagcgtgacttacgtatttagtaccgacaccgagactagtagtgtacagttcgaagggggttcttacgggcgggtaagggtacctaaggttcggtacccggttccgttagggtaccgacggaccccgtaaggccgttccggcccccgttaccggtacctaccgttccgttaccccg

SEQ ID NO: 90066 - DNA, 679 bp, Homo sapiens
  misc_feature: GYAE6OF02JTJZ6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccgtcggtgtcagtcgtacccgaggacaacggccaggactccacctgctcgtggagtattacagttacgaaccaaaagtaattatacgttgttcggtaccagcgaagtagtacgacggccgacggccccttagtacgtcggtacactccgatggacgccaggtacgacgacgacgtccggactccgagacgagtacttccgtcgtccgtcctaccgacgtaccgtacggaagggtactacggtccggtacccttaccgttacgtactacgtacggacgggtaccgggaccgaagggtacggaactagtacggtagtaccgtagtaacctagtttagtaccgtacgaccacgtagacgtaggtacgtcggtactaggttacgggtaaggggttcgtacggggtaacggacgggtaacgtacggtccgtaaccggtcccggttaacgtacgggaaccgtcgaacccgtacgtcccggtccccgtacccgtccggtacccgtacttccccggg

SEQ ID NO: 90067 - DNA, 607 bp, Homo sapiens
  misc_feature: GYAE6OF02IIEV2.21.8.A08.1.454.CMB.1.raw
  modified_base (327)..(327): a, c, t, g, unknown or other
  misc_feature (327)..(327): n is a, c, g, or t
  modified_base (387)..(387): a, c, t, g, unknown or other
  misc_feature (387)..(387): n is a, c, g, or t
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacagcccaccctcggtgtcagtcgtcccaggacaaacggccaggatcacctgctctgcagagtggactgaccaaaagaaatatgtacttagttacggtaaccaacgaagaacgccaggaccacggtccctgtgttagtgatataataagacactagagacgcctanagagactaccgtagagacgtattctacgtgcctcagctacgaggacagcagtcgacgtanatactcgtagtgaagtccgaggacgagagacgagtcgtagacttatacgtagtaacaaacgagtaacgaacgtaagtaagggtaacgttactacggtacggttaggggttacgttcggggaacgggtacgggaaaccggtaacgcggtaaccggtacccggttacccgtaaggtccggaaccgtaacccgggtaacgtccccggtacccgtacccccggg

SEQ ID NO: 90068 - DNA, 630 bp, Homo sapiens
  misc_feature: GYAE6OF02FK2D8.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgagccagtcgacgacacgtccgggatcccgtgagagattctctgcctccagtctcgagggacagtcggccctacgtttgacttagtcgacgggtcggggcccgagggtcgggacgagtaggaacggtctacgtacttaacgttagtttacggttaaccgacgacctagaacgtaaggtaggttggtactagtacggtaagggggttagttacgggacgggtaacggggaaccgtacggtttacggtacccggtttccggttcggttaccgtacggtaccccgtaacgggtcccgttaccggtccccccgttacggtcccgtaccgttacccgttccccgg

SEQ ID NO: 90069 - DNA, 741 bp, Homo sapiens
  misc_feature: GYAE6OF02IZIMR.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgaccacacgccacccgtcggttcgtcagtcgtccccaggaacaaaccggcaggactccacctgcctctcgggagtattcattacgaccaaaagaactattacttgttcgtccagcagtaagtcgaggccgacggcccctaggtacgttcggtaccagttacctagtcggaggacccgtagttcgaaccggacctaccgtacccggggtcttaccccgtaggaacgtagtaccgtttctaccggtcgacccttaccgagtccgttacgggacgggtacgtaacggtccgtaaccccgttaccgttaccggtactacgtccggtaacggggtccgggaaccccggtaggggtaccggaacgtaacggtacggtaaaccggcgttaacgtaaccgtttaacgttaacggtttaccggttaacccgccgtaaaccgtaggtaaccgttaaggttaacggttcggtacgttacgttacgggtacgggttacgttcgggaacggtacggtaccgtacgttacgtaccgtaccgtttgaccgacggcccgaaggtcccgtccgtccccgtggtccttacccgtccttaccccg

SEQ ID NO: 90070 - DNA, 635 bp, Homo sapiens
  misc_feature: GYAE6OF02H7T8A.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggactcacctgctcgtggagattcatgaccaaaaagatatcttgttggttccagcagagtcaggccaggcccctgtactggtacactcagtgacgacgacgtcgaacgaccaccggtaccgggaccttccgaggagacgtacttcgtaccgtcgcccttaccgacgtcccgtacggaacgggtaccgtaggtccggtaccctacgttgtaaccttacgtacgaggggtacccgggaccggtagggtacggaacgtagacggtacgtcgtacgtaacttactttagttacgtacgacacgacgacgtagttaggtacgtacgtagtacggggtagggttcgcgggaagggacggaacgttacggtcgtaccggttcgttcggtacgaccgtacccgacggtccgtccggccccgttcggcttcccgtcgttccccg

SEQ ID NO: 90071 - DNA, 596 bp, Homo sapiens
  misc_feature: GYAE6OF02G0V0H.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgctcccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagagtcaggccaggcccctgtactggtcatccatgaggccagtccgacgaccacgtcccgggactcccgtgacgagtacttctcgtcgccctccgagtctcggacgggacaggtcgacctaccgttgacctagtcgaggtcggggacccgtagggtggaggatggaagctagacttactcgtagttacgtcagacagaccgagacgaggtcgtacgacgtcgggagggactacgggttcgggacgggtacgggaccgtagggtaccggtacccggtaccgttacggtccgaaccggcccggtaaggtcccggtcccggtcccccgttacggtaccccg

SEQ ID NO: 90072 - DNA, 705 bp, Homo sapiens
  misc_feature: GYAE6OF02I7LFY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctggtgtcagtcgtccccgaggaccaaacggccaggatccactgctcgtggatattcattcgaccaaaagatacttacttggttcgtccagcagagtcaggccacggccctgactggtcacgtccatgagccagtccgacgacaccgtccggactcccgtaggacgtagtacttctctcgtaccctcaggtctacggacggactacggtcggcccctaaccgttgaaccttacgtaccggtagggtaccggggaccccgtaagggtacgggaacgtagtacggaacggacgttagtaccgttaacgtttacggttaccgttaaccggccctaaaccgtacgaaccgtaagggttacgtaccggtactacggtacgggttaacgggggttccgttaacggggaccgggtaacgggtaacccgttaaggtttaccggtacccggttcgggttccggaacgtacggtaaccccggtaagggtcccttaccccgggtcccccgttaccgggttacccgtacccgttccggttaccccccgg

SEQ ID NO: 90073 - DNA, 796 bp, Homo sapiens
  misc_feature: GYAE6OF02IONF2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggcctcctagtgagctgacacacgcccacccgtcggtgtctaggtccgtacccgaaggaacaaaccggccaaggactccaccgtcgctcgtaggagtacttctacgttacgaacctaaaaagtaattaactttacgtttggtttacggttactaaacgacgtaagtaacggtacgacggacccgtaaccgggtcccccgttaggttaaccgttcggttacctacgttaccccgtagtacggacggaccctacggtaccggacgacctaccggtccgggaccttcccgaggaagtacgtacgtttacctccgtacgtcccctacgacgtccgtacggacgggtactaggtccgtaccctaccgttacggaacttacgtaccggtagggtaccggggacccgtaaggggacgggtaacggtagtaacggtacgtacgtagtacccgttaacgttacgttacggttaccgtacgacgacgtaacggactacggtaccgtaggttacgtacgtaaccggttacggggacgggtacgtaacggttccggggacgggtaaccgggtaccggttaacgggttcccggaaccggttacccggtacggtaccggacccgtaccgggtaccgtcccggtccccggtaccccgtacggtacccgg

SEQ ID NO: 90074 - DNA, 771 bp, Homo sapiens
  misc_feature: GYAE6OF02H8O4U.21.8.A08.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgacggcctcctatgagctgacacacgcccacccgtcggtgtcngtcgtccccgaggaccaaaccggccaggactccacctgctcgtggacgtattacattacgaacaaaaagtattacttacgtttggttcggttaccagtacgaagtaacgtaccgacggccgacggccccttgtaccgtcggtactacgtaccagtcggacggacccgaggtaccgacgaacccgtaccggtcccgggtactcccgtaggacgacgttacttccgtccgtcgtccctaccgacgtccgtacggaacgggtaccgtacggtccggtacccgttaccgttacgtaaccgttacgtacgggtacggggtcccgggggtacccgtaggggtacgggaacgtagtacggaacgtcgtaacgtaacccttaacgtttacgttaccgtaccgtactaccgaaacggtacgtaaggttacggtcgtacgtagggtacgggtaacggggttcgtaccggggagggtaaccgggtaaccgttaggttaccgggtacccgtttccggttcgggtaaccgtaccggtacccgacgggtccctccccgggtccccggtttaccggaccttaccccggttccgttaccccccgg

SEQ ID NO: 90075 - DNA, 710 bp, Homo sapiens
  misc_feature: GYAE6OF02GJLYK.21.8.A08.1.454.CMB.1.raw
tcagtcgtcgctcgcacgaccggtgctcgatttagcatactctacagggggtgggctcaggaggcagagctctgggaatctcaccatggcctggatccctctacttctccccctcctcactctctgcacaggctctgaggcctcctatgagctgacacagccctacccgtcggtgtccaggtcgtcccccaggaccaggaccggccaaggatcacctgctctgcagatggactcgaccaaaagaatagtgtacttagttacggtaaccaacgagaacgccgaggacccgacggccccgttggtagttaggtgtaagtaataagtaaagacacgtaggaacggacggtccctagacgacgacctcccgtagacgtcgtattcctcgtcggtcctaccgacgtcctacggaggacagtacgtacgtacgtacgttcgacgttagtacgagtacgtaacgtaccgaagggtaccgaagggtacgggaacggtacggtacgttacgtaacttaacgttaccgtacggtaaaccgaaaacgtaaggtaacgtaacgtaagggttaacggtaacggtttacctggttaacgggtttcgggttacgggttaccggggaacgggtaacgggtaaccgtaacggttcggtaaccggtacccggttaccgtacggtaccgacccggaaccccggtaggttaccccgtcccgtacccccgg

SEQ ID NO: 90076 - DNA, 696 bp, Homo sapiens
  misc_feature: GYAE6OF02JZVYC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctgctctggatattcattcgaccaaaagatatacttgttggttccagcagaagtcaggccaggccctgtactggtcactccagtgacggccagtccgacgacacgtccgggactcccgtaggacgtagtacgttcctcgtcggccctaccacggtccgtacgaacggggactacgggtcggacccctaccgtttaggaaccttacgtaccggtaacgggttcccggggtacccgtaaggggtcgggaaccgtagtacggaacgtcgtacggtaccttaacgttagttacgtaccgaccgaccgtaagacgtacggttacgtcggtacaacgttcgggtaacggggttcgttaccgggacgggtaacgggtaccgtaagggttccggtacccggttaccggtttacggtaccgtaaccggtacccggtaagggtcccgttacccggtcccccggttacgggtacccttacccgttccggttaccccg

SEQ ID NO: 90077 - DNA, 616 bp, Homo sapiens
  misc_feature: GYAE6OF02H2CU5.21.8.A08.1.454.CMB.1.raw
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccctcctatgagctgacacagcccaccctcggtgtcagtcgtcccaggacaaacggccaggatcacctgctcgtggagattcattgaccaaaagattatacgttgttggttccagcagaagtcaggccaggcccctgtactggtcactccatggacgccagtcgacgacactccgggatcccgtgacgngattccncgtcgcctcgagcctcgaaggccagtcggaccctacgtgaacctatacgacggtcgggcccgagggtacggaagtacgtaggaacgcgtagacttacgttattcggtaccacacgagacgtagtacgtggtaccagtacggtacggggttagtacgggacgggtacgggtaccgtaacggtttcggacccggttccggttacggtacggtaaccgacccggtaacggtccgtacccggtccccccgttacgggtacctacccgttccgttaccccg

SEQ ID NO: 90078 - DNA, 850 bp, Homo sapiens
  misc_feature: GYAE6OF02JNMJA.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggcgtgtgggcgtcaggaggcagagctctgggaatctcaccatggcctggacccctctcctgcctcccctcctccactttctgcacagtctctgaggcctcctatgagctgacacagccaccctggtgtcagtcgtccccgaggacaaacggccaggactcactgctcgtgganattcattgaccaaaagaattacttacgttggttcggttaccaggacacgtaaagttcgacggaccgtacggtcccccgttagtacctgggtacaccgttccagttacgggaaccggtccaaggtccgaaccggtactaaccggttacccgggacttccccgtaggaaacggaaggttactttctccgtcgaccccgtacgaccgtacgtaccgaaggggcctaaggtcccggtaccgaaccgttttcgacgttaccttacgtacgggtccggggtaccgacggggttcgggaacgtacgtacggaacggtaccgttaggtaacttaccgtttaacgtttaacggtttaaccggtaccctaaccggaaccggtaacgttaacggttaacgggttacggggtttacctaacgggtttaaccgggttaaacggggggttaaccgttttcccgggggaacgggttaaccgggggtaaccgttaacgggtttacgggttaaccccgggtttccggtttaggggtacccggttaacccgggtaacccggtaaccgggtccccggtttaacccggtacccccccggttaccggggttttaccccgttacccggttaccccgggtttacccccgg

SEQ ID NO: 90079 - DNA, 588 bp, Homo sapiens
  misc_feature: GYAE6OF02GEVN3.21.8.A08.1.454.CMB.1.raw
  modified_base (521)..(521): a, c, t, g, unknown or other
  misc_feature (521)..(521): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggagcatggtccagcctgggagtccctgagcctctcctgtgcagcgtctggattcagtactcggccttccgtttgcccatgcctacgttcgggtcccgccgaggtcctccgagggcgaagggggctgggaggtggggtggcgtattatcgtaggtatggagtagggaagtgagtagattattattcgaacgtacttccggtaggaacggggtccgtattccacctatcctaccagacgaacaactacgacccaaacaacactactagtacttcttacaaagtcgaccgtcctgacgacgccgagaccgacgtctagngttacttacgtagtacgagttcgtttaggtacgtaggttcgggaccgtacgggtacccgtggtaccg

SEQ ID NO: 90080 - DNA, 600 bp, Homo sapiens
  misc_feature: GYAE6OF02IBV8G.21.8.A08.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctcgtggagattcattgaccaaaagatatacttgttggttccagcagaagtcagccaggcccctgtactggtcatccatgagccagtcgacgacaccgtccgggaactcccgtgacgagattccngtcgccctccagcctagagggacagtcggcctaccttgactatcgaggtcggggcccgaggtcggacgatggaaagctgaacctactagttacgttacgctaccaagacgagtaggtcggtacgagttcggaaggggttacgtcgggacgggaaggggtaacctaagggttaccggtaccggttccgtttagggtccgtaaccggacccgtaacggccgtacccggtcccccgtaccggtccgtaccgttccgttccccgg

SEQ ID NO: 90081 - DNA, 772 bp, Homo sapiens
  misc_feature: GYAE6OF02IUAR8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtggtgtcagtcgtcccaggaaccgaaacggccaggactcacctgctcgtggatatctagtcgaaccaaaagattattacgttgttgtaccagcaagtaacgtcgacggccgacggtccccttagtacgtcggtcacgtaccagtacggacggacccgtacggtacggaaccgtaaccgtacccggtaccggggaccttcccgagggaacgtacgttactttccgtccgtaccgtcccctacggacgttcgtacgggaagggtactacgggtccgtaccctaaccgttcgtaacgttacgtaccggtacggggtaccggggtaccgtaagggtacgggaacgtacggtacggaacggttccgtaacggttaaccgttaacgtttagtttacccggtaccgtaacccgaacgtaacggtaacgtaaggtttacggttacggtaccgtaaggttacggggtaacggggtttacggtaacggggaacgggtaacgggtaaccgttacggttaccggttcccggttacggttcggtaccggtacgtacccggtacggtccgtcccggtcccccggttacggtacctacccgttccgtacccccg

SEQ ID NO: 90082 - DNA, 804 bp, Homo sapiens
  misc_feature: GYAE6OF02FFRJ0.21.8.A08.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccagtcggcctcggacccctctcctcgccttccccctctctactttcngccactgtctctgacggtccttctatgacgtctacgacctaccgaccgtcccgtacccggtggtcgtaccgtaacggttacccgaccccggaacggaaacccgaaccggtccgtaacggtaccttacccgtaccgttcggtaccgttaggtaacgggtaaccttacgttacctaacggtttaacggaaaaccttaaaggttacctttacgtttaccggtttacggtaccgacaacggtacgaaacggtccgtccgaaccggtcctaacgggttccctaggtaccgtctaccgacgtacgagaccggtaccggtactaaccggaccgtaccgtccgtaaccggtcggttaccttcggaggtaactcttaccgtccgtaccgtcccggactacggtaacgcgggtaaaccggtcgtaaccgtaccgggtttacccaccggttaggtaaccacggtccgggtaacggtcgggaccgtaggacggtacgtacgacgtacgtactacgtaacttacgttacgtacggttacaccgagtacgtaacgtaggttacgcggtacgtaacggtcgggtaacgggttcggcgtaacgggcgtaccgtacgtcgaccgtccgtacggtcaccgtacgtacgccctccgtcccgtaccgttctacccgttctcccgtacccg

SEQ ID NO: 90083 - DNA, 672 bp, Homo sapiens
  misc_feature: GYAE6OF02GPQ9D.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggactcacctgctctggagattcattcgaccaaaagatatacttgttgttccagcagaagtcaggccaggcccatgtactggtcatccatgagccagtcgagacgactccgggatcccctggagacgattctctcggcctccgagtctcgtacggggacaacggtggcccaacccgttgaaccttaagtccgaaggtccggggacccgagggtacgggacggagtacggaaaggcctaggtaacttacgttaattacgggttaacgacgtaaccaacgtaacctaagggtacgttacggttcgaacgttacggtaggggggttaacgttttcggggaaccgggtaacggggaaccgtaacgggttacggtaaacccgggtccggtttaagggtccgtaacggaccccgtaagggacccgtacggtaccccccggttcggttacccgtacccttaccgttacccgtttccccccgg

SEQ ID NO: 90084 - DNA, 907 bp, Homo sapiens
  misc_feature: GYAE6OF02H5XIH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccaccgtcggtgtcagtcgtccccgaggaaccaaaccgggccaaggactccgacctgccgttcgtcgggagtactttctagttaacggaaccaaaaaaggtaaacttaagttaaccgttttacgggtttacggtttacccaagtaccgaaaggtaaacggttaccgaacgggaccccgtaaccgggtaccccccttaggttaaccgtacgggttccaacttaccccgtaggttacgggtaccggacccgtaagggttaccgaaccggaacccgtaacccggttacccggggtactccccggttaaggaacggtaacgtaacctttccgttcgtccgtccctacccgacgtccgtaacggaacggggtaccaagggtaccggacccgttaaccgttcggtaaccttacgtacgggaacgggttccgggggaccccggtaaggggttaacgggacggtaacgtaagggtaacggtaccgttaacggtaaccgtttaacgttaacggtttaccgttaccgaacccgtaaaccgaacggtaacgtaacggttaacgggttacggtacgtaacggttaacgggttacgggggttaacggtaccggggaacgggtaaccggggtaaaccgttacgggttaccggtaacccggttccggttcggtacccgtaacccggtacccgtaacgggtcccgttacccgggtcccccgtttaccgggtcccgttacccgttcccgttacccccg

SEQ ID NO: 90085 - DNA, 690 bp, Homo sapiens
  misc_feature: GYAE6OF02IHQ8G.21.8.A08.1.454.CMB.1.raw
  modified_base (166)..(166): a, c, t, g, unknown or other
  misc_feature (166)..(166): n is a, c, g, or t
  modified_base (183)..(183): a, c, t, g, unknown or other
  misc_feature (183)..(183): n is a, c, g, or t
  modified_base (326)..(326): a, c, t, g, unknown or other
  misc_feature (326)..(326): n is a, c, g, or t
tcagtcgtcgctcgcacgaccggtgctcgatttagcatactctacaggggggctgtgggctcagggaggcagagctctggggaatctcaccatggcctggacccctctcctgcctccccctcctcactttctgcacagtctctgaggcctcctatgagctgacacngcccaccctcggtgtcngtcgtccccgaggaaccaaaccggccaggactcacctgctcgtggatattcattcgaccaaaaagatatacgttgttcgtccagcagaagtcaggccacggcccctgtacctggtcatccagtgacggccacggtcgacgacnccgtccgggactcccgtagacgtagtacttcctctcgccctaccgacgtcctacgaacgggacaggtccggaccctaccgtttagaccttatacgacgggtccggggacccgtaagggtcggacgtagtacggaacgtccgtagaaccttacttagtttcgggttaaccaccgaaccgtaacggaacgttacggttaggttcggtactacggtacggggtaaggggttacgtcggggtacgggaacgggtaccgtacggttacggtacccggttccgttacgggaccgtacccggtaacccggaacggttcccgtaccccgggttcccccgttcggtacccgtacccgtttcccggttccccgg

SEQ ID NO: 90086 - DNA, 875 bp, Homo sapiens
  misc_feature: GYAE6OF02JBHD3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggcctcctatgagctgaccacacgccctacccgtcggtcgtcctaggttcgtccccgaggaacaaaccggccaaggactccacctcggctccgtgggatactttaccagttcgaacccaaaaagtaacttagttaaccgtttggtttacggttcccaaggtaccaaggaaacggttcgaacgggaccccgacgggtcccccctaggttaccgtcgggttacctaacgttccccaaggttcggaaccggggtccccgtaagggttaccccggaaaccggtaaccctacccgggttaaccccggggtacttaacccccgttggggaaccgggtaacgttaccgtttcctttacccggtaccggtcccccttacccgtaaacgggtccccgttacgggaaaccggggtaaaccctaacggggtcccggggtacccccctttaaaccccgtttacggtaaccccgttagtaccggtacgggtaccggggtaccggtacggggtacggacggtagtacgagtacgtacgtacgttacgttaacgttcgttacgtaccacgtaacgaacgttaggtacgttacggtacgtacggtacgggtaacggggttacggtcgggtacggggaacgggtaaccgtacggttaccggtacccggttcgggttaccggtaccggtacgacccggtaaggtccgttccggtacccccggtccgtacccggtaccgttccgttcccgg

SEQ ID NO: 90087 - DNA, 736 bp, Homo sapiens
  misc_feature: GYAE6OF02G5NX9.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacctcggtgtcagtgtccccaggacaaacggccaggatcacctgctctgganattcattcgaccaaaagatatacttgtggttacagcagaagtcaggccaggcccctgtactggtcagtccagtggaggccaggtaccgacgacacgtcccgggaatcccgtggaagtacgtactttaccgtcgtcgtacccctcgaacgtccgtaccgaacggggaccagggttcggaccctaaccgttgaactagtaccgagggttccgggggacccccgtaagggggtccggtaaaccggtaatacggggtaaacggtcccgttacggtaacccttaacgttaacgttttacggttaaccaccgtaaacccgacggtaaaccgtagggttaacggttccgggttaactacggttacggggttaaggggggttacgttacggggaccggggtaacggtacccggtaaggtttaccgggtaacccggtttcccgtttaagggtccgaaccggtaccccgtaagggtacccttcccgggtaccccccgtgggttaccctaccgttcccgttaccccgg

SEQ ID NO: 90088 - DNA, 759 bp, Homo sapiens
  misc_feature: GYAE6OF02INJNJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggcctcctatgagctgacacgacgcccacccgtcggtcgtcagtcgtacccccgaggaaccaaacggccaggactccaccgtgcctcgtggtatacttcattcgaaccaaaagatatacttgttggtccagcaagaagtcaggccacggtcccctagtaccgtggtcacgtccagtacggacggcctaggtaccgaccgtacaccggtcccgggacttacccggtgacgtagtacttcgtcgtcgtccctaccgacgtccgtacggtaacggggacctacgggtaccggtacccttaaccgtttcggtaaccttacgtacggtaacggggtccgggggacccgtaggggtacggaacggtaagttacgggaacgtacgtacgtaaccgttaccgttaagtttaccgttaaccgacctaaccgtaacgtaacgtacgggtacgttacggtacctaacggtacgggtaacgggggttacgttaccgggaacgggaacgggttaaccgtacggttaccggttacccggttaccgtttacgggtaccgtaaccggtacccgtaaggttcccgtacccgggtaccccccgtcgggtacccgttacccgtcgttcccccggg

SEQ ID NO: 90089 - DNA, 514 bp, Homo sapiens
  misc_feature: GYAE6OF02F74DW.21.8.A08.1.454.CMB.1.raw
  modified_base (450)..(450): a, c, t, g, unknown or other
  misc_feature (450)..(450): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagaatatacttgttggttcagcagaagtcaggccaggcccctgtactggtcatccatgaggccagtcgacgacacgtccgggatccctgagagattctctgcctccagctcgagggacagtggccacttgactatcagtcggggccaggtggacgagtgaagctgacttactattgttacgcaccagacagtagtggtcagtcgaggggtattcgggnggacgggaccgagttgaccgttccgttggtcacgccgaaggctcgcccctcggtcacgtctccg

SEQ ID NO: 90090 - DNA, 631 bp, Homo sapiens
  misc_feature: GYAE6OF02IVMMP.21.8.A08.1.454.CMB.1.raw
  modified_base (134)..(134): a, c, t, g, unknown or other
  misc_feature (134)..(134): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngtctctgaggcctcctatgagctgacacagcccacccgtggtgtcagtcgtccccaggaccaacggccaggatcactgctctggatacttcattgaaccgaaaagtaatattactttgttggttccagcagaagtcacggccacggcccctgtactggtcatccagtgacggcaggtcgacgtacacgtaccgggactccgngagtatnttctcgtcgccctcgacgtcgtcgacggactaggtccgacctaccgttgtaactatcggacggtcggggacccgtaggggtacggacgtagtacggacgtacgtgtaacttactttacgttcggttacacccgaactaacggagtaggttagttcgggtactaggttacgggtaaggggttaccggttcgggaacggggacggtaaccgttacggttaccgtaccggttcggttcgtacggtaccgccgtaaggccttccggcccgtccgtacgtccgtcgttccccg

SEQ ID NO: 90091 - DNA, 667 bp, Homo sapiens
  misc_feature: GYAE6OF02IJTJS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggatattcattgaccaaaagatatacttgttcgtccagcagaagtcaggccaggccctgtactggtcatccatcggacgccagtcgacgacaccgtccgggaactcccgagacgagtacttcgtctcgccctcgacgctcgagggtacctaggtccggaccctacgtttcgaaccttacgtaccgtacggtccgggggaccccgtagggtacggaccgtagttacggaacgtcgtacggtaaccttaacgttacgtttacgttaccgaccaccgtaacggtaacgtaaggttacggtcggtactacggtacgggtaacgggggttacgttccggggaccgggtaacgggaccgtaggttaccggtaccggttccggttacggtaccgacggtacccgtaaggtcccgttcccggtacccccgttcgggtacctaccgttccgttaccccgg

SEQ ID NO: 90092 - DNA, 722 bp, Homo sapiens
  misc_feature: GYAE6OF02HXSD7.21.8.A08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgccaccctcggtgtcagtcgtcccaggaacaacggcaggactcacctgctctggagtcttcagttcgaacctaaaaaatttnttagttttttaggaccagacagtaagtcaggccacggccctgtgttgctactccatgaggacgaggacgaccgacccgtcggactccgtagagtagactttcgcgtcggacctccgaacgtacggaacggggtacggtcggaccgttacggttcgtaacgtttccgtacggtacggggtaccgggggtacccgtaagggggttagggaacggttaaggtacgggtaaacggtccgttaacgggtaaacctttaccgttaaccggtttagttaacccgttaccgaacggtaacccgtaaggaaacccgagggtaccgtacgggtttacgggtacccgtaaggttaccggggacggggtactagggttaccgggacggggtacggaacgtacgggtaccgaccgtttaccgacgggtacaccgacccgggtagtccgccgttaccccgcgtacctacctcggtacccgtacccctcccg

SEQ ID NO: 90093 - DNA, 890 bp, Homo sapiens
  misc_feature: GYAE6OF02G2MQY.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgaggcctctatgagctgacacacgccctacccgtcggtcgtcagtcgtccccgaggaaccaaacggccaggtactccacctgctcgtaggatactcattacggaaccaaaaagtaattacttaacgtttcggtttcggttacccgagacgaaggaagttaccgagggacccacggtacccccttaggtaccgttagggtcctaacgtacccgtaagtacgggtaaccgggcccgaacggttaccggaaccgaacccgtaaccgggtaccccggggtaactttacccccgtaggaaacggtaacgttaccgtttccgttccgccggtcccgtacccgtaacggtacccgtacggaaacggggacctacggggtccggaccccttaccgtttacgtaccttaagtacccggtagggtccggggtaccccggtaagggttcgggaaccgtaagtaaccgggtaacggttaccgttaacggtaacgttaaccgtttaacgtttaccggttaccaaccgtaaccgtaacgtaacgtaaggttaacggttacgggtacgtaacgggtacggggtacggggtttaaccgggtaccgggtaacggggtaaccgggtaaccgtacggggtttccggtaacccgggttcggtttaccggggttacccggaaccgggttccccggtaaaacgggtcccgttaccccgggttaccccccgggttacggtaacccgttacccggtttcccggttacccccgg

SEQ ID NO: 90094 - DNA, 733 bp, Homo sapiens
  misc_feature: GYAE6OF02FJ3U0.21.8.A08.1.454.CMB.1.raw
  modified_base (357)..(357): a, c, t, g, unknown or other
  misc_feature (357)..(357): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagtctgacacagcccaccctcggtgtcagtcgtcccaggacaacggccaggatccactgctcgtggagtacttcagttcgaaccaaaaagtacttacttacgtttggtttacgttaccagacagtaagctaacggccacggcccctggtactggtcatccagtggacgccagtccgacgaccacgtcggatcccgtgacgtacgtnttcctcgtcgccctacgagtcctacggaacgggactacggtccggtaccctaccgtttacgaaccttagtaccggtacggggtcggggtaccccggtaggggtaccgggtaacggtacgtaacgggtaacgggtaccggtacgtaacccgtttaacgttacgtttacggttaacccgaacgtaccgtaaagggtacctaagggttacggtacggtacgtacggttaccgggtaaggggtttcgtacggggaccggggtaacgtaaccggttaggttccgggtacccgttagggttaccggtccgaaccgttacccggtaacgtccccggttcccgttacccccggttcgtacccttaccgtttcccgttacccccg

SEQ ID NO: 90095 - DNA, 633 bp, Homo sapiens
  misc_feature: GYAE6OF02JKM1X.21.8.A08.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagcatactctacagggggcgtggtgggcgtcaggaggcagagctctgggaatctcaccatggcctggacccctctcctgctcccctcctcacttctgcacagtctctgaggcctcctatcgagctgacacagccaccctcggtgtcagtgtcccaggacaacggcaggatcacctgctctggagattcattgaccaaaagatatactttgttggttccagcagaagtcaggccacggccctgtactggtcatccatgagccagtcgacgacactccgggatccctgacagattcncttcgcctccgagctacagggacacggtcggaccacctttgacttagtacacgtggggcccagggtcggacgtagtacgaagtcgtacaacgttcgttaagtttacgttaccgcgtaaaccacggtaaccaaggttacggttgggtacaggttcgaacggggggttaacgttaccgggacgggttacgggaaccgtaggttttaccgggaacccgtttccggttacggttaccgaaccggacccggaaacggtcccgttacccgggccccccttacggggtcccctaccgttccggttaccccgg

SEQ ID NO: 90096 - DNA, 666 bp, Homo sapiens
  misc_feature: GYAE6OF02H7EKU.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctagacacacgcccaccctcggtgtcagtcgtcccaggaccaaacggccaggatcacctgctcgtaggagtattcattgaaccaaaaaagattagttacgtttgttcggttaccgagacaagaacgtcgacggaccacggtcccctgtaccgtcggtacacttccagtcggacggccaggtccgaaccgactaccggtccgggactcccgtagacggtatacgttctactcgcctcgacgtccgtacgagggactacgtcgccctacgttgaaccttagtcgtagggtcgggaccgtagggtacggacgtagtacgacgtctacgtactacttagttacgtacgccacgaagacgtaggtacggtcgtacgtagtcgggtaaggggtcgtccgggaacgggacggtaaccgtaggttcccggaacggtttccggttacggtaccgtaccggacccgacgggtcccgtacccggtcccccgttacgggtacccttaccggtccgttccccgg

SEQ ID NO: 90097 - DNA, 595 bp, Homo sapiens
  misc_feature: GYAE6OF02HMFF3.21.8.A08.1.454.CMB.1.raw
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctggagattcattgaccaaaagatatacttgttggttccagcagaagtcaggccaggcccctgtactggtcatccatgagccagtcgacgacactccgggatcccgtgagngtattctctcgcctccgagtcctacgagggacnggtcggcctaccgttgacttatcgtacggtcggggaccctagggtcggacgagtagaagctagtaacttacttagttcgtttaccgacaccagacgtaggttagtcggtacagtcggtaggggttactcggggacgggacggggaaccgtaggttacggtacccggttcggttacggtacgacgacccgaagtccggtacccgccccgttcggttaccctccgttccttccccgg

SEQ ID NO: 90098 - DNA, 600 bp, Homo sapiens
  misc_feature: GYAE6OF02G3VWC.21.8.A08.1.454.CMB.1.raw
tcagtcgtcgctcgcacgaccggtgctcgatttagcatactctacagggggtgggctcaggaggcagagctctgggaatctcaccatggcctggaccctctcctgctccccctcctcactttctgcacagtctctgaggcctcctatgagctgacacagccaccctggtgtcagtgtccccaggacaaacggccaggactcactgctcgtggagacttcattcgaccaaaagatatacttgttgtccagtcagagtcaggtcaggcccctgtactgtcatccatgagccagtcgacgacacgtccggactcccgtgagtagacttcgtctcgtcctccagccttacgaggacaggtcggccctaaccgttgaccttatacgaggtcgggacccgaggtcggaacgtagtgaaacgtctacgaaccttactaagtttcgtacgacctaacgaacgtactacggttagtcggttacacgtcggtaagggggtagttccgggacgggtacggaaccgtaagttacggtacccgttcgtcggtacacggtaccgacggcctccggccccgttcggtcctaccgtccttacgtccccctaccccg

SEQ ID NO: 90099 - DNA, 676 bp, Homo sapiens
  misc_feature: GYAE6OF02JI06Q.21.8.A08.1.454.CMB.1.raw
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggaggcagtcggtccagccgtgggaggtccctgacgcctctcctgtgcagcgtctggattcagtatcggtctcctttgccatgcacgtcgggtcccgcgacggctccgaggcgaaggggctgggagtggggtggcgatttagtcgttggtatggacgtgggaagttggaagagacttagttacttcgagacgtccggttaggaagggccgtacgtaccaccgactacctccgaagaacgtaacgtaaactacggacccaaaaccgtaacaaccgtaaccgtgttaacttcccgtttaacaaacgttaccggaaccccgggtacctacggaacggaacgacccgggaaacgggtaacccgacgggtacgttacttaggttaacttaaccgttaggttaaacggtacgttcggttttacggtaccgttaggttccggggacccggaccgggttaacccgtcgggttacccgg

SEQ ID NO: 90100 - DNA, 611 bp, Homo sapiens
  misc_feature: GYAE6OF02GAM0G.21.8.A08.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (428)..(428): a, c, t, g, unknown or other
  misc_feature (428)..(428): n is a, c, g, or t
tcagtcgtcgctcgcacgaccggtgctcgatttagcatactctacagggggctgtgggctcaggaggcagagctctgggaatctcaccatggccgtggacccctctcctgcctccccctcctcactttctgcacagtctctgaggcctcctatgagctgacacagcccaccctcggtgtcagtcgtccccaggacaaacggccaggactcacctgctctgganattcattgaacaaagatatacttgttgttcagnaagaagtcaggccacggcccctgtactggtacatccgagtcgacggccacggtacgacgaaccncgtaccggactcccgtagagagtacttctactcgcctaccgagtcncggaggacnggtcgcccgtacttagacctagtacgaggtccgggaccgacgggtaggaacgngtagaacgtcgtagaccgttaactacgttacgtaccgacaccgaagaacgttaggtacggtacgttcaagttcgggtaagggttacgtcggggacgggacggaaccgtagtccggtaccgtcggttagtaccgacgtaccggaacgtcgacccgtccccgtcgtccgtaccgttccttcccgg

SEQ ID NO: 90101 - DNA, 548 bp, Homo sapiens
  misc_feature: GYAE6OF02IWYPV.21.8.A08.1.454.CMB.1.raw
  modified_base (218)..(218): a, c, t, g, unknown or other
  misc_feature (218)..(218): n is a, c, g, or t
  modified_base (332)..(332): a, c, t, g, unknown or other
  misc_feature (332)..(332): n is a, c, g, or t
  modified_base (375)..(375): a, c, t, g, unknown or other
  misc_feature (375)..(375): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgccaaaagatatacttgttggttccagcagaagtcaggccaggcccctgtactggtcatccatgaggccagtcgacgacacgtccgggatccctgacgagatttccnctcgccctccagtctcgagggaccaggtcgccaccttgaactntacgaggtcgggcccaggtcggacgagtgaagctagacttactagttcgttacgcaccagacgagtagtggtacagtcgaggggttatcgggacgggtaggaccgtagttggacccggtcgttacggtcgagtcccgaaggtcctcggccccgtcggtcgtacctcgttcccg

SEQ ID NO: 90102 - DNA, 680 bp, Homo sapiens
  misc_feature: GYAE6OF02IHMKI.21.8.A08.1.454.CMB.1.raw
  modified_base (227)..(227): a, c, t, g, unknown or other
  misc_feature (227)..(227): n is a, c, g, or t
  modified_base (323)..(323): a, c, t, g, unknown or other
  misc_feature (323)..(323): n is a, c, g, or t
  modified_base (394)..(394): a, c, t, g, unknown or other
  misc_feature (394)..(394): n is a, c, g, or t
  modified_base (446)..(446): a, c, t, g, unknown or other
  misc_feature (446)..(446): n is a, c, g, or t
  modified_base (627)..(627): a, c, t, g, unknown or other
  misc_feature (627)..(627): n is a, c, g, or t
tcagtcgtcgctcgcacgaccggtgctcgatttagcatactctacaggggctgtgggcgtcaggaggcagagctctgggaatctcaccatggcctggacccctctcctcgctccccctcctcactttcctgcactgtctctgaggcctcctatgacgctgacacagccacctcggtgtcagtgtcccaggtaaccaaaggccaggactcacctgctctggatacttnacttgaaccaaaagaattatacctttggttcgttacctagacctaagtaacgtcgaggccaggtccccctaggtctaggtcatccaatcggagccngtacgacgacgtaccgtaccgggactcccgtagaagacgttatctacgttcgcctcacgctacgaaggacncggttcgaccctcttacggactacgtcggtacggtcggggtaccctacgggnggaaccgtagtacgaacggtcgtactaaccgtaatttacgtttacgtaaccgctaacgacgtaaccgtaaggttacggttacgtaacgtcgtacgttaagggggttctaacgggacggacgggtaaacgtacggttacggtacccggttcggtacggttacccgacggtaccccggttaancccgggtacccgtcccccgtttacggtacccgtaccgttaccgtttcccccgg

SEQ ID NO: 90103 - DNA, 734 bp, Homo sapiens
  misc_feature: GYAE6OF02F9TTC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtctcccgaggacaacgccaggactcacctgctcgtggagtattcattcgaaccaaaagtaatattacgttgttcggttaccagcaaggtacgtcgacggaccgacggcccctgtacgtcggtcactccatggacggccaggtacgacgacgaccgtaccggactccgtagagtagtacttcctcgtacgccctaccgacgccgtacggaacgggacctagggttacccgtacccgttaccgttacgtaacctaacgttccggaagggtcccggggtacccgtaggggttacgggaaccggttagtaacgggaaccggttgtaccggttaaacgttaccgttaagtttacggttaacccgacccgtaacgtaacggaacgtacgttagggtacgtacgtacggtagggttaaccggggtggttacggggaacggtacgggtaacggtagttcccgggtaccggtttaccggtcggtaaccgtacccgtaccggtaacgggtccccgttacccgggcccccgttacggacccttacccgttcccgttacccccgg

SEQ ID NO: 90104 - DNA, 529 bp, Homo sapiens
  misc_feature: GYAE6OF02H9B28.21.8.A08.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagaatatacttgttggttccagcagagtcaggccaggcccctgtactggtcatccatgagccagtcgacgacactccgggattcccgngagagtacttctctcgccctcagctcgagggcaggtcggcctaccgttgactatcgaggtcgggcccaggtggacgagtgaagctagacttactattgttacgcaccagacagtagtgtacagtcgtaggggtacttcgggcgggagggaccaggttcgaccgtcgttggtcacgaccgaggcctcgccccgtggtcctacgtctccg

SEQ ID NO: 90105 - DNA, 730 bp, Homo sapiens
  misc_feature: GYAE6OF02HTS55.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatggagctgacacagcccaccctcggtntcagtcgtccccaggaccaaacggccaggatcacctgctctggagattcattgaccaaaaagaatacttacttgttggttaccagacagaagtcaggcccgaacggtccccctgtacgttggacctactccatggacggaccagtccgacgacaccgtccgggactcccgtagagacgtacttcgtctcgtaccctccacgtctacggaacgggtactacggttaccggggtcctaacccgtttacgaaccttacgtacgaacggggttccggggacccgtaaggggtacggacggtagtacggaacgcgtacgtaccttaacgtttacttcggttaaccgcaaccgagaacgttaggtaacggtggtaccgtaggttacgggtaggggggttacgttacggggaccggggtaacggggaaccgttagggttaccggtacccgggtttacggtttacggggtacccgtaacgggtacccccgaagggttccccgtccccgggttacccccggttaccggggtacccttacccggtttcccgttacccccggg

SEQ ID NO: 90106 - DNA, 633 bp, Homo sapiens
  misc_feature: GYAE6OF02JGV3M.21.8.A08.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagcatactctacagggggctgtgggctcaggaggcagagctctgggaatctcaccatggcctggatccctctacttctcccccctcctcactctctgcacaggctctgaggcctcctatgagctgacacagcccaccctcggtgtcagtgtccccaggacagacggccaggatcacctgctctgcagatggactgaccaaaagaaatatgctttagttacggtaccaaacagaacgccaggcccacggccccttggtcgttagtgatataagtaaagacaactggagacggccctanaagagtactcccgtagacggcgtattcctacgtcggacctacgacgtcgtaccgagggaccacgacctagtccgtaacgtttagactaatccgaagttacgaaacggttcccgaagggaccgaaggacgggtaaccggaggtacctaggtaacctttaagttaccgtagtaaccgaaaacgtaggtaacgaaccgtagttaacgggacgttactagttaggttcgggttacgggtcgggtaacgggaacgacgtacgacgtaccggacccgttcgtacggaccgacggaccgacggtacccgg

SEQ ID NO: 90107 - DNA, 621 bp, Homo sapiens
  misc_feature: GYAE6OF02GNO1D.21.8.A08.1.454.CMB.1.raw
  modified_base (219)..(219): a, c, t, g, unknown or other
  misc_feature (219)..(219): n is a, c, g, or t
  modified_base (339)..(339): a, c, t, g, unknown or other
  misc_feature (339)..(339): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagccaccctcggtgtcagtcgtccccaggacaaacggccaaggactcactgctctgganattcattgaccaaaagatatacttgttggtcagcagaagtcagcaggccctgtactggtcatccatgacgccagtcgacgacacgtccggactcccgagtagagtacttcgctcgtaccnccgaagcctacgagggactaggtcggcctacgttcgactatcgacggtcgggccgtaggtacggacgagtaggaacgtacgtgtaactaacgttagtttacgttaccgaccaaccgtaacgtagtaacggtagttacgtacgtaacgtacggtaagggggttacttacggggaccggaacgggtaaccgtaaggttccggtaaccggttccgtacggtaccgtaacgtacccggtaacggtccgtaccgtccccgtcggtccgtacccgtccttaaccccgg

SEQ ID NO: 90108 - DNA, 646 bp, Homo sapiens
  misc_feature: GYAE6OF02ISFVR.21.8.A08.1.454.CMB.1.raw
tcagtcgtcgctcgcacgaccggtgctcgatttagcatactctacagggggtgggctcaggaggcagagctctgggaatctcaccatggcctggaccctctcctgctcccctcctcactttctgcacagtctctgaggcctctatgagctgacacacgccaccctcggtgtcagtcgtcccaggacaacggccaggactcacctgctcgtggagtattcattcgaaccaaaagaattatactttgttcggttaccagacaagaacgtcacggccacggcccctagtactggtcactccagtgacggcctaggtcgacgacaccgtccggactcccgtgacgagtacttctctcgccctacgacgtctacggacgggactacggtcgcccgtaccttacgacttacgtcgacgggtcgggaccgtagggtacggacgtagtaggaacgtcgtacgacttattagttacgtacaccaccgagacgtagttagtcggtacgtaggttcgggaagggggttacgtacggggacgggtaacggtaacgttacggttcgacccggtttcgttacgggtaccgaccggtaccgtacggtccgtcccggtccccgttacggtcctaccgttccgttacccgttcccctaccccg

SEQ ID NO: 90109 - DNA, 671 bp, Homo sapiens
  misc_feature: GYAE6OF02FEKF0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttgtccagcagaagtcaggccaggcccctgtactggtcatccatgacggccagtcgaacgacaccgtccgggactcccgtgacgagtacttctctcgccctccgacgctacgacggggactacgggtcggaccctaccgtttgaaccttagtacgtacgggtcggggccccgtaaggggtacgggaaccggtagtacgggaacgtcgtacggtaaccgttaacgttacgttttacggttaaccgacctaaccgtaagtacgtaggtagggttacggtacgtagtacgggtaagggggttacttacggggacggggtaaccgggtaaccgtacggttcggtacccggttccggttcgggtaccgtaacggtacccgaacggtcccgtcccggtacccccgttcggtccctaccgtcccgttccccgg

SEQ ID NO: 90110 - DNA, 835 bp, Homo sapiens
  misc_feature: GYAE6OF02IJ61L.21.8.A08.1.454.CMB.1.raw
tcagtcgtcgctcgcacgaccggtgctcgatttagcatactctacaggggggtgggctcaggaggcagagctctgggaatctcaccatggcctggacccctctcctgctcccccctcctcactttctgcacagtctctgaggccctcctatgagctgacacagcccacccgttcggtgtcagtcgtaccccgaggaacaaacggccaaggactaccaccgttgcctcgtgggaagtactttcattcgaaccaaaaaagtaatacttacgtttgttacggttccaaggcctaaggaaacgtcgaacgggtcccacggggtacccccttaggtaacccttagggtacctaacgtttacccgaagttacggaaccgggtaccccgtaaggtacccggaacccgtaaccgtacccggttaccccggggtaacctaccccgttagggaaaccgtaacggttattttccctccgttacgtaccccttccgaaaggtcctacgggaacgggaacgtacggtccgaaccccgttaacttacggaacctagtccggaaggttccgggggaccctaaggggtacgggaaaccggtagtaaggaaaccgtacgtaccgtaaaccgttaaacgtttatttaacggttaaccgaccgtaaacccgaagtaaccggtaagttagggttacgtacgtaacgtcgggtaaagggggttacgttacggggacgggaaacggtacctaagggttcccgacggtttcgtaccgggtacaaccggtacccgaacggttccgtaccccggccccgttacggaccctaccgttccggttcccgttaccctacccccg

SEQ ID NO: 90111 - DNA, 636 bp, Homo sapiens
  misc_feature: GYAE6OF02JC3D2.21.8.A08.1.454.CMB.1.raw
  modified_base (163)..(163): a, c, t, g, unknown or other
  misc_feature (163)..(163): n is a, c, g, or t
  modified_base (367)..(367): a, c, t, g, unknown or other
  misc_feature (367)..(367): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctcctatgagctgacacncgccaccctcggtgtcagtcgtccccaggacaaacggccaggactcacctgctctggagattcattcgaaccaaaagtatatacttggttcgttccagacagtacgtcaggccacggtcccctgtacgtggtacactccagtcggacggccagtaccgacgacaccgtccgggtactcccggtagagtacgtactttctcgtcncctcgcgtctacgacggactaggtccgacctacgtcgtactacgtcgtacgggccgggtccgtagggtcggaacgtggtaacggaactccgtagtaccttaagttcgttacgtaccgactaccgacgtacgtaggtacgttcggtactagtcgggtacggggttgacgggtacgggaacggtacgtacggttcggtaccgttcggtacggtacgtaccgacgtaacggttccgacccgtcccgtaccggtcctaccgttcgtcccccgg

SEQ ID NO: 90112 - DNA, 697 bp, Homo sapiens
  misc_feature: GYAE6OF02JANYL.21.8.A08.1.454.CMB.1.raw
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagtcgtcgctcgcacgaccggtgctcgatttagcatactctacagggggctgtggggctcaggaggcagagctctgggaatctcaccatggcctggacccctctcctgctccccctctcactttctgcacagtctctgacggcctcctatgagctgacacagcctacctcggtgtcagtcgtcccgaggacaacggccagactcactnctnggagatcatcgacaaanatatacttgttacgtcagacagagtcacggcacggccctgtactggtacatccgatcgacggtccaggtaccgacacgtacgtccgggactcccgtgacgtagtacttactcgtacgtccctacgaggtaccgtacggaacggggaacgtacgggtaccgggtacctaacccggtttagaacgttacggtaccgggtccggggtaacgggggtacccgtaggggtacggacgtaacgttacgggacgtacgtaccgtaacttacggtaacgttttaccgtaccggactaaccgaggaacgtacggttacgtccggtataacggtacggggttacgggtacggtccgggaagggtacggttaacccgtgttacccggtaaccggtttcggttaaccggtacgaacccggtaccggtacggtaccctcccgggtacccgtaccgggtaacttccgtacccgttaccccg

SEQ ID NO: 90113 - DNA, 732 bp, Homo sapiens
  misc_feature: GYAE6OF02JNROJ.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtgtcagtcgtccccaggaacaaacggccaggactcacctgctcgtgganttcattgaccaaaagatatacttgttgttccagcagagtcacggcacggcccctgtactggtcactccagtgacgccagtcgacgacgaccgtccgggactcccgtggaacgtaggtacttctccgtcgtacctccgacggaccgttacgacgggacgaacggtccggtaccctaccgttacgtaaccgttacgtaccgtacggggttccggggaccccgtaaggggtaccgggtaacggtaacggtaagggaacggtccgttaacggtaaccttaaccgtttacgtttacgggttaccgaccgtaaccggtaagtaaccgtaaggttaccggttacggtacgtaacggttcgggtaacgggggtttaccggttaccgggacggggtaacggggtaaccgttacgggttaccggtaccgggttccgttaacggggtacctaccggaaccccgggtaaggtcccgttacccggtcccccgttcgggtaccctaccgttcccggttaccccg

SEQ ID NO: 90114 - DNA, 616 bp, Homo sapiens
  misc_feature: GYAE6OF02JGMHU.21.8.A08.1.454.CMB.1.raw
  modified_base (127)..(127): a, c, t, g, unknown or other
  misc_feature (127)..(127): n is a, c, g, or t
  modified_base (173)..(173): a, c, t, g, unknown or other
  misc_feature (173)..(173): n is a, c, g, or t
  modified_base (332)..(332): a, c, t, g, unknown or other
  misc_feature (332)..(332): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttcngcacagtctctgaggcctctatgagctgacacgagccaccgtggtntcagtcgtcccgaggacaacggcaggactcacctgctcgtggatacttctatcgaccaaaagtatatacttgttcggttccagcagagtcaggccacggcccctgtactggtcactccagtacggacgccgtagtcgacgacgaccgtcgggactccgngagtagtacttcgtcgtcgcctcgagtcgtacggacggaacacgtcgacctacgtacgtacgtacgtcgtacgggtcgggaccgtacgggtggaaccgtagtacggaactcgtacgtacttacgttagttacgtaccactaccgagtacgtaggtagtacgtactaggtacgggtacggggttacgtcgggtacgggacggtacgttacggttccggaccgtttcggtaccgtggacccgtaccgaggtcctcccggtccctagtccgtaccgtccgttacccg

SEQ ID NO: 90115 - DNA, 722 bp, Homo sapiens
  misc_feature: GYAE6OF02IWZ6D.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccagatcactgctctggagtacttcattacgaccaaaaagtatatacttgttcggttaccagcagaagtcaggccacgccctgtactggtcatccatggacggccgagtcggaccgtaccgaccgtaccggggactacccgtggaagtagtacttctctcgcccctcgacgtacctacggaacgggtacgtacggtccgcccgtaaccgtttacgaaccttactaccggtacgggtccgggggtaccccgtacggggttacgggacgtacggtacgaaacggtcgttacgtaaccgtttaacgtttaacgtttcggtttaaccgacccgtaaccgtaacggtacggaacggttaacggttcggtactaacggttacgggtaagggggttcgttaccggggacgggtaacgggtaaccgtagggttaccggtccggttacccggttcggtaccgtaccggtacccgtaacgggtcccgtcccggtcccccggttccggtaccgtacccttcccggtttaccccg

SEQ ID NO: 90116 - DNA, 622 bp, Homo sapiens
  misc_feature: GYAE6OF02GVGMY.21.8.A08.1.454.CMB.1.raw
  modified_base (173)..(173): a, c, t, g, unknown or other
  misc_feature (173)..(173): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtntcagtcgtccccaggacaaacggccaggactcacctgctcgtggagtattcattgaccaaaagatatacttgttggttccagcagaagtcaggccaggcccctgtactggtcatccatggaggccagtcgacgacacgtccgggatccctgagagtattctctcgcctccagctcgagggacaggtcggcctaccgttgaaccttagtccgagggtcggggcccgagggtacgggacgtagtggaaagcgtaggacctacgttagttcgttaccgaccacacgacgtaggtagttcggtactagttcggtaagggggttagttcggggacgggtagggaaccgtaaggttcggacccggttccgttgggtccgaccggtacccgaagggtcccgttaccggtcccccgtcggttaccctaccgttccgttaccgttcccccctaccccg

SEQ ID NO: 90117 - DNA, 740 bp, Homo sapiens
  misc_feature: GYAE6OF02FXSBZ.21.8.A08.1.454.CMB.1.raw
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
tcagtcgtcgctcgcacgaccggtgctcgatttagcatactctacagggggcgtggtgggcgtcgaggaggcgagagcgtctgggaatctcaccactggcctggacccctctcctcgcttccccctcctccactttcctcgtccactagtctctgacggccttccagttgagcgtgacacacgccaacccctccggtgtcctacggtnttccccgaggaccaaacggccaaggaatcacctcgctcnggtacgattcngttgacctaaaagaactaatacttgttagttcgtacgtntaacgtagacgtacggaccgacggcccgcgttacgtcggtcgacgtaccaccgtaaggcctaacggcgtaacggacacctcgggaccgtaccctcggtaacgcgtaagttcctctcggtcctaccgtacgccgtacgtacgggaccgacggttacgggaccgtccctttacggaactacgtactaacggtcgggacccgaacggggtttcgggaaccggtaacgtacggtaacgggacgtacggtacgttaacgtacgttttagtaaccggttcgtaaccctacggtaaaccgtaggtaacgttacgggtcgttaacggttccgttaaggggggtactttacggggcgggtaacggggaaccggtacggtacgtacccggttcggtacggttaccgtagccgtacggaccgtcaccccgtcggtaccgtccgttcctacccgg

SEQ ID NO: 90118 - DNA, 747 bp, Homo sapiens
  misc_feature: GYAE6OF02FRJYQ.21.8.A08.1.454.CMB.1.raw
  modified_base (147)..(147): a, c, t, g, unknown or other
  misc_feature (147)..(147): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
tcagtcgtcgctcgcacgaccggtgctcgatttagcatactctacaggggcgtggtgggcgtcgaggaggcgagagcgtctggatctcaccatggcctggacccctctcctgctccccctcctccactttcctgccactagtctctnaggccttcccattcgagctgacacagcccacctcggtgtcagtgtcccccaggacaaggcccaggattccactcgctctggacgattcattgccaaagaatatactgttggtcagtcngaanctaggcaggccccngtcctagccgtatccatgaggtcagtcacgacactcgggatcccngangtatctntcgcctccgagcctcgtcggggaacagttcggggcctacccgttttacgactacgttactagtcggggtcccgaacgggttcggtaaccgggactacggtaaacggaccgtaggtaaccgttacgtaaacgttttcgtttaaaccggtccgtaacccgtaaccggtaaccgtaacggtaaccggggtttaacgggttaccgttaaaaccggttccgttaaacgggggggtaactttttacccggggggaccggggtaaccgggggggtaaccggttaaccggtttaacgggaacccggggttttaacccgttaccggggtaccgtttaaccgggacccgtaaacgggtcccgggttaacggtcccccccggtaacgggttcccgtaaccccgtttcgttacccccgggg

SEQ ID NO: 90119 - DNA, 686 bp, Homo sapiens
  misc_feature: GYAE6OF02I32NP.21.8.A08.1.454.CMB.1.raw
  modified_base (264)..(264): a, c, t, g, unknown or other
  misc_feature (264)..(264): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggagcagtggtccagcctgggagtccctgagcctctcctgtgcagcgtctggattcagtntcggctccttgccatgctacgtggggtcccgccaggctccgaggcgaagggggctgggaggtggggtgacgtattgtcgttggtatggagtgggaagtggagtaagtattaagttacgttacacggtacgtcccggtaggaacggggtccgtaagttccaacctactaccgtaccgaagacgaactaacgtcgaacccgaaacaaccgtacctacgttacgttaactaccgttaacaaacgtaccggaacccggtccgttaaggacggtaaccggacccggtaacgggtaaccgaacccggtattagttacggttaacgtttaacggtaccggttaacggtaacggttaccggttttacgggtaccgttaacggggttccggggtacccgtaaccgggggtaccccgttagggttaaccccg

SEQ ID NO: 90120 - DNA, 744 bp, Homo sapiens
  misc_feature: GYAE6OF02G69YK.21.8.A08.1.454.CMB.1.raw
  modified_base (380)..(380): a, c, t, g, unknown or other
  misc_feature (380)..(380): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacacgccacccgtggtgtcagtcgtccccgaggaaccaaacggccaggactcacctgctcgtaggatattcattgaaccaaaagattatacttgttcgtccagcaagacgtcgacggccacggcccctagtactcggtactacgtcaagtcggaacggccagtaccggaaccgtaccgtaccggtccgggtaacttcccgtaggaacggtactacgttccnccgttcggcccttccgaacgtccgtacggaacgggtacctagggttcccggacccttaacccgttttagaacttacgtaccggtaacgggtcccggggaaccccgtagggggtaccggtaacgtacgtaacgggtaaccgtcgtaacgttaaccgttaacgtttacgtttaacgaaccgtaaccgtaccgaaacggtcgtaaaggttacgttacgtacgtaaggtacgggtaggggttacggtacgggaccggtaacggtaaccgttaggttaccggtaccggttccgtaggtaaccgtaccggaacccgtaacgggtcctaccccgggtccccgtaaggtacccttccgtacccgttaccccg

SEQ ID NO: 90121 - DNA, 768 bp, Homo sapiens
  misc_feature: GYAE6OF02GQ6PK.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctatgagctgacacacgcccacccgtcggtgtcagtcgtccccaggacaaacggccaggatcacctgctcgtggagattcattcgaccaaaagtaatatacgttgttcgtccagcaagagtcaggccacggtcccctagtacgttgcactccagtcgacggtccaggtccgactaccgacgtccgggacttccccgtagaagtacgtactttccacgttccggccctaccgtaaggtccctacgggaacggggtactaacgggtccggaccccttaaccgttacgtaaccgttagtccggtaacgggggttccggggaccccgtaggggtcgggaacggtacgtaggaacgtccgtaacgtaacgtttaacgtttacgttacggttaacccgacgtaaaccgacggtaacgtaaggtttacggacgggtttactaaacggggttccggggttaaacgggggggtttacttccggggggaacggggtaaccgggtacccgttaaggggttccgtaccccgggttcgggtttaccggtaccggaacccggtacccggtaccgggttcccgtcccgggttccccccggtacgggtaccccttacgttccccgttacccccgg

SEQ ID NO: 90122 - DNA, 815 bp, Homo sapiens
  misc_feature: GYAE6OF02HPMAK.21.8.A08.1.454.CMB.1.raw
  modified_base (165)..(165): a, c, t, g, unknown or other
  misc_feature (165)..(165): n is a, c, g, or t
tcagtcgtcgctcgcacgaccggtgctcgatttagcatactctacagggggtgggctcaggaggcagagctctgggaatctcaccatggcctggacccctctcctgcctccccctcctctactttctgcacagtctctggacggccctcctatggagctgacacncgcccacccgtggtagtcaggtccgaccccgaaggaaccgaaaccggccgaaggtactaccaccgtcgccttcgtagggaacgtactttactacgttacggaaacccgaaaaaaggtaattaacgtttacgttttgggttttacgggttaccaaggtacgtaaggtaacgtcgaacgggacccaccggtcccccttaggttaccgtcggtacctacgtacctagtcggaccggacctacggtaccgaaccgtaacccgtaccggtcccgggtacctcccgtaggaacgtacgtacttccgtcgtccgtccctaccgacgtctaccgggacggacgacggtccgacccttacgttcggaactacgtccggtacggggtccgggaccggtagggtacggaacgtacgtaggacgtcgtacggtaaccttagttacgtttacggtaccgacgtaaccgtacgacgtagggtacgtcgggtactacgggtacgggtacggggttacgttacggggaaccgggtaacgggtaccgttaacgggttccggtacccggtcggttacggtaccggaccggtaacccggacggttcccgccccgtccccggttacggacccttacccggtttcgttaccccggttcccccggttacccc

SEQ ID NO: 90123 - DNA, 642 bp, Homo sapiens
  misc_feature: GYAE6OF02HXMH4.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctctgganattcattcgaccaaaagatatacttgttcgttaccagcagagtcacggccaggcccctgtactggtacactccagtcggacgccagtcgacgacaccgtccgggactcccgagacgagtacttctcgtcgcctacgacgtctacgaagggactacggtcggaccctaccgttgaacttacgtcgtacgggtcgggacccgtagggtcggaacgagtaggaacgtctagtaacttacgttagttacgttaccgacaacgaagacgtaaggttacgtcggtactaaggttcgggtaaggggttcgttacgggacgggtaacgggaaccgtaggttaccggtaccggttcgttacggtacgaaccggtacccgaacggtccgttacccggtcccccgttcggtaccctccgttcccgttccccgg

SEQ ID NO: 90124 - DNA, 920 bp, Homo sapiens
  misc_feature: GYAE6OF02JX376.21.8.A08.1.454.CMB.1.raw
  modified_base (191)..(191): a, c, t, g, unknown or other
  misc_feature (191)..(191): n is a, c, g, or t
tcagtcgtcgctcgcacgaccggtgctcgatttagcatactctacagggggctgtgggctcaggaggcagagctctgggaactctcaccatggcctcggacccctctcctcgcctccccctcctcactttctgccacgacgtctctgacggtcctcctatgacgctggaccacgacgccctacccgtggtntccagtccgtacccgaggaacctaacggccacggtactccgtaccgtggtcctcgttagggactaacgttaccagttacggaaacctaaaaaggtaacttacgttaaccgtttggttaccggttacccaaggaccgtaacggtaaacggttccgaccgggaccccgtaacgggtacccccttaggttaccgttgggttacctacgtttacccgagttacggaccgggacctacggtaccggaaccgtaccgtaccggttaccgggtactccccggttaggaacggtacgttaccttcctacgtccgtaccctacgacgtccgtacgacgggactacgggtccgtaccctacgttcgaacgtcgttacggaacgggtccgggacccgtagggtacggtacgtagtacggaacgtccgtacggttaactaccgtttaggtttaccgacccgtaacgtaacccggtagtaaaccgttagggtaaccgggtttcggtaacctaaggggttacccgggggttaagggggttacccgttaaccggggggtaccgggttaaacccggggtaaaccgttttaccggggttaccggtaaccccgggtttaacccggttacgggtaacccccggtaacccgggttacccggggtaaacccgggttccccttaaccccccggggtaccccggtttacccgtaccccggttaccccggtttacccggttttcccccccggg

SEQ ID NO: 90125 - DNA, 764 bp, Homo sapiens
  misc_feature: GYAE6OF02JSKJ5.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggcgtgtgggctcaggaggcagagctctgggaatctcaccatggcctggacccctctcctgctccccctcctcactttctgcacagtctctgaggcctcctatgagctgacacagccaccctcggtntcagtcgtccccaggacaaaaccggccaacggataccaccgtgcctctgggagtacttacattcggacccaaaaaggaatataccgtttagttcggttaccgagctaacggaagttaccgaacggcccaacggcccccgtaggtaccgttggtccgtaactccaagtcgacggtcccagttaccgaccgggaacctaccggttacccggggattcccccggtagaacggtagtaacgtttcccgtactcggtccctacccgtaagtccgtacggaacgggtaacaaccgggttcgggacccctaaacgttttacgaccgttaacgaccgtacggttaccggggacccgtacgggtacgggtaccgaagtacggaagtcgtacgacgttaactacttacgtacgacgtacctagactagtagtacgtagtactcggttaagggtgttacccgggagggtacgggtaaccgtaaggttaccgggtacccgttaccgggtttaccggtactaaccggtaccccggtaacgggtacccggtaccgtacccccgggtttacccggacccggttaccctcccggtttaccccgg

SEQ ID NO: 90126 - DNA, 617 bp, Homo sapiens
  misc_feature: GYAE6OF02FXAQO.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacaggggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganattcattgaccaaaagaatatacttgttggttccagcagaagtcagccacggcccctgtacctggtcactccatcggacggacctaggtccggacgaccgaccgtcccggggtactcccgtggaagtacgtacttcctacgtcgccctaccgagcctacggagggacaggtcgaccctacgttgactatcgaggtcgggccgtagggtcggacgagtagaacgtctaggtacttattagttacgttaaccgacaccgtaagacgtaaggtaggttcggtacacggttacggtagggggtacttcgggacgggtaacggacctaggttcggaccggttcgtaggtaccgacgaccgacggccgtccgtccccgtcgtccgtacgttcgttacccgg

SEQ ID NO: 90127 - DNA, 814 bp, Homo sapiens
  misc_feature: GYAE6OF02HB6MS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccacctcgatgtcagtcgtccccaggaccaaacggccaggatccaccgtgcctcgtagggacattccgatttcgaacccgtaaaaagattaacgtttaccgtttaggttcggtttacccaaggtcctaaaggtaagtccgaacgggtacccgaaccggtccccccgttagtaaccgttcgggtacctaacgttccccgtaagttcggaaccggcccgtaaacggtttaccggaaccggttaaccgaacccggtttcccggggtaaaccttcccccggttagggaaaccggttaacggtaaccttttcggttaacccgtcggtaccccgttaaccgtcggaccgtttaccgggaaacggggtaccttaaaccggggtccgggtaccccctttaaccggtttacgtaaccttaacgtacccgtaacgggttcggggtaccccgtaaggggttaccggtaacggacggtacgtaacggtacgttaacgtacgtaacgtttaacgttcgtaacgtaccaacgtagtaacgtaggttacgtacggtctacgtacggtaggggttacttcgggacggtaggaccgtacgttcggaaccgttccgttagtccgaccgtacgtacggtcgtaccggtcccgtacgtcctacgtcccgg

SEQ ID NO: 90128 - DNA, 675 bp, Homo sapiens
  misc_feature: GYAE6OF02IWNI7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctgctcgtggagtattcattgaccaaaaagatatacttgttcggttccagcagaagtcaggccaggcccctagtactggtcatccagtgacggccagtccgacgacaccgtcgggactcccgtagagagtactctctcgccctcagctcgaggactggtcgcctacgttcgacttacgcgtacgggtccggggcccgtaggggtcggaacgtagtaggaacgtcgtacgtaaccttaacgttacgtttacgtaccgaccaaccgtaacggtaacgtaggttacggtaggtaccgtagttaccgggtaagggggttaccgttaccggggacggggtaacgggtaaccgttaacgggttaccggtacccggtttccggttacgggtaccgtaacggtaccccggtaaggtccccggttcccggtaccccccgttcgggtaccctacccggttacccgtttaccccgg

SEQ ID NO: 90129 - DNA, 630 bp, Homo sapiens
  misc_feature: GYAE6OF02H936O.21.8.A08.1.454.CMB.1.raw
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (340)..(340): a, c, t, g, unknown or other
  misc_feature (340)..(340): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttccnccttgctcttttaagnggtgtccagtgtcaggcgcaacgtggtggagtcgtgggggagcagtggtccaggcctgggacggtccctgacgcctctcctgtgcagcgtctggattcagtatcggctcctttgcctatcgcacgtgggtccccgcaggcctaccgaggccgaaggggctgggagtggggngcgtattagtcgtggtatggataggaagtgagtagattagttaatcacggtacgtccggtaggaacgggcctaattccgaacctatcctacgaaggaacgaacaagtcgaaccaaacgaacacgacttagtactacttaacgaaacgttcggacccgtacgtagaacggtacgacccggaaggaaccgtacggtacttagtacgtttaacgttacgtacggtaacgtacgttacgtttacggtacgtaacggttccggggacccgtaacgggtaccccgttggtaccccg

SEQ ID NO: 90130 - DNA, 782 bp, Homo sapiens
  misc_feature: GYAE6OF02JZ0BT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacctcggtgtcagtcgtcccaggaccaaacggccaggactcacctgcctacgtggagtattcattcgaaccaaaagaatctacgttgttcggtccagtcaagtaagtcgagcccgacggtcccctggtactggtaccactacgacgtgacgcctagtacgaacgtaacaccgtccggggacttccccgtaggacgtacgtagtttcctcgtacgccctaccgagtccgtaacggacgggacctaaggtcggacccctacgtttacgaactacgtacggtaggtaccggggacccgtaggggttacggacgtacgtagggaaccggcgttaacgtaacttaacgttttacggttacgggttaacccacccgtaaacggttacgtaaaccgggttacgggtttaaggtaccggtttaaccgttaacgggtacggggtaacgggggttttaccggtaccggggaagggggtaaccgtaccgttaccggggttacccggttacccggtccgggtttaagggaccctacccgggggttaaccccgtaaccggttcccggttaccccgtacccccgggttaaccgggttccttacccggtttccccggtttaacccccgg

SEQ ID NO: 90131 - DNA, 824 bp, Homo sapiens
  misc_feature: GYAE6OF02ISR6H.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggccctctatgagctgaccacacgcccaccccgtcggtgtcagtccgtccccaggacaaaccggcaggactcgacctgctcgtaggagtacttccagttacgaaccgaaaaagtattattacgttggtttacggttccaggtcaaggtaagtcgacggccacggcccctggtaacctggtactacgtaccagtcgacggtcctaggtaccggacgaccacggtaccgggactcccgtagacgacgtacttccgttcgccgacccgttaccgacggtaccctacgggaacgggacgtacgtccgggacccttaaccgttaccggtaactacgttacggtacccggggtacggggtaccccggttaagggaacggggtaaccgtagtacgggtaactacgggttaccgtaaagtttaacccgttaggtttaacccgggttaacctacccggaaacctaacgggtaccgttaagggtaacggttacggtaccgttaccggtaccggggtaggggttaaccggtccgggggtaaccggggtacgggtaaacccggtaggttccgggtaacccgtttccgggttacggacccgttaccgggacccgtaaacgggttcccgtaccccggtccccggttaccggggtacccttacccggttaccgttaccccggttacccccttacccccgg

SEQ ID NO: 90132 - DNA, 724 bp, Homo sapiens
  misc_feature: GYAE6OF02JVLSG.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggagcagtggtccagccgtggggacggtccctggacgccttcctcctggtcgacaggcgttctggacttcgagttactccggtcttccgttgcccagtcgcctacggttcggggtccccgaccgaggtcctacccgagggaccggaacgggggccttaggggacgggttggggtcggaccgtaagtttagtccggttaggtacttaggagttacggaaggttgggaagtagtaattatttaacgttacgaacgtaccgttccgggtagggtaaccgggtccgttacttacctaccgtacgtccgtaccgaagaacgtactagtacgaacctaaacaacactacgtagttactacttaacgtaacgtacgtacccggtacgtacggaacgacgtaaccggaacggtaccgacggtactacggttacgtaacgttaacggtacgttaccggtagtttaccggtttcggtaacgttacgggttaccggggacccgtaaccgggtacccgttacggtacccgg

SEQ ID NO: 90133 - DNA, 705 bp, Homo sapiens
  misc_feature: GYAE6OF02JIDK9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccacccgtcggtgtcagtgtccccaggacaaaccggccaggactcacctgctctggagtcttcattcgaccaaaagaatatacttgttggttccagcagaagtcacggccaggcccctgtactggtcatccatgacgccagtcgaccgacacgtccggactcccgcgagagtactttctcgtcgccctccgacgtcgttacggaacgggtacacggtcggaccctaccgttcgaccttagcgtacgggtccggggaccccaaggggtcggacgtacgtacggtaacgcctaggtaccgttacgtttagttaccgggtttaccaccgtaaacccacgggtaacctaggggttagttacgggttaccgtaacgttacgggtagggggtttaacgttcccgggggtagggaacggggttaaccccgttaggtttacccgggtaaccccggttttccggttaaccgggtataacccggtaccccggaccggtccggttaccccgggcccccgttaacggtacctacccggttccgtttacccccgg

SEQ ID NO: 90134 - DNA, 895 bp, Homo sapiens
  misc_feature: GYAE6OF02FWL2M.21.8.A08.1.454.CMB.1.raw
tcagtcgtcgctcgcacgaccggtgctcgatttagcatactctactaggggggctgtgggcctcaggaggcacgagcttctgggaatctcaccatggcctggacccctctcctgctccccctctcactttctgcacagtctcgttgaggcctcctatgagactgacacagccaccgtggtgtcagtcgtccccaggacgaacggccaggactcaccgtgactcgtggacgtattcagttcgaccaaaagtattactacgtttgttacggttccagtcaaggtaacgtcgaacggtccgaacgggtccccctaggttaccgtcgggtacaacgttcccgtaagtcggtaacgggtccctaaggttaccggaaacgtaaccaccgttaccggggtacttccccgtaggaaacgtacgtaacgtttccgtacgtaccggtacccgttaccgaaggtcccgttaccggaaacggggtaccctaagggttaccggtaccccttaaaccggtttacgaaaccgtttaacgttaccgtaaacggggttacccgggggtaccccgttaaggggttaccgggtaaacgtaacgttaacgggtaaacggtaccgttacgttaaccgttaaaccgtttaacgtttaccggttaaacccggacccgttaaacccgtaacggttaaaccgttaacggttaacgggtttaccggtacctaaacgggttaccggttaagggggtttaaccggttaccggggtaaccgggtaaccggggtaacccggttaacggttaccgggtaacccggtttaccggttacgggttaccgtaaccggttaccccgtaaaggttcccgttaccggttaccccccggttacggtacccgttaccgttacccgtttaccccgg

SEQ ID NO: 90135 - DNA, 691 bp, Homo sapiens
  misc_feature: GYAE6OF02I3FXV.21.8.A08.1.454.CMB.1.raw
  modified_base (367)..(367): a, c, t, g, unknown or other
  misc_feature (367)..(367): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcactgctctggagtattcattcgaaccaaaaagaataatacgtttgttcggttaccagcaagaagtcgaacggccacggtccctgtactggtcatccatgaggccagtccgacgacacgtccgggactccgtgagtagtacttctactcgtccctaccngcccgtacgaacggggacacggttcgggaccctaccgttgaaccttacgtaccggtagggtccgggggacccgtaacggggtacgggaacggtaagtacggaacggtaccgtacgtaaccttaacgttagtttacgttaccggacctaacccgaagtaacgtaaggttacggttggtacgtagtacgggtaagggggttaccggtcgggacgggtaacgggtaaccgtaacgttcgggtaccgtcccggtttacggaccggtaacgtcccggaacggtccgttacccggtccccgtaccgggtcctaccgttcccgttacccgg

SEQ ID NO: 90136 - DNA, 792 bp, Homo sapiens
  misc_feature: GYAE6OF02JZA7V.21.8.A08.1.454.CMB.1.raw
  modified_base (143)..(143): a, c, t, g, unknown or other
  misc_feature (143)..(143): n is a, c, g, or t
  modified_base (273)..(273): a, c, t, g, unknown or other
  misc_feature (273)..(273): n is a, c, g, or t
tcagtcgtcgctcgcacgaccggtgctcgatttagcatactctacaggggtgggcgtcaggaggcgagagctctggaagtctcaccactggcctcggacccctccgtcctcgctcccctcctccactttctgcacagtctctnacggcctcctatcgagctgacacagccaccctcggtgtcagtcgtcccaggacaaacggccaaggctcacctgcctactcggagattcgattgaccaaaagactatacgttgtggttccagctagacgtnacgccgagtcccctgtacctggtccactcctagcgtaacggcccgaagtccggtacgaacgtaccgtacccggggattccccgtagaggaacgtacttcgtaccgtccggtaccttaccgacgtcccgttacgacggggaacctaacgggttcgaccccgtaacgttccgtaaccgtacgtaaccggtcggtaccgggtacccggtaacgggtcggtaaccggggtaacttaggggaaaccgtcggttacggtaacccgtttacgtaacgtttacggttaccgaacgtaaccgtaacgtaccgagggttaacgttcggtacgtaacgtccgggtaagggggttaactttaccgggggacggttaaccggggacccgttaaaggtccggtttaccgggtaccctttttacggggaaccgtaacccgggtaccgtaaaaccggggttccctttaccggtccccccggttaacgggtaccccgtacggtttaccccgtttaccggtcccccttaaccccggg

SEQ ID NO: 90137 - DNA, 683 bp, Homo sapiens
  misc_feature: GYAE6OF02GXN29.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctcgtggagatcattgaccaaaagaatatactttgttcggtccagcagaagtcaggccacggcccctgtactgtactatccgagtcgacggccagtcgacgacaccgtccggactccgtaggacgagtacttcctcgtcgcctaccgtagccgtacggacgggacctacggtcggtaccctaccgtttgaactcgtcgtacgggtccgggtcccgtaagggtacgggaacggagtacggaacgtcgtacgtaacttacgttacgttacgtaccgactaacccgagtaaccgtaggttacggttcggtacgtaacggttacggtaagggggttacgttaccgggggacgggtacggggtaaccgtacgggtttccggtacccggttcggtttacgggcctaacccggtccggtaaccggtccgtcccggttacccccggttaccgggtaccttacccgtaccgtttcccccgg

SEQ ID NO: 90138 - DNA, 720 bp, Homo sapiens
  misc_feature: GYAE6OF02IQ9PA.21.8.A08.1.454.CMB.1.raw
  modified_base (546)..(546): a, c, t, g, unknown or other
  misc_feature (546)..(546): n is a, c, g, or t
tcagtcgtcgctcgcacgaccggtgctcgatttagcatactctacagggggctgtgggctcaggaggcagagctctgggaatctcaccatggcctggaccccctctcctgcctcccccctcctcacctttctgcactagtctctgaggccctcctatgagctacgacacacgcccaccctggtgtcagtcgtccccgaggaaccaaaccggccaggactccaccgtgacctcgtaggagtacttcgattaccgaaccgaaaaagtaagttacttacgtttcggttcgttaccgagactaaggtacgtcgacggccgaccgtcccgtaggtaccgtgtacctacgacctagtacggtacggacccgtaaggtaccggtaaccggaacgtacccggttaccggggaaccttcccggtaacgggacgtaagtactttccgtaccgttccgacccgttaccgacgtcccgtaaccggacggtaacctcgggtacgtacccttcgtttaccgacttacgtaccgacgggtccggacgtcgggtcgtaacgngtaacggtagtcgtacgtacttaacggttactttacggaccgactaacgtacggtactaggtccgttaggtaccgtagtacgggtaggtacggtcggaacgggtacgacgtaggtacgtccgtcggttgacgccggtacgacggctcccggacccgttgacctcgttccgcccg

SEQ ID NO: 90139 - DNA, 650 bp, Homo sapiens
  misc_feature: GYAE6OF02FV2GH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctctggagtatcattgacaaaagatatacttgttggtccagcagaagtcaggccaggcccctgtactggtcatccatgacggccaggtcgacacacgtccgggactcccgtagagagtcttctctcgcctcagctacgagggactaggtcggccctacttgaactactcgtaacgggtcggggaccccgaggggtcggaacgtagtacggaacgcgttacggaacttacgttaagtttcggttaaccgacctaaccgaagtaacctaaggttacggttacggtaccgtaagttacgggtagggggttaactttccggggaccggggtaagggtacccgtaagggtttcggaaccccggtttccggttaggtccgaacggtaaccccggaggtcccgttccgggcccccggttacggtaccctacccgtccgttaccccgg

SEQ ID NO: 90140 - DNA, 866 bp, Homo sapiens
  misc_feature: GYAE6OF02HKUAL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccaccccgtcggtcgtcgagtccgtcccccgacggaaccaaaccgggccgaggactccacctgcttcgtgggagtattacagttacgaccaaaaagaattattacgtttggttacggttaccagacgaaggaacgtcgaacggcccacgggccccttggtacgttaggtcactaccctagtcgacggccacggtaccgaccgacaccgtccggggtactcccgtaggagtactacgttcctctcgccctcgacgtcgtacgacgggtacgagttcgacccctacgttcgacctacgtacggtcgggtcgggaccccgtagggtacggaacggagttaccgggacggtccgttaacggtaaccctttaacgttaccgtttacgggttaacccgtcccgaaaacccggtaacgggtaaacgttaacggtttaccggggtacggttaccggtaacgggtttaacgggggttaaccgggggggttttacggttccccggggggaaacggggtaaccgggggttaccccgggttacgggggtttacccgggttaaccccccgggggttaaccgtttaacccgggggtaaccccgtaaccgggtaaaccccgggtaccccgggttcccggttaccccccgggttacccccccgttaccggggggtttaccccctacccggtttacccggtttaccccccccgggg

SEQ ID NO: 90141 - DNA, 732 bp, Homo sapiens
  misc_feature: GYAE6OF02IXBZP.21.8.A08.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttcngcacagtctctgaggcctctatgagctgacacagcccaccgtcggtgtcaggtcgtccccaggaacgaaacggccaggtactcacctgctacgtgggactattcatcgaaccaaaagtactatacttggttacggttaccagacaagtaagtcgaacggcctacggccccttggtactcggtacctaacgtccagtaggacggtccgagtacgaccgaactaccgtaccgggactcccgtaggacgtaagtactttccgcgtaccgtcctaaccgaggtccacggtaacggggactacgggtaccggtccctaacccgttaggtaaccttacgtaccgggtacgggttaccggggtaccccggaaggggtacgggaacggttaagacggtaacgacgttacgtaaacgttaccgttaagttcggtaaccgacgaaccgtagtaaccgaggttaacgtcgggtactaacggtaccggtaacggggttacggtccggaaggggtaaccgaaccggttagtccgggtaccgttacggtcggtaccaccggaaccgtaaggcccgttaccccggacccggttaggtccccttacggtcccgttccccgg

SEQ ID NO: 90142 - DNA, 715 bp, Homo sapiens
  misc_feature: GYAE6OF02JR9H7.21.8.A08.1.454.CMB.1.raw
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (359)..(359): a, c, t, g, unknown or other
  misc_feature (359)..(359): n is a, c, g, or t
  modified_base (422)..(422): a, c, t, g, unknown or other
  misc_feature (422)..(422): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgacgctgacacacgcccacctcggtntcagtcgtcccaggacaacggccaggctcactgctcngganatcatcgacaaaagatatacgttgttcgtcagcaagtagtcacggaccacggtccccgtagtactggtaccacgtccaggtcggacgcctagtaccgaccgactaccggaccggtactcccgtagacgacttacttccncgtacgtccctaaccgcggtactaccggaggtacctacggtcccggtaccctacggtttaacnccgttacgtaccggtacgggggtccggaaccccggtaggggtaacgacggttaaacgtagggaaacgtttcgacgttaaacgttacgtttagttaccgtaccgaacctaaccgaaggtaccgtaaggttaggttaccggtctaacggggttacgggttacggggtccgttaaccgggtaccgggtaaccgggaactttacgggtccggttaacccggttccggttaggaccgaacccgtaccgggtacgtcccgtcccggtaccccgtggttacctacgttccccgtacccgg

SEQ ID NO: 90143 - DNA, 634 bp, Homo sapiens
  misc_feature: GYAE6OF02GLD2V.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagtattcattcgaccaaaaagatatacttgttggttccagcagaagtcaggccaggcccctatactggtcatccagtgaggccagtcgacgacaccgtccgggatccctgagacgattctctgccctccagcctcgagggacaggtcgaccctacgttgaactagtcgaggtcggggacccgtagggtcggacgagtaggaacgtcgtacgtaacttacgttagtttacgttaaccgacaacccgtaagaacgtaaggttaggttacggtaccgtagttacgggtagggggttaacgttcgggacgggtaacggggtaccgtaaggttcggtacccggttccggttacggtaccgaaccggacccgtaacggtcccgtccggtacccccgttcggtaccctccgttccgttccccgg

SEQ ID NO: 90144 - DNA, 630 bp, Homo sapiens
  misc_feature: GYAE6OF02I8GU7.21.8.A08.1.454.CMB.1.raw
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
tcagtcgtcgctcgcacgaccggtgctcgatttagcatactctacaggggggctgtgggctcaggaggccagagctctgggaatcctcaccatggcctggacccctctcctgctcccctctcactttctgacactagtctctgaggcctctagtgagtctgacactagccctaccgtggtgtcagtcgtcccgaggacaacggtccagactcacctgcctgcggaatacttcattcgaaccaaaagtaactagtacctggttacgtccagnaacgtaagtccaggtcccacggcccttgtaaccgtgtcattccatcggaagccagtaccggaacacgaccgtccggatcccgtgacgtaancttcacggtcacctcggagtcaccggaggacagtcgacctacgttgactacgtcagggtacgggcctagggtacgagtacgagtaacncgtacgtattactagttcgttacgcctaccagactaggtagtcaagtactacggtaagggttacgtacgggtacggagggtacccgtaggttaccggtacgttcccggtaaggtacgaacccggtaccgaaacggtccgttacccgtaacccgtccgggttactacccgttccgtcccgg

SEQ ID NO: 90145 - DNA, 544 bp, Homo sapiens
  misc_feature: GYAE6OF02IFAUD.21.8.A08.1.454.CMB.1.raw
  modified_base (214)..(214): a, c, t, g, unknown or other
  misc_feature (214)..(214): n is a, c, g, or t
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagtcgtcgctcgcacgaccggtgctcgatttagcatactctacagggggtgggctcaggaggcagagctctgggaatctcaccatggcctggacccctctcctgctccccctctcactttctgcacagtctctgaggcctcctatgagctgacacagcccaccctggtgtcagtcgtcccaggacaaacggccaggatcacctgctctgganattcattgaccaaaaagatatacttgttggttccagcagaagtcaggccaggcccctgtactggtcatccatgacggcagtcgacgacacgtccgggacttcccgngacgagtatttccncgtcgcccttcagcctacgacgggacaggtcggacctacgttgactatcgaggtcgggaccagggtggacgagtgaagctagacttactattgtacgcacagacagtgngtacngtcgaggggttcttcgggcggaggactagtcgtaccgtcgttggcacgccgaagtctaccggcccctgggtcctacgtccgtccgtaccctccccg

SEQ ID NO: 90146 - DNA, 854 bp, Homo sapiens
  misc_feature: GYAE6OF02GO3A8.21.8.A08.1.454.CMB.1.raw
tcagtcgtcgctcgcacgaccggtgctcgatttagcatactctacaggggctgtgggctcaggaggcagagctctgggaatctcaccatggcctggacccctctcctgcctcccctcctcactttcctgcacagtctctgaggcctcctatcgagctgacacagccaccctcggtcgtcacgtcgtccccaggaccaaacggtccaggactcacctgactcgtggagattcattgaccaaaagaatatacttgttcggtccagctagaacgtcacggccgaggcccccgttagtaacctggtaccctaatcccgagtcggaacggaccctacggaccggaacgtaaccgtaccgtaccggggtaaaccttccccgttagggaaggtaaccgggtaacttttcccgtacgttccgggtccccttaacccgaacgggttccgttaaccccggaacggggggtaacttaccggggacccgggttaccccgtaacccgtttttaaccgggaacgtttaacccgttaccgtaacgggtaccggggtaacccggttaaacggggttacgggaaccggtacggtaacggtaaacgggtccgttaacggtaccgtttaaacgtttaaccgttttacggtttaaccgggaccgtaacccgtaaccggtaacgttaacggtaacggttcgggtactaacggttacggtaacgggggttaacgttcgggtaacgggtacgggtaaccggttaggttaccgtacccggggttacccgtttagggtacccgtaaccggtacccggtaaacggtccgtaccccgggtccccgttaccggtacccgttacccgttaccgtttcccccgg

SEQ ID NO: 90147 - DNA, 614 bp, Homo sapiens
  misc_feature: GYAE6OF02F8D2F.21.8.A08.1.454.CMB.1.raw
  modified_base (222)..(222): a, c, t, g, unknown or other
  misc_feature (222)..(222): n is a, c, g, or t
  modified_base (370)..(370): a, c, t, g, unknown or other
  misc_feature (370)..(370): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtgganattcattgaccaaaagtatatacgttgttggttccagcagaagtcgaggccacggcccctgtactggtcactccatgaggccagtcgacgacacgtccgggactcccgtagacgagtacttctctcgcctccgagtctacgacggacnggtcgccctacttagactagtccgaggtcgggacccgagggtcggacgagtagaagcgtagacgttactagttacgtaccgacaccgagactaggtagttcgtacagtcgggtaggggttcgtccgggacgggtaacgggaccgtaaggttccggtaccggttcgtttacgggaaccgtacggacccgaacgggtcccgtccggtccccccggttacggtaccctacccgtccgtttaccccgg

SEQ ID NO: 90148 - DNA, 720 bp, Homo sapiens
  misc_feature: GYAE6OF02JRCZY.21.8.A08.1.454.CMB.1.raw
  modified_base (558)..(558): a, c, t, g, unknown or other
  misc_feature (558)..(558): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacggcctcctatgagctgacacagcccaccctcgatgtcagtcgtcccaggacaaacggcaggactcactgctcgtggatattcattcgaccaaaagtatattacgttgttcggtaccgagactagtaacgtcgacggcccgaacggtcccccttaggtacctggtaccaactccgaagtcggacggaccgacggtaccgaccgtaccaccggtcccgggacttccccggtaaggagtacgtactttcgcctcggtccctacggacgtccgtacggagggtaccgtacggtaccggacccctttacgtacgggttacctacggtaccgtacggggtaccggggtacccggtaggggtaccggtacgtagtaggaccgtcgtacgtaactacgttacgttaccgtacgactaacganacggtaagtggtacgtacgtaacggtacgggtaagggttcggtaccggggaacggtacggggtacgttaaccggtacggtacccggtttacggtacggtacccggaacgtaccggtacggtcccgtacccggcccccggttacgtccgtacccgttccccgg

SEQ ID NO: 90149 - DNA, 781 bp, Homo sapiens
  misc_feature: GYAE6OF02JK1N6.21.8.A08.1.454.CMB.1.raw
  modified_base (128)..(128): a, c, t, g, unknown or other
  misc_feature (128)..(128): n is a, c, g, or t
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttcngcacagtctctgacggcctctatgagctgacacagcccacctcggtctcagtctcccaggacaacggccaggactcacctgctcgtgganattcattcgaactaaaagatatacttggttcgttaccagtacagtaacgtcgaggccacggtcccctagtacgtcggtacaacgtccgtagtacgacgggtacctaaggttccgaaaccggacctaacccggtccggggtaaccttccccggtaggaacggtaactcgtttcctacgtaccgacccttccgaaggtccttaacggaacggtactaacggtccggaccctaacgttcggaaacttaccgtccggtacgggttacgggccccgttaaggggtcgtaaccgtagtacggtaacgtcctaacggtaacctaacggtttaacttcgggttaacccggacctaccgtaaaggttaccctaagggttcgtaccggttaccgtacgttaacgggggttaaccgggtttcggttaaacccgggacggggtaaaccggtacgttaaggttcccggttacccggttaaggttaccgttaccgaacccgggtaaccccgttacggaccgtttcccccggtaccccgttaacgggtttaccctcccgttacccggttaacccccgg

SEQ ID NO: 90150 - DNA, 731 bp, Homo sapiens
  misc_feature: GYAE6OF02JOBYQ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccaggaccaaacggcaggatccacctgctcgtaggagatcgctattacgaacctaaaaaatttgtttgtttttacgaccagcaaggtacgtcgacgaccgtacggccccgttggttaggttcggtacctactacccgtagtaggtacgggaacctaggggacgaacccggtacccggtccgggactcccgtagacggtaacgtacttcgtacgtcggtacctaccgaacgtcggacggggtaccgggtcgccgtacgttcgtattccgtacgagggtccgggaccgtagggtcggtaaggtagtagaacgtcgagtaccgtaacgttgtacgttacgcgtacgtaacgagacgtacgtacggtagtacggtactacgggtcgggtaacggggccttaacgggttccgggggacgggtaacccggtaccggtaggttaccggtaacccgtcgggttaacgggacctacccgggtacccggaacggtcctccccgggttaaccccgtccgttaacgtcccgtttcccgttacccggttaccccc

SEQ ID NO: 90151 - DNA, 836 bp, Homo sapiens
  misc_feature: GYAE6OF02GMM6O.21.8.A08.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttcngcacagtctctgacggcctcctatgagctgacacacgccctacccgtcggtgtcacggtcgtacccccgaaggaaccgaaaccggccaaggactaccacctgactcgtaggaatacttacattacgaaccaaaaagtaacttagttacgttggtttacgttaccagtacgaaggtaacggtacgacgggccccgtaaccggtcccccgttaggtaccgttcggtacctaacttacccgtaggtacggtaaccgggtcccgtaacggtaccggaacccgtaacccggtacccggttaacccggggtaaccctttaccccggtaggaaaccggttacgttaacctttccgtaccgttccgtaccccgtaccgtacggtccgtacggaacgggtacgtaccggtacccggtaccctacgttacgaaccgttacgtaccgggtacgggtacccggggtaccgtaacggggtacggtaaacggtacgtaacgggaaccgttaccggtacgttaaccgttaacgtttacgtttaacgtacccgtaacctaccgtaacgtaaccgtagggtacgtcggtaacgtacggttacgggtacggggttacgtaccggggacggtaacgggtaccttaacgggtccgtacccgttcgggtacgtaccgaccgtaccgtacgcccgtccggtacccgtcgtacctccgttcccgtcccg

SEQ ID NO: 90152 - DNA, 689 bp, Homo sapiens
  misc_feature: GYAE6OF02FOXWL.21.8.A08.1.454.CMB.1.raw
  modified_base (174)..(174): a, c, t, g, unknown or other
  misc_feature (174)..(174): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgacggcctcctatgagctgacacagcccaccctcggtntcagtcgtccccaggaccaaacggccaggatccacctgcctcgtggatattcattcgaaccaaaagaattattactttgttcgttccagcagaagtcgaggccacggtcccctgtacgtggtcactccatggacggccagtcgacgacaccgtccgggactcccgtagagagtacttctctcgcctccacgtctacgacgggactacggtcgacccgtaccttagactacgtcgagggtccggggacccgtagggtacgggacgtaggtacggaacgtcgtacggaacctttacgttacgtttcggtaaccgacctaaccgaacggtacctaggttacgtacggtacgtacggttcgggtaagggggttacgttccggggaacgggtacggtaaccgtaacggttccggtacccgttccggttacgggtaccgaccggtacccggtaacggtcccgttccccgtccccggttccgttaccgtacccgtttcccgttccccgttccccgtcccccg

SEQ ID NO: 90153 - DNA, 643 bp, Homo sapiens
  misc_feature: GYAE6OF02JJND7.21.8.A08.1.454.CMB.1.raw
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (377)..(377): a, c, t, g, unknown or other
  misc_feature (377)..(377): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtccagtcgtccccaggaccaaacggccaggactcacctgctctggatattcattgaccaaaagactatacttgttggtccagcagagtcaggccaggcccctgtactggtacatccagtgacggccagtcgacgacaccgtccggatcctgagngattcnctacgccctcagctcgagggactagtcggacctaccgtttnaaccgttacgtccgaaggttcggggaccctagggtcggaacgagtcggaagtccgtagtaccgttaacttagttacggttaaccgcgtaacccgtagaacgtaaggttacgtacggtacgtacgttaccgggaagggggtttccgttacgggacgggacgggttaacccgtaagggttcgaacccggttccgttaggtaccgacggtacccgtaacgggtaccttcccggtacccccgtcggttacccgtaccttcgttcccccgg

SEQ ID NO: 90154 - DNA, 730 bp, Homo sapiens
  misc_feature: GYAE6OF02IRT7Q.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctctatgagctgacacagcccaccctggtgtcagtcgtacccgaggaacaaacggccaggactccactgctcgtgganacttcattcgaaccaaaagtaatattacgttgttacgttaccagacgaagaagtcaggccacggcccctagtacgtcggtctactccgagtcggacggtaccgagtaccgacgaaccgtaccgaccgggtaactcccggagacggaagtacttctccgtcgaccctaccgacgtccgtacgaacgggtacacggtcgacccttaccgttaggaaccttactacggtacgggtaccggggaccgtagggtacgggtacgagttacggaacggtcgtaacgtaacgttaacgtttaacgtttacggtaaccgtaccgtaaaccgaagtaaccgtaggttacggtacgtacgtaacggtacgggtaaggggttacgttaccgggaacggggtacgggtaaaccgttacgggttacggtaaccccggttccggttacggtaccgtacggaaccccgtaacggtcccgtacccggtaccccctaggtacccgtacccgttacgttacccccgg

SEQ ID NO: 90155 - DNA, 666 bp, Homo sapiens
  misc_feature: GYAE6OF02ID3MN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaacggccaggatccaccgtgcctcgtggagtacttcattcgaaccaaaaagtaacttattacgttgttggttaccagcaagaagtcgaggccacggccccttgtaccgtggtcactccagtggacggtccagtccgaacgaccaccgtccgggactccgtagagtagctttctctcgcccttccgagcctacggacgggactaggtccgtccctaacgttgaacctactacgtacggtcgggaccgtagggtacggacgtagtacggacgtacgtcgtacgttacgttacgttacgttaccgacgtaccacgtacgtagtacggtagtacgtagtacggtacggggttaggtacgggtacggaacgggggggtaacctaggttaccggtaccggtccggttacggtccgtaccggtacccgtaacggtccgtccggtccccgttccggtccgttaccgtccgttaccccgg

SEQ ID NO: 90156 - DNA, 675 bp, Homo sapiens
  misc_feature: GYAE6OF02HKK0C.21.8.A08.1.454.CMB.1.raw
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctctatgagctgacacagcccaccctcggtgtcagtcgtcccaggacaaacggccaggatcactgctctgganatnattgacaaagatatacttgttgttccagcagagtcaggccacgccctgtactggtcatccatgacgtcagtcgacgacacgtccgggactccgtgagagtattctctcgcctcagctcgagggacagtcggccaccttggaccttagtacgaggtcgggacccgtaggacgggacaagtagaaacgtccgtaggtaaccttaaacgttactttacggttaaccgaccgtaaacccgaagtaacgtaaggttaacggttacgggtaccgtaagttaccgggtaacggggggtttaacgttaccggggtacgggaacggggtaacccggtaaagggtttccggtaacccggtttccggtttacgggtaccctaaccgggtacccccgtaaacgggcccgtttacccgggaccccccccggtttacgggtcccttaacccggttccccgttccccggg

SEQ ID NO: 90157 - DNA, 611 bp, Homo sapiens
  misc_feature: GYAE6OF02GCHY0.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctctgganattcattgaccaaaagaatatacttgttggttccagcagaagtcaggccaggcccctgtactggtcatccagtcgaggccagtcgacgacacgtccgggatcccgtgagagtacttctctcgccctccagctcgagggactagtcggaccctacgttgacttacgtcgacggtcggggacccgtagggtcggacgtagtacggaacgtccgtagtaaccgttaacttacgtttcgttaaccgactaaccgaacgacgtaaggtaggtcggtacacgtcggtaaggggttacgtacgggagggacggaccgtaggttcggtaccggttccgttcggtacgaacggtaccgaacggtccgtccggtcccccgtcggtcctaccgttcgttccccg

SEQ ID NO: 90158 - DNA, 705 bp, Homo sapiens
  misc_feature: GYAE6OF02H38T7.21.8.A08.1.454.CMB.1.raw
  modified_base (129)..(129): a, c, t, g, unknown or other
  misc_feature (129)..(129): n is a, c, g, or t
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctggaaccctctcctgcctccccctcctcactttcngcacagtctctgaggccttcctatgagctgacacagcccaccctggtntcagtcgtacccaggacaaacggcaggatccacgtgctcgtaggatattcgattcgaccaaaaaagtacttatacgtttgttaggttccagacaagaagttcgacggccgacggaccccttgtacgtcggtacacttccagtggacggtccgaggtaccgacgaccgaccgttacccggggacttccccgtaggaacgtagtactttccgtccgttcggaccccttaccgacgtccgttacgaacggggtacctaggtccggtacccttacgttcgaactttagtccggagggtccggggacccgtaggggtacggtaacggagtaacgacggctaggtaaccttaacgtttagttacgttaccgccaacctaggacgtagttaggtcgtacgtacgtacgggtaggggttaccgtacggggacggaacgggtaaccgtaggttccggtaccgttcggttcggtaccgacgtaacccgacggtccgtacccggtccccgttaccggtcctacccgttccttcccccgg

SEQ ID NO: 90159 - DNA, 696 bp, Homo sapiens
  misc_feature: GYAE6OF02F4MU7.21.8.A08.1.454.CMB.1.raw
  modified_base (225)..(225): a, c, t, g, unknown or other
  misc_feature (225)..(225): n is a, c, g, or t
  modified_base (381)..(381): a, c, t, g, unknown or other
  misc_feature (381)..(381): n is a, c, g, or t
  modified_base (438)..(438): a, c, t, g, unknown or other
  misc_feature (438)..(438): n is a, c, g, or t
tcagtcgtcgctcgcacgaccggtgctcgatttagcatactctacagggggtggggcgtcgaggaggcagagctctgggaatctcaccatggcctggacccctctcctcgctcccctcctccactttctcgtcacagtctctgacggtcctcctatgagctagacacagccacccgtcggtgtcagtcgtcccaggacaacgccgaggatcacctgactcgtganattcattcgactaaaagaatatacttgtcgttccagcaacgaagtcgacgaccgtacggccccgtgtaacgttggacctaacgtccaagtcggacgaccgacgtacgaaccgacgtaccggtcgtaacgttccgtacgaaggtactatccgttacncgcctcccgagcgttaccgagggaactacgcggtacccgtaaccttggaaccttacncggtacgggtcggggtacccgtaggggacggtaacggaagttcggaaagtcgtacgtaaacggtacttaaggttagtacccgtcaaccgtataaccggagtaacgggttcgtacgtacggtacgggttagggggtaacgttcggggaccgggtaggggaaccgtagggtacccggtacttcgggtcgtacggacgtacccggagtcccgaccggttcccggtccggtcgtacccgtacgttcccgttaccgtccccgg

SEQ ID NO: 90160 - DNA, 687 bp, Homo sapiens
  misc_feature: GYAE6OF02ISFTT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggatattcattcgaccaaaagatatacttgttggttccagcagaagtcaggccaggcccctgtactggtcatccatgacggccagtcgacgacacgtccgggactccctgacgagtattctctgccctaccagtcctacgagggaccaggtcggccctaccgttgacctagtcgaggtccggggacccgtagggtcggacgtacgtaggaacgtccgtagaaccgttacgtttagtttcggtttaaccgaccgtaaccgaaggtaaccgtaagggttacggttacgggtacctaacggttaccgggaaggggggtttacgttaccggggaaccggggtaaggggtaacccgtaagggtttccggacccgggttttccgtttacggggtaccgtaacggtaccccgtaacgggtcccgttacccgggtaccccccggttccgggttaccctacccggttcccgtttaccccgg

SEQ ID NO: 90161 - DNA, 721 bp, Homo sapiens
  misc_feature: GYAE6OF02ICJ25.21.8.A08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtcggtntcgagtcgtacccgaaggaaccgaaacggccgaggactcaccgtgtctcgtagggatacttacagttacgaacaaaagtattacttacgtttggtttcgtaccgtagacgaagaagtcacggccgacggtcccctggtactcggtacactccgtagtcggacggccagtccgaacgaccaccggtccggactcccgtaggacgacgtacttacgtcgtcgtccctacgcacgtcgacggacgtaaggtccggaccctaccgttaggaccttacgtaccgacgggtccggggacccgtagggtacgggtacgtaagtacggaacgtcgtacgtaacttaacttacgtttacggtacacgaccgaagacgttaacggtaggttcgacgtaaggtcggtaaggggttcggtaaccgggacggggtaacggtaaccgtacgggtttacggtacccggttcccggttaggtacccgaacccggtaccgtacgggtccctacccgggtccccgttacgggtaccctccgttcccgtttacccccggg

SEQ ID NO: 90162 - DNA, 647 bp, Homo sapiens
  misc_feature: GYAE6OF02F2N2N.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganattcattgaccaaaagaatatacttgttggttccagcagaagtcacggccacggcccctgtactggtcactccagtgacggccagtcgacgaccaccgtccgggactcccgtagagagtactttcgtcgtcgtccgtaccagtcctacggaacgggactaggtcggccctacctttacgacttactcgaggtcggggaccgtagggtggaacgagtacggaacgtcgtagtaaccttaacttagtttacggttaaccgccaaccgtacggaacgtagtaacgggtcgtacgtagtcgggtaaggggttacgttacgggacggggtaacggaccgtaacggttcggtacccggttccgttagggtaccgaacggacccgaacggtccgtcccggtaccccgttcggtacctaccgttcccgttaccccg

SEQ ID NO: 90163 - DNA, 610 bp, Homo sapiens
  misc_feature: GYAE6OF02HTGFC.21.8.A08.1.454.CMB.1.raw
tcagtcgtcgctcgcacgaccggtgctcgatttagcatactctacagggggtgggctcaggaggcagagctctggggaatctcaccatggcctggacccctctcctgctccccctcctcactttctgcacagtctctgaggcctcctatgagctgacacagcccaccctcggtgtcagtcgtcccaggacaaacggccaaggatcacctgctcgtggatattcattgaaccaaaaagtaattaattacttggttggttacagaccagaagtcacggtccacggcccctgtactgggtacactccatggacggccagtcggacacgacgtcgggactccctgagagtattctctgcctcacgctacgtaggactaggtcgcctacttagactacgtcacgggtggggaccctaggggtacggacggagtaggaactacgtagtacctaatgtttagttaccgacaccgagtacagtagtcgtagagtacgggtaggggttaacgttacgggcgggagggaccgtaagcgttacggtaacccggtcgttaacggcgtaaccggccgtaacggcctaccgtccccggtgtcccacttcccgtccttacccccg

SEQ ID NO: 90164 - DNA, 704 bp, Homo sapiens
  misc_feature: GYAE6OF02GZ8XQ.21.8.A08.1.454.CMB.1.raw
  modified_base (171)..(171): a, c, t, g, unknown or other
  misc_feature (171)..(171): n is a, c, g, or t
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagcttgggttttcctccttgctcttttaaagnggtgtccagtgtcaggcgcaacgtgggtggagtcgtggggggagcagtcggtaccaggcccgtggggacggttccctggacgccttctcctgtgcagcgtctggatcagtntcggcttcctgctatcgcacggtcgggtcccncgaggtcctaccgaggtaccggaaggggtctgggaggtgggtgaccgtagtttatcgtagggttataggagtagggaagttggacgtagtattattaacgtcgaagtaccgttacggagggtaaccgggctaacgtttacccaacgtctacccgtaacggtactaacggtaaacctaacgtaccgaaccaaacaaccgtactaccgttagtacttaccgtaacgaaacgttaccgaaccgtaccgtaaggaacggaaccgtaaccgggaaacggtacgtaacccgtactaagttacggtttaactaacggttacggtaacgtacggttacgtttacgggtacgttgggtaacccgggaccgtttaaccggacccgtttacggtaacccgg

SEQ ID NO: 90165 - DNA, 698 bp, Homo sapiens
  misc_feature: GYAE6OF02FKWDO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagtattcattgaccaaaagaatatacttgttggttccagcagaagtcaggccaggccccctgtactggtcactccgatggacggccaggtcgacgaccacgtccgggactcccgtaggacgagtattccgtctcgccctccagcctcgacgggactagggtcggccctaccgttgaaccttagtcgtacgggtacggggccccggtaggggtacgggacggtagtacggaaagtccgtacgtaaccgttaacgtagtttacggttaccgacccgtaacccgaacgtaaccgttaaggtacggttcggtaacgtagttaccgggtaacgggggttaacgtttaccggggtacggggaacggggtaaccgttaacggttaccggtacccggtttccggttacggttaccgaaccggtacccgaacggtcccgtacccggtaccccccggttccggtaccctcccggttccgtttacccccgg

SEQ ID NO: 90166 - DNA, 536 bp, Homo sapiens
  misc_feature: GYAE6OF02IC3P3.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggcccctgtactggtcatccatgaggccagtccgacgacacgtcgggatcccctgagagattctcgtgcctccagctcgaggacagtggccacttgactatcgaggtcgggccgaggtggagagtgaagctgactacttattgttacgcaccagacagtagtgtacagtcgaggggttacgtcgggacggagggacctaggttcgtaccggtcgttggaccgtagacccgaggcctcggtacccccgtcggtacctaccgtcttcccgg

SEQ ID NO: 90167 - DNA, 712 bp, Homo sapiens
  misc_feature: GYAE6OF02IYTTN.21.8.A08.1.454.CMB.1.raw
  modified_base (134)..(134): a, c, t, g, unknown or other
  misc_feature (134)..(134): n is a, c, g, or t
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngtctctgacggcctcctatgagctgacacacgccacccgtcggtgtcagtcgtacccaggaaccaaacggccgaggactcacctgctcgtggatntcatcgaacaaaagatatacgttgttcgtacagcgagacgtcgagccgacgtccctagtacgtggtacactaccagtacgacgaccagtacgaaccgacgtaccgtccgggactacccgtaggacgtaacgtagttccgtcgtcgtccctacgacgtccgtacggacgggtactacggtccgcctaaccgttgacctagtaccggtaggtaccggggaccgtagggtaccggtaacggaagtaacgaacggtccgttaacggtaaccgttaacgtttacgttacggttaaccgaccgtaacggacgtaacgtaggttaacggtacgtacgaacggttacgggtaacgggttacgtcggggtaacggtacgggtaaacctagggtttaccggaccggtttccggtacggacgttaaccggaccggtaacggtcccgtacccggttaccccggttaccggtccttaccggtaccgtttcccccgg

SEQ ID NO: 90168 - DNA, 756 bp, Homo sapiens
  misc_feature: GYAE6OF02JUT7O.21.8.A08.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagcatactctacaggggctggtgggcgtcgaggaggcgagagctctgggaatctcaccatggcctggacccctctccctgcctccccctcctccacctttcctgccacagtcctctgacggcctcctatgagcctgacacacgcccaccctcggtcgtcagtcgtcccccgaggaccgaaaccggccaaggactccgacctgcctccgtggacgattccattcgaaccaaaaagtatatactttgttcgttaccagcagaatcaggccacggcccctgtactgcancatgacgcctagtccgacgactaccgccgggtacctcccgtgacggagtacttccgtcgtccgtccctaccgacgtcctaccggaggggaacctacgggtccggacccccgttaaacccgtttggaaccctttacgtaccggtacgggtaccggggaccccggtaacggggtccggaaccggtaacgtaacgggaacgtacggttaccgtaaccggtttaaccgttaaggtttaccgttaccgacccgtaccgtaaacggtaccgtaaggttaggtaccggtactaacggtacggtaagggggtacgttaccggggacggtaacgggtaaccgtaggttaccggtacccggtccggttacggtacgtaacccgtccggtaaaccggtccggtaccccggtccccggttaccgtacccggtacctccgttaaccccgg

SEQ ID NO: 90169 - DNA, 653 bp, Homo sapiens
  misc_feature: GYAE6OF02GEJCU.21.8.A08.1.454.CMB.1.raw
  modified_base (217)..(217): a, c, t, g, unknown or other
  misc_feature (217)..(217): n is a, c, g, or t
  modified_base (329)..(329): a, c, t, g, unknown or other
  misc_feature (329)..(329): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatccacctgctcnggagattcattgaccaaaagaatattacttgttggttccagctagaagtcaggccaggcccctgtactggtcactccagtgaggccagtcgacgacacgtccgggactcccnggacgagtacttcctctcgcccttccgagtcctacggaagggacctagttaccgggcctaacccgttgaccttacgtcgtacggtcggggaccccgtagggtacggacgaagtacggaaggccgtagaaccgttacttagtttacggttaccgtacctaccgaacgtaacgagttacggttggtacgtaacgtcggtaagggggttacgttcggggaccgggaacgggtaaccggtagttccggtaccggttccgttgggtaccgaccggacccgtaacggtccgtaccggtcccccgttcggtcctaccgttccgttaccccg

SEQ ID NO: 90170 - DNA, 727 bp, Homo sapiens
  misc_feature: GYAE6OF02JGAY4.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacgagtctctgacgcctctatgagtctgacacacgccctaccgtcggtgtcaggttccgtaccccgaggaaccaaacggtccaaggactccgacctgctcgtaggagtactacgattcgaacctaaaagtaagtattacgttgttcggttaccagtcgtaagacgtcgaacggcccacggtccctacggtacgtcggtacagtccgagtcggacgtaccagtaccggaaccgtacaccggtaccgatacccgtagtaacgtcgtacttccgtacctcgtaccctccgtaacggtcctaacgggacggtaactacggtccggtaccttacgtacgactacgtcggtaccggtaccggccggttagggcgaacgtactcgggtaactcgtaacgtacttacgtagttacggacctaccgacgaagtacgtcgttagtccgtagacgtacgggtagggttacggacgggtacgggaacgtacggttaacgggttccggtacgttacccgggtagtaccggtaacccgtaaccggtccggtacccgttacccggtaccccgggtccggtttaacccgtcggtttcccggttacccccgg

SEQ ID NO: 90171 - DNA, 790 bp, Homo sapiens
  misc_feature: GYAE6OF02IJPGS.21.8.A08.1.454.CMB.1.raw
tcagtcgtcgctcgcacgaccggtgctcgatttagcatactctacaggggggtcgtgtcgggctcaggaggcagagctctgggaatctcaccatggcctggacccctcgtcctgcctcccctcctctactttctgctacagtctctgacggtcctcctatgtacgctcgaacactacggcccacccgtcggtcgtccacggtcgtaccccgaggaacaaacggccgaggactacacctgctcgtaggatacttcagttacgaaccaaaagaatacttacgttgttcggtacaagacaagaacgtcgacgaccacggtccctgtaccgtgtacactccagtcggacgccgacgtaccgacgacgaccgtccgggactccgtagacgtagtacttcctcgaccggtacccctcgacttccgttacggacgggtactacggtaccggaccttaccgttacggaaccgttagtaccggtacgggttaccggggaccgtaacgggtcggtaacggtacgtaacggaacgtccgtacgtaaccgttacgtttacgttaccggttaccgacccgtaacgaacggtaccgtacggttacggttccgtaccgttacggtacgggtaacggggtttaccgtaccggggaaccgggtaacgggtacccgtaacgggttacccggtacccggttaccggtttcggtaacccggtaaccggtaccccggtaaccgggtcccgttaccccggttacccccggttacccgggttaccttaccccggttcccgtttaaccccccgg

SEQ ID NO: 90172 - DNA, 1059 bp, Homo sapiens
  misc_feature: GYAE6OF02JRGPW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagccctacccgtggtagtcacgttcgtcccccgaaggacgaaaaccggccaggatccaaccttgccttcgtacggagtactttcgacgtttacggaaccctaaaaaaggtactttaacgttaaccgtttttggtttacgggttttacccaacggtacctaaacggtaaacggttaaccgtaacggggaccccgtaaaccgggtccccccgttagggtttaaacccttcgggggttaccgtaaccgttttaccccgaacgtttacgggtaaccgggcccgtaaaccgggtttaccgggaaacccgtaaaccggtaaccccgttacccgggggggtaacctttaaccccggttacgggtaaccgggaacgttaaccgtttaccgttcccgttaccgtaccccgtttaccccgaacggtccccgttacggtaaccggggtaaccgtaaccgggtcccggggtaacccgttaaccccggtttacggacccgtttaacgtacccgggtaacggggttacccgggggtaccccggggtaagggttacggggtaacccggtacgggttaaacgaaaccgggtccggttaaacggaccgtttaaacgtttaccgtttaaccggttaaccgttacccgtaaaccgtaacgggtaaaccgttaaccgggttaaagtttccggggtaaccttaacgggtaccgggttaacgggggtttaacgttccgggggaacgggttaacgggggaacccgttaaggggttacccgttaacccggggttttacccggttagggtttaaccccggtacccggtaaccccggtttaacgggtaccccggtttacccggtaacccccgggtttccccgggttaacccgttaccggttaccccggttttaacccccccggg

SEQ ID NO: 90173 - DNA, 689 bp, Homo sapiens
  misc_feature: GYAE6OF02IW1Y0.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggactcacctgctctggagtattcattgaccaaaagatatacttgttggttccagcagaagtcaggccacggcccctgtactggtcaatccatgacggccagtcgaccgacaccgtccgggtactcccgtggacgtatactttctctcgccttccagcctcgaagggacagtcgcctaccgttgactacgtcacggtcgggacccgtagggtcggacgtagtacggaacgtcgtacgtaacttacttacgtttacggttaaccgacgtaacccgaggtaacgacggttaacggttcgggtacctaagttaccgggtaagggggggtttaaccgttccggggtaaccggggtaacgggtaacccggttaacgggtttacgggtaacccgggtttccggtttacgggttacccgtaacggtacccgaagggtccccgttcccggtaccccccggttccgggtacccttacccgttcccggttaccccggg

SEQ ID NO: 90174 - DNA, 770 bp, Homo sapiens
  misc_feature: GYAE6OF02JVV2T.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctagacacagcccaccctcggtctccagtcggtccccgggaacaaaccggccaggactccacctgctccgtggagatcgctatacgaaccaaaaaatttgttggtttttcggaccagtactaacggaagtaccgacggccgacggtccccttaggtgttcggtctactccgagtggaacggtacgaggaacgaccggaccccgttccggggacttcccgacgagacgtacttacgtcgtacggtcctaccgtaaactcgggacgggtaccggtacgtaccgtacggttcgaactttcgacggtaccggggtcggggtacccgtggggtacggggtaaggtacgtacggggtaacgtcgttaaggtaaccctttacggttacgttaccggtttaccaggtaaccgacgaacgaccgtacgtacgacggtttaccggacgtaccgacgggaagggtcggtaccggttccgggaacgggtacgggtaaccgtagggttacccgtacggtaccggtagtaacccgggtccggttaaaccccggacggttacccgccccggttccccggtaccggttacccgtcccgtttacccggttccccggtaacccccgttccccg

SEQ ID NO: 90175 - DNA, 857 bp, Homo sapiens
  misc_feature: GYAE6OF02HHDFB.21.8.A08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcatactctacagggggtgggctcaggaggcagagctctgggaatctcaccatggcctggacccctctcctgctccccctcctctactttctgcacagtctctgaggcctctatgagctgacacacgccacccgtcggtgtcagtcgtcccaggacaacggccaggactcactgctcgtganattcattacgaaccaaaaagtatacgttacgtttggttacggttaccaagacgaaggtaacgtcgaacgggcccaacgggtcccccgttagttaaccggttgggtacctacgttacccgaaggttacggaaccgggtacccgtaacgggttaacccggaaccgtaaacccgtaccccgggtttaacccggggggacctttaccccggtaagggtaacggtaaccggtttaatttcccggttaacctccggtaccccttacccgacggttaccgttaccgggaaacggggtacctacggggtaccggtaccccttaacggttacgtaacctacggtaccggtaacgggtccgggggtacccgtaaggggtacggtaacggtacgtacgggaacgtcgtaccgttaacgttaacgtttaaggttccggttaaccaccgtaaaccgaacgtaacgacggttacgggtacggtaactacggtacggggtaaggggtttacgtccggggacgggtaaaccgggtaacgtaacgggttcccgtaccggttccggttacgggtaccgaccggtacccgtaaggttcccgtacccgtaccccggttcggtaccctacccggtttccgttcccgttacccccgtacccgg

SEQ ID NO: 90176 - DNA, 633 bp, Homo sapiens
  misc_feature: GYAE6OF02IPHB3.21.8.A08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagcatactctacagggggcgtgtgggctcaggaggccagagctctgggaatctcaccatggcctggacccctctcctgcctccccctcctcacctttctgcacagtctctggaggcctcctatgagctgacacagccaccctcggtntcagtcgtccccaggacaaaccggccaggactcacctgctcgtggagattcattcgaccaaaagatatacttgttgtccagcagaagtcacggccaggcccctgtacctggtcactccatcgaggccagtccgacgacacgtcccgggatccctgacgtacacttctacgtcgtcctccgagcctcgacgggacacggtcggcctaccgttgactactacgagggtcgggcccgagggtcggaacgtagtagaacggtctacggtaaccttaacgttagtttacggttaccgacccgaaccgtacgacgtaaggttacggttcggtacgtagtacgggtacgggggttacgttcgggacggggtacgggaaccgtaggttacgaccggttccttacggtaccgacgtacccgaagggtcctcccggtccccgtcggtcctaccgtcttccccg

SEQ ID NO: 90177 - DNA, 544 bp, Homo sapiens
  misc_feature: GYAE6OF02GOREZ.21.8.A08.1.454.CMB.1.raw
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccaccctcggtgtcagtcgtccccaggacaacggccaggatcacctgctcgtggatattcattcgaccaaaagatatacttgttggtcagcagaagtcaggccacggcccctgtactggtcatccatgacggccaggtccgacgacaccgtccgggactcccgtagacgagacttctctcgcctcacgctcgaggacngcgcctacttgactatcgaggtcgggccgagggtcggacgagtacgagctagacttactagttcgtacncacagacagttagtcgtacagtacggaggggttgtcgggacggacgggtaccgtagtcggaccgttcgtcggtacgacgccgaggtcctccgccccgtgtcctactcgtcccg

SEQ ID NO: 90178 - DNA, 942 bp, Homo sapiens
  misc_feature: GYAE6OF02FUPRR.21.8.A08.1.454.CMB.1.raw
tcagtcgtcgctcgcacgaccggtgctcgatttagcatactctacaggggtagggcgtcgaggaggcgagagctctgggaatctcaccatggcctggaccctctcctgctcccctcctcactttctgcacacgtctctgagcctctatgagctagacacagccacctcggtgcagtcgtcccaggacaacgccgaggactcaccgtgctcgtaggtagtacttcagttcgaaccaaaaagacttaataaccgtttgttcggttacctaagcgtacgaaaggttcaaggacctacggacccccgttcgtaagttcgggtacctaacgtacctaagtcgaacggcgtaacggtccgaccgaacgtaccgtccgggtaacgtcccttgggaacgtaccggtatttccggtactaccggtcccgttaccaacggttcctaacgaccgggtaacgtcgtaccgggtcccacctttacggaacttaacttcggacggaccgggtaccgacgggtacgggaccggtagtaaggtaccgtcggtacgtacgttaactttcgtaacggttacggtaccctaacggtacgaaacgttaagggtaacggtttacgggtacgttaaacgttccgggttaaaggggggtttttaaccgtttacccggggggggtaaccggtaaacggggggtttaaaaccccggtaaacgggggttttacccgggtttaaaccccggggtaacccgtttttttaaacgggggggtccccccggttaaaaagggggttaacccccccgggttaaaacggggtttacccggggttaaacccccccgggtccccccgggggttttttaccccggggtttttaaaaacccccggccccgggttttttaaccccccggtttttttaacccccggggtttaacccccccccgtttaaccccccccccgggg

SEQ ID NO: 90179 - DNA, 744 bp, Homo sapiens
  misc_feature: GYAE6OF02GQJRM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgctacagtctctgaggcctcctatgacgctcgacacagacccaccctcggtcgtactacgtcgtcccccagggaccaaacggccaaggactcacctgctctacggatacttcattcgaccaaaagatattactgttgttcagtcagagtcgaggtccagcccctgtactcggtcatccattcgaggtccagtacgacactaccgtcggactcccgtgagtaacgtcttcgtactcgacctccgaacgtctcgtaaggggacctacggtacggtccctaaccggtttcgaacgtttactaccggtaacgggtccgggtaccccgtaggggtacggtaaccggtagtacgggaacgttccgttagaccgtttaaacttaggtttaccgtaccgaccaaccggaactaaccggtacggttacggttacggggacttaacgggttacgggtaacgggggttaacgttccgggaacggggttacgggaaccgttaagggttcccgggtaaacccggtttcggttacggtttacccggaacggtacccggtaaacgggccccggtttaccgtcccccggttaccgggttaccccgttaccggttacccgtttacccccgggg

SEQ ID NO: 90180 - DNA, 896 bp, Homo sapiens
  misc_feature: GYAE6OF02GLOGI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggacggcctctatgagctgacacacgcccacccgtcggtcgtcgagtccgtacccgaggaaccgaaaccggccaaggactccaccgtcgctcgtaggatattcagttcgaaccaaaaagtaattaacgttacgttggttggttacccagtacgaaggtaagtccgaagggtacccgacggtcccccgtaggttaccgttcgggtacctacgtacccaagtcggacggacccgtacggtccggaaccggtaaccaccggtcccggggaaccttccccggtaggtacggaagttaccgtttcctacgttccgtcccttaccgacggtaccgtaccggggaaggggacctacggggtacccggtacccttaaccgtttacgaacccgttagtaccggtaacgggggttcccggggtaacccggaaggggtttaaccggggaacgtaaagttacggggaaacgtccgttacggtaaacccgtttaacgttacggttttacggtaacccggtacctaaaccggaacgtaaacggtaagggttacggttacggttaaccgaacgtttaccggggtaacggggttaccggttaaccggggaacgggggtaaccgggtaaccggttaacgggtttaccggtacccccggggtttacgttaccgggtaaccggacccggttaacccgtaccgggggtcccttaccccggggttccccccggttaccgggtccccgttaacccgtttcccggtttaacccccccgg

SEQ ID NO: 90181 - DNA, 874 bp, Homo sapiens
  misc_feature: GYAE6OF02HH2YI.21.8.A08.1.454.CMB.1.raw
tcagtcgtcgctcgcacgaccggtgctcgatttagcatactctacagggggctgtgggctcaggaggcagagctcgtgggaatctcaccatggcctcggacccctctcctgcctccccctcctctactttctgcacagtctctgacggcctcctatgagctagacacacgcccaccgtcggtgtcagtcgtaccccgaggaaccaaacggccaggactaccaccgtgactcgtaggagtacttacagttacgaaccgtaaaagtaacttattacgtttcggttcggttaccaagacgaagtaacgtacacgggaccaccggtcccctagtacgtcggtactacgtaccgagtcggacggtaccacggtaccgaaccgtacgaccggtccgggaccttccgaggaacgacgttacttccgtcctccgtacccgtacgaccgtacgtacggaacggtacgtacgggtcccggaccctaccgtttagaaccgttacgtaccgggtacgggtacccggggacccggttaaggggtacggacggtaacggtacgaaccggttacgtacgttaacctttaagtttaacgtttccgggtaaccaccggtaaaccgacggttaaaccggtaaggttttccggtaaggttaccggtaacggtttaaccggggggttaggggtttaaccgggggttaccgggggaagggggttaaacccggggttaacgttaacccgggggtttggtaacccccggggtttcccggtttaacggggtacccggtaaacccgggtacccccgggtaaaccggttcccggtaacccccgggttcccccgggtttaacggttcccctttaacccggttcccgttttccccccccggg

SEQ ID NO: 90182 - DNA, 514 bp, Homo sapiens
  misc_feature: GYAE6OF02GMFBD.21.8.A08.1.454.CMB.1.raw
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctggtgtcagtgtccccaggacaaacggccaggatcacctgctctggagattcattgaccaaaaagatatacttgttggttccagcagaagtcaggccaggccccctgtactggtcatccatgaggccagtcgacgacactccgggatcccgtgagagattctctgcctcagctcgaggaccagtcggccacttgactagtcgaggtcgggcccagggtagacgagtgaagcgtgactactattcgtacgcacagacagtagngtacagtcgagggtatcgggnggacggacagttgaccgtcgtggtcagtccaaggcctcgccccgtgtccactctcgtccctaccc

SEQ ID NO: 90183 - DNA, 799 bp, Homo sapiens
  misc_feature: GYAE6OF02GESD4.21.8.A08.1.454.CMB.1.raw
  modified_base (164)..(164): a, c, t, g, unknown or other
  misc_feature (164)..(164): n is a, c, g, or t
tcagtcgtcgctcgcacgaccggtgctcgatttagcatactctacagggggctgtgggctcaggaggcagagctctgggaatctcacatggcctggacccctctcctgcctccccctcctcactttctgccacagtctctgacggcctcctatgagctgacacncgccaccctggtgtcagtcgtacccgaggaccaaacggccaggactccacctgctcgtggagtacttcattcgaaccaaaagtatatacgtttgttcggtccagctaagaacgtcgaggccacggtcccctggtacgtggtaccacgttccgaagttcggacgcccgtaaggtccgaacgaccgtaccggtccgggtacctacccgtaggacgtacgtactttccgtccgtcgtacccctccgtaaggcccttacggaacggggaacctacgggttacccggccccgtttaaccgtttccgggtaaacctttacggttacccggaagggggttcccgggggtaaccccggtaagggggttaccgggaaacgtcggtaacgggaacttaccgtacgtaacgtttaacgttacggtttagttaacccgccgaaccgaacggtaacgtaacgggttgtacggttaacccgagttaccggggtaaggggttcgttaccggggagggtaaccgggtaaccgttaggttacccggaccggttttcccgggtaacggttacccgaacccgggtacccggttaaccggtccggttacccgttacccggttaccccgtacggttacccgaccgttttcccccgg

SEQ ID NO: 90184 - DNA, 855 bp, Homo sapiens
  misc_feature: GYAE6OF02I1I44.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgacgctgacacacgccaccctcggtgtcagtcgtccccgaggaccaaacggccaggactccgtaccgtcgcctcgtggagtacttcaatttcgaaccctaaaaaagtaacttaacgttaaccgtttttggttttacggttacccgtaacgacgtaaggtaaaacggttccgaaacggggtcccctaaaccggggtccccccttagggttaaccgttacgggttacctaaacttccccgtaaggttacgggaaccggggcccgtaacgggttacccggaacccggtaaacccgtacccggttacccggggtaaccttccccggtaaggacggtaacgttacctttccgtaccgtcgtaccccgttaccgaccggtactacgggaacgggaacctacggggttcgacccctaccgtttacggaacttacgtacgtacgggtaccggggacccgtaggggtacgggagtaacgtaggtaacggccgttacggaacgtttacgttaagtttcggtaaccgcgtaacccaggaaccgtaagggttacgttaggttaccaggttaccgggaacggggtttacggttaccggggtacgggaaaccgggttacggtacgggtttacggtacccggtttacgttacggtccgacggaccggtacggacccgttcccggtaccccggtcggtacccgtacccgttccgtcccg

SEQ ID NO: 90185 - DNA, 889 bp, Homo sapiens
  misc_feature: GYAE6OF02HSDBH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgagcctcctatgagctgacacacgcccacctcggtgtacagtcgtcccaggacaaaccggccaggactccacctgctcgtggagtacttcattcgaaccaaaagtatacttacgtttgttcggttaccagtaccgaagtaacgtccgacggaccgaacggtccccgttagttacgtacgggttactaaccttcccgtaagtacgggaccgggtacccaacggtaccgaaccggtaacctaacccgggttacccgggaaccttccccgtaggaacggtacggtacttttccttaccgtccgtcccgtaccgtacgccgttaacggaacggggtaccgtacggtccgggtaccctaacccgtttacgaccttacgtacggtaccgggtaccggggacccggtaggggtacgggtaaccgtaaggtacgggtaacgtacggttaccgtaaccgtttaaacgtttacgttttaaccgtttaacccgggacctaaaccggtaacggtaacgtaacggggtttaacggtacggttacccgttaaagggttaccggggtaaacgggggtttaacgggttaccggggaacggggtaaccggggtaacccgttaccggggttttacggaccccgggtttacggtttaccgggtacccggtaacccggttaaccccgggtaaccgggttacccgttaccccccggggttcccccgtttaccggggttaccccttacccggtttccccgtttacccccggg

SEQ ID NO: 90186 - DNA, 637 bp, Homo sapiens
  misc_feature: GYAE6OF02GRKW6.21.8.A08.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagcatactctacagggggctgtgggctcaggaggcagagctctgggaatctcaccatggcctggacccctctcctgctcccctctcactttctgcacagtctctgagcctcctatgagctgacacagccaccctcggtgtcagtgtccccaggacaaacggccaggatcacctgctctgganattcattgaccaaaagatatacttgttgttcagcagaagtcaggccaggccctgtactggtcatccatgagccagtcgacgacacgtccgggactcccgtagacgagacttctctcgccttccagtccgtcgacgggactaggtacgaccctaccgttgaaccttagtcgtacgggtccggggacccgtagggtacggacgtagtaggaagtcgtagaacttacttagtttacgtaccgcaccgtagacgtagttagtggtagacgttacgggtaggggttacttcgggacggtaacggggaccgtaacggtttcggtaaccggttccgtttacgggtaccgtaacccgggtacccgtaacggggtcccgttacccgggtccccccgttaccgggtacccgtacccgtttccgttcccccgg

SEQ ID NO: 90187 - DNA, 547 bp, Homo sapiens
  misc_feature: GYAE6OF02G6AJ7.21.8.A08.1.454.CMB.1.raw
tcagtcgtcgctcgcacgaccggtgctcgatttagcatactctacagggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtctgggggagcatggtccagcctgggaggtccctgagcctctcctgtgcagcgtctggattcagtatcggctcctttgccatgcactgggtccgccaggctccaggcaagggggctggagtgggtggctattatctggtatgatggaagtgagagatattattcagactccgtgaagggccgattcacatctccagacacaatgaccaaacaacacactgtatcttcaaatcgacccgcgtgagacgaccggacggaacgaccggactagtacgtaatttacgtagttaccggtagtccgtttggtacgtacggtttcggggacctacggggtacccgtggtacccg

SEQ ID NO: 90188 - DNA, 670 bp, Homo sapiens
  misc_feature: GYAE6OF02JIGD4.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganattcattgaccaaaagatatacttgtgttcagcagagtcagccaggccctgtactggtcatccagtgaggacaggacgaccgaccctccgggatcccgtagacgagtattcctacgtcggacctccgaactcggaagggtacggtcgggaccctacggtttacgactttcgtcgagggttcggggacccgtagggtacgggaggtacgtgaacggtcgtacgtaaccttaccgtacgttacggttaactacgtaacgaccgtacgaaccgagacgtaggttacggtaccgtaacgttcgggaacggggtaccgtaggttaccgggacggggacgggtacccgtagggttaccggacccggttaaccggttacggtaccgtaaccggtacccgtaacgggcccgttacccggtcccccgttacggttaccccgtaccgttccgttccccgg

SEQ ID NO: 90189 - DNA, 164 bp, Homo sapiens
  misc_feature: GYAE6OF02FPMI3.21.8.A08.1.454.CMB.1.raw
  modified_base (161)..(164): a, c, t, g, unknown or other
  misc_feature (161)..(164): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggagtttgggctgagcgggctggcaaggcgcatagnnnn

SEQ ID NO: 90190 - DNA, 543 bp, Homo sapiens
  misc_feature: GYAE6OF02FU901.21.8.A08.1.454.CMB.1.raw
  modified_base (104)..(104): a, c, t, g, unknown or other
  misc_feature (104)..(104): n is a, c, g, or t
  modified_base (216)..(216): a, c, t, g, unknown or other
  misc_feature (216)..(216): n is a, c, g, or t
  modified_base (331)..(331): a, c, t, g, unknown or other
  misc_feature (331)..(331): n is a, c, g, or t
tcagtcgtcgctcgcacgaccggtgctcgatttagcatactctacagggggccgtgggctcaggaggcagagctctgggaatctcaccatggcctggacccctntcctgctccccctcctcactttctgcacagtctctgaggcctcctatgagctgacacagccaccctggtgtcagtgtccccaggacaaacggccaggatcactgctctgganattcattgaccaaaagatatacttgtgttccagcagaagtcaggccaggcccctgtactggtcatccatgaggccagtcgacgacacgtccgggatccccgtgacgagatttccnctgcctccgagctcgaagggtacaggtcgaccaccttgactatcgagtcgggcccagggtcggacgagtagaacgctagaacttattagttgttacgcaccagaccagttagtggtacagtcgaggggttatcgggacggtaggaccgagttcgaccgtccgttcggtcacgcccgaagcgtaccgcccctggtccacgtccgtgtaccccc

SEQ ID NO: 90191 - DNA, 743 bp, Homo sapiens
  misc_feature: GYAE6OF02HB2IS.21.8.A08.1.454.CMB.1.raw
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctctatgagctgacacacgccctacccgtcggtcgtcaggtcgtccccgaaggaccaaacggccaggactcacctgcctcgtggagtattcattcgaaccaaaagtaatattacgttgttacggttccagacaagaacgtcgacggccacggcccctgtacgtgtcatcctatggacggccaggtaccgacgacaccgaccggatccctagagatntcctgtcncctacagtctacgaagggactacggtcggaccctaaccgtttacgtaactacgtacgtacgggttaccggggcccctaaggggtaaccggtaacggtaggtaacggaacggtaccgttaacggtaaaccttaacgtttaacggttaccggttaaccgtaacccaaaccgttaacgaaccgtaaagggttacggttacggtaacctaacggttaacggggtaacggggttttaacgggtccgggaacggggtaacggtaacccggtaacgggtttaccggtaacccggttccgggtttacgaacgtacccggaacccgtaacgggccccgtttacccggacccccgttcggtaccctaccggtttcccgtaccccg

SEQ ID NO: 90192 - DNA, 707 bp, Homo sapiens
  misc_feature: GYAE6OF02FWX8E.21.8.A08.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagcatactctacagggggctgtgggctcaggaggcagagctctgggaatctcaccatggcctggcccctctcctgctccccctcctcactttctgcacagtctctgaggcctcctatgagctgacacagcccaccctcggtctcagtgtccccgggacaaacggccaggatcacctgctctggagatgcattgaacctaaaaaattnttgtttttacggaccagcagaagtcaggccacggcccctgtgttggtcatccagtgaggacgaggacgaccggtacccgtccgggtactcccgtaggacgtagtacttctctggcctaccaactcgacgggtacggtcggaccgtacggttgacgtttccgtacggtacggttcgggggacccgtaggggtacgggtaacggaggttacggaacgtcgttacgtacctacgttacgttacgttactcgaacgcgtaacgactacgaccgtaggtcggtacgtagttaccgggaggggtcctacgggttccggacgggaacgggtaccgtagggtttaccggacccgtttaccgggtacggtccggaaccggtacccggaaaccgggtcccgttaccccggcccccggtttaccgggtaccccgttacccgttcccgtttaccccggtacccccccttaacccccggg

SEQ ID NO: 90193 - DNA, 650 bp, Homo sapiens
  misc_feature: GYAE6OF02GFPXF.21.8.A08.1.454.CMB.1.raw
  modified_base (361)..(361): a, c, t, g, unknown or other
  misc_feature (361)..(361): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcactgctcgtggatattcattgaccaaaagaatatacttgttggttccagcagaagtcaggccacggcccctgtactggtcatccatcgaggccagtcgacgacacgtccgggatcccgtgagagtattctctcgcctccgagctcgaggacnggtcgcctacttgactactcgacggtcgggaccgtagggtcggacgtagtacgaacgtctacgtaacttacgttagtttacgttacgaccgaccgtaagaaccgtaggttagttacggttacgtaacggttacgggtaagggggttcggttaccgggtacggggtacgggaaccgtaggttaccggttacccggttccggttacggtaccggtaccggtacccggaacggtcccggttcccggtaccccccggttcggtacccggttacccgttccggtttacccccgg

SEQ ID NO: 90194 - DNA, 722 bp, Homo sapiens
  misc_feature: GYAE6OF02IA166.21.8.A08.1.454.CMB.1.raw
  modified_base (156)..(156): a, c, t, g, unknown or other
  misc_feature (156)..(156): n is a, c, g, or t
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctcggacccctctcctgcctccccctctcactttctgcacagtctactgacggcctctatganctgacacagccctacctcggtntcgagtcgtcccgaggaccaaacggccaaggctaccacgtgacctcgtgggatattcaatcgaaacaaaagtattactacgtttcggttacgtaccaggacaaggtaacgtcgacggtccaaccggtccctagttacgtacggtactacgtacgaagtacgggacgtaccgtacggtccgaaacgtaccgtaccggtaccgggtaacttcccggtaaggaacggtacgttacgtccgtacgttcggaccctacgacgtcgtaacggacggtctaacggcgtaccctacgttagacctagtcgtaacgggtcgggaccgtaagggcggtaacgtagtacggtacgtagtacggtaaccttaacgttcgtacgtaaccgacgaacgacgtacgtaagtacggtcgtacgtacggtacggttacgggtcgtacgggaacgggtaccgtaacgtacgggttaccgtaccggtacgttcggacggtaccgtacgtaaccggtccgtccggtaaccccggttcggtaccttaccggttcccgttaccccg

SEQ ID NO: 90195 - DNA, 610 bp, Homo sapiens
  misc_feature: GYAE6OF02I9IUT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttggtccagcagaagtcaggccaggcccctgtactggtcatccatgacgcagtcgacgacacgtccgggatccctaggagacgattcctcgtcgcctccaggctacgagggtacagggttcggccctaaccttggaacctagtaccgtagggtccggggaccctagggtcggacgtagtgaacgcgtacgaccttaactagtttacgttaacgccaaccgagtacgtaggttacgttggtacacgtcggtaacggggttattaccgggacgggaacgggaacctaggttacggtacccgttcggttcggacgacggtcccaaggtccgtaccggcccccgttacggtccgtaccgttcgttacccgg

SEQ ID NO: 90196 - DNA, 820 bp, Homo sapiens
  misc_feature: GYAE6OF02IDSRL.21.8.A08.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcagggaggcagagctctgggaatctcaccatggcctggacccctctcctgcctcccctcctcactttctgcacagtctctgacggcctcctatgagctgacacacgcccaccgtcggtntcagtcgcccaggacaaacggccaggatcacctgctcgtaggagattcatacgaacaaaagtatatacgtttgttcggttaccagacgaagaacggtcgaacggcccacggtccccttaggtaccgtcggtacacttccgagtcgggacgacgtacgtccggaaccgtaccgtaccggtccgggactccgtaggacggttaacgtattccgtcgtcgcccgtaccgagtcctacggacgggactaggtccggcccttaacgttagaacgttacgtaccggtacggggttacccgggggaccccggtaaggggtacgggtaacggtaagtacgggaaacgtccggttacgtaacgtttaaccgtttagtttacggttaccgaaccgtaacgaacggtaacggtaagggtttaggttacgacgttaacggttaccggggtttaacggggggtttactaaccgggggggaccgggttaaccgggtaaaccgtttaacggggttaccgggtttaaccccgggttccggtttacggggttaacccgaaccgggttaaacccccgggaacgggtttccccgtacccccgggtttaccccccggttacgggttaccccgtttacccgttccccgggtttaaccccccg

SEQ ID NO: 90197 - DNA, 740 bp, Homo sapiens
  misc_feature: GYAE6OF02H8TWO.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctggtntcagtcgtacccaggacaaacggcaggactcactgctcgtggatattcattacgaaccaaaaagtattacttacgtttggtttacggttaccagtaccaaggaacgtacgacggccgtaccggccctagtactcggtacactaccagtggacggacctaggtaccgacgacgaccgtaccggactcccgtagaggtactacttcacgtcgtacccgtcacgtctacggacgggactaacggtaccggacctaccgtttagaacctacgttaccgacgggtaccgggaccgtaagggtacgggtaacgtacgtaacggaacgtacgtacgttactaacgtttacgtttacggttaccgaccgtaaccgtaacggtaacgtaacggttaggttacgttaacgtacggttaacgggtaaggggtttacggtccgggaacggggttaaccgggaaccgttacggtttaccggtaccggtttaccggttcggtaccggtaacgacccggtaaacggtccggtacccggtacccccgttacggtacccgttaccgttccgttaaccccgg

SEQ ID NO: 90198 - DNA, 755 bp, Homo sapiens
  misc_feature: GYAE6OF02H2T2D.21.8.A08.1.454.CMB.1.raw
  modified_base (172)..(172): a, c, t, g, unknown or other
  misc_feature (172)..(172): n is a, c, g, or t
tcagtcgtcgctcgcacgaccggtgctcgatttagcatactctacagggggctgtgggctcagggaggcagagctctgggaatctcaccatggcctcggacccctctcctgcctccccctcctcacttttctgcacagtctctggacggtcctcctatggacgctagacacncgcccacccgtcggtgtcacgtccgtccccgaaggaaccaaaccggccaaggactccaccgtgcctcgtaggagtacttctacttacgaaccaaaaagtagttaacttacgtttggtttacgttaccagcaagtagtcgacggaccgaccggccctggttaccgttggaccactccagtcggcggaccgacgtccgaaccgaccacggtcccggactccgtagagtatcttctctcgtccctcgaccggtcggtcggggaactcgggtcgaccctaccgttagaccttacgtcggtacggggtcgggacccgtaggggtacgagtagtacggaacgttcgtacggtaacttaacgttagtttaccgtaaccgtaccgaacgaacggtacggtaagttaggtaacgtacgtacggtacggggttaacggggttacgtaccggggacgggtaaggggtaacccgtttacgggttccggttacccgttaccgggttgtacccggacggtaacccggccgttacccgtaccccggtacccccggttcgttaacccggtcccgtttcccggttaccccttaccccccg

SEQ ID NO: 90199 - DNA, 698 bp, Homo sapiens
  misc_feature: GYAE6OF02FT1P2.21.8.A08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagcccaccctcggtgtcagtcgtccccaggaaccaaacggccaggatccacctgctctggganattcattgaccaaaaagatatacgttgttggtccagcagaagtcaggccaggcccctgtactggtcatccatggacggccaggtacgaccgacaccgtccgggactcccgtagagagtacttccgtcgtcgtccctaccacgtacgttccgaaggggactacgggtcgggtaccctaccgtttacggaaccgttacgtacgtacgggtcggggacccgtagggtacgggacgtagtacggaaggtctacggtaacttacgttactttacggttaccgaccaccgtaacggtacgtaacggttacggttacggtaccgtaggttacggtaacggggggttacttacggggacgggtacgggaaccgttaagggttccggtaaccggttcccggttacgggtccgtaacgtacccggtaacgggtcccttaccgggtccccccgttacgggtacctaccccggtttccttaccccgg

SEQ ID NO: 90200 - DNA, 605 bp, Homo sapiens
  misc_feature: GYAE6OF02F4VHD.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcattgaccaaaagatatacttgttggttccagcagaagtcaggccaggcccctgtactggtcatccatgacggccagtcgacgacacgtccgggatcccctagagagtacttctcgtcgccctccagcctcgagggacaggtcggacctaccttgacttatcgacggtcggggcccagggtcggacgtagtaggaacgtcgtagacttactagtttcgtaaccgctaccgagtaacgtaggttagtagtctagtacgggtaaggggttagtcgggacggggacgggaaccgtaggttcggacccggttcggttcggtaccgtaaccgacccgtaacggtccgtcccggtacccccgttcggtacctacccgttcttccccgg

SEQ ID NO: 90201 - DNA, 685 bp, Homo sapiens
  misc_feature: GYAE6OF02IZ7BX.21.8.A08.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagcatactctacagggggctgtgggctcaggaggcagagctctgggaatctcaccatggcctggacccctctccctgcctccccctcctcactttctgcacagtctctgaggcctcctatgagctgacacagcccacctcggtgtcagtcgtccccaggacaaacggccaggatcacctgctctggagattcattgaccaaaaagaatatacttgttcggttccagcagaagtcgaggccaggcccctgtactggtcactccatgaggccaggtcgacgacacgtccgggatcccgngagagattcctctcgccctcagtctcgacgggacaggtcgacccaacgttcgaacttacgtacgaggtcggggccctaagggtcggacgagtacggaacgtacgtacggaacttaacgttacgtttacgttaccgcctaaccgaaggaaccgtaaggttacggttacggttacgtaagttaccgggtaacgggggttaacggttccgggtaacggggaacgggtacccggttaaggtttccggtaacccggtttccggtttaccgggttacccgaaccggtaccccgtaaacgggttcccgttacccggtacccccggtttccgggtacccttacccgttcccggtttacccccg

SEQ ID NO: 90202 - DNA, 898 bp, Homo sapiens
  misc_feature: GYAE6OF02HHEU0.21.8.A08.1.454.CMB.1.raw
tcagtcgtcgctcgcacgaccggtgctcgatttagcatactctacagggggtgggctcaggaggcagagctctgggaatctcaccatggcctggaccctctcctgctccccctctcactttctgcacagtctctgaggcctcctatgagctgacacagccacccgtcggtgtcagtcgtcccaggacaaacggccaggactcacctgctcgtggacgacttcattcgaacccaaaaagaattacgttacctttggttacggtttaccccgagtccgaacggtaacggttccgaacgggtcccgaacgggtcccccccttaggttaacccgttggggttaacctaacgtttacccgaacgttcgggtaaaccgggtcccgtaacggttaccgggaaaccggtaacccgtaacccggttaccccgggggtaacttcccccggttaaggaacggtaaggtaacttttccgtcgttccggccccttccgaagtccgtaccggaacggggaaccgtaacggtcggacccgtaacccgtttacgggaacctttacgtacggtaacgggttccgggggtaccccaaagggggttcgggaaccgtacggttacggaaacggtccgttaaggtaccgttaaccggtttaatttaccggtttaaccgacccgtaaaccgtacggtaaccgtagggttaacggtacggttaaccgtaagtaccggggtaacggggggtttaacgttccggggtacggggtaaacgggtaaccgtaacgggtttcccgggacccggtttaccggttttaccgggtacccgtaacggtaccccggtaacgggtccctcccggtaccccccggttacgggtcccttaaccggtcccgttaccggttacccccctacccccgg

SEQ ID NO: 90203 - DNA, 698 bp, Homo sapiens
  misc_feature: GYAE6OF02ITDWY.21.8.A08.1.454.CMB.1.raw
  modified_base (380)..(380): a, c, t, g, unknown or other
  misc_feature (380)..(380): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcacagtctctgacggcctcctatgagcctgaccacacgcccaccgtcggtgtcagtcgtcccaggacaaacggccaaggactcaccgtgctcgtggactacttcagttacgaaccaaaaagtatattaacgttggttcggttccaaggcaaggtaagtcacggacctacggcccctaggtactggtccactccaatcggacgcctaggtccgacgacctaccgtcggacctcctaggacgagtccttcnctcgaccctcgaagtccgtaccgaagggacgtacggtaccggaccctaccgtttgaaacttcgtacggacggtccgggacccgtagggtacgaaccggtatacggaacgtccgtagtaaacgttacgttaacgttcggtaaccgacctaacgaacgtaccgaaggttacgttacggtacacggttacggtaacgggggttaacttaccggggaacgggacgggtaacccttagggttccgtaaccggttccggttaaggccgaaaccggtcccgaacgtccgtcccggtccccgtacgcttacccggtcctttcccgg

SEQ ID NO: 90204 - DNA, 780 bp, Homo sapiens
  misc_feature: GYAE6OF02JV47O.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtccagtcgtccccaggacaacggccaaggactcacctgctcgtggagtattcattcgaccaaaagaatatacgttgttgtccagcagaacgtcgaacgccgacggccccttgtactggtacatccatacggacgccaggtccgacggaacaccgtcgggaactccgtaggagagttacttccgtctacggcccttaccgagtccgtaccggtacgggaaccgtacggtcggacccctaccgttttacgggaactttacgtaccgggtaccgggtaccggggggtaccccgtaacggggttaggggaaccgtaacggttacggtaaacggttaccgtaccggtaaaccgtttaaacgtttacggttttacgttaaccggtacctaacccggaaggtaaccggtaaggttacgggttacgggtacttaacggggttacccgggtaaggggggttaaccttacggggggaacggggtaaccggggttaaccgtaacgggttttaccgggaacccggtttccggttaacgggttccaaccgggttacccgaaggtcccggttcccgtacccccggttggtaccccttaccggttcctttacccccggg

SEQ ID NO: 90205 - DNA, 807 bp, Homo sapiens
  misc_feature: GYAE6OF02ITH2Q.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctgacggcctcctatgagctgacacacgccaccctcggtgtcagtcgtacccgaggaaccgaaacggccaggactccacctgctacgtggagtacttactagttacgaaccaaaagtaattaacttacgtttaggtttaccggttaccgaagtacgaaggtaacggtaccgacgggtaccccgtaacgggtcccccttaggttaccgtcggtacctaacgtcctaggtcgggacgccgtaacggtaccgacggaacctaccggtaccgggaccttcccggtaggaacggtacgtactttccgtaccgtcgtaccctaccgacggtcccgtacggacgggacgtacggttccggacccttacgttacgtaaccttagtaccggtacggggtaccgggtaccggtagggtacggtaacggtacgttagggaacgtcgtaacgttaaccttaacgtttacggttacgttaccgtaccgtacgagtaacggtaggttaacggtcggtacgtacggtacggggttaggggttacggttaccggggacggggtacggtaaccggtacggttaccggttacccggttaccggttaccggaccgtaccggacccggtaacggtcccggtcccggtaccccgttaccggtacccttaccggttcccgttaccccgg

SEQ ID NO: 90206 - DNA, 885 bp, Homo sapiens
  misc_feature: GYAE6OF02ISBTY.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctggacggtccctcctagtgacgctagaccacacgccctacccgttcggtgtcacgtccgtccccgaaggaaccaaacggccgaaggtactaccaccgtcgcctcgaggtactacttcgagttacgaaacctaaaaagtaattaacttacgtttggtttacgtaccgagtacgaagtacgtcgacggtccgaccggtccctaggtacgtggtacctacgtaccgagtacggacgaccgtagtaccggaccgtaaccgtaccggtcccgggtacttacccggtaggaaggttaacgtaccgtttcccgtaccgtccgttaccccgtaccgtaaccggtcccggttaacggaaaccggggtacgttaaccgggtttacccggaaccccgttaaccggttttacgaaacccgtttacgggttaccgtaccggggggttaacccggggccccgggtttaacggggaaacccgggttaaccggtaagttacgggtaaaccggtccggttaaaccgttaacggttaaccgttacggtttaacgtaacccgaaccgttaaccggaaccggttagttacggttaccgggtacgttaccgtaacgggttaccgggtaaaggggtttcgggttaaccgggaacggggtaacgttaacccgggtacgttaccgggtaaccggtttccggtacggtacgaacccggtaccgtacgtccggttcccgtcccgttacggcccttacgtacccggtcccg

SEQ ID NO: 90207 - DNA, 803 bp, Homo sapiens
  misc_feature: GYAE6OF02JT21M.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctggacggcctcctatgagctgacacacgcccaccgtcggtgtccgaggtcgtccccgaaggaaccgaaaccggccaaggactccaccgtgtcctcgtagggatacttacctacgttacggaacctaaaaaagtaacttacttaaccgtttggtttacgggttaaccaaggacctaaaggtaaacgttaccggaacgggtaccccgtaacgggtccccccttaggttaccgtcgggtacctaacttaccccgagtacggacggtccctaaggtaccgacggtaacccacggtcccgggaacttcccgtaggaacgtagtacttctaccgtacgtccctaccggtacgtcccgtacggaacgggtacgtaacggtaccgggtaccctaaccggttgaaaccgttacggtaccggacggggtaccgggtaccggtaagggtacgggtaacgtaaggtacgaacggtcctaacgtaacgttacttaggttacgttaaccgccgtaaaccgtaagacggtaggttaccggtaggttaaccgtaaggttaccgggtaaacggggttgtaacccgggagggtaacggtaaccgtagtccggtaccgtccgttagaccgtacgaccgacggtacctcccggacccgttggcccgttacgcccgttccccgg

SEQ ID NO: 90208 - DNA, 717 bp, Homo sapiens
  misc_feature: GYAE6OF02FQR2A.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccaggaccaaacggccaggactcacctgctcgtggatacttcattcgaaccaaaaagtaacttattacgtttgtttcggttaccagtcgaagtaacgtcacggccaacgggtcccccttaggtacctgggtcctattcccgtagtcggacggacctaggtccggaacgtaccgaccgttcccggggacttccccgtaggaacgtacggtactttccgtccgtcgcccgttaccgacggtccttacggaacggggtactacgggtccggtaccctaaccgtttcgaacttacgtacgtacgggttccggggacccgtagggtcgggaacgtagtaacggacgtcgtacgtacgttacgttagttcgttaccgctaccgtaagactaggtacggttcgtacgtagtacgggtagggttacgtcgggtacggacgggtacgtacgtccggtaaccgttccggttacggtacgtaccggacccgtaacggtccgtccggtaccccgtcggtacctaccgtccgttacccccg

SEQ ID NO: 90209 - DNA, 782 bp, Homo sapiens
  misc_feature: GYAE6OF02I3ME8.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtcctcctgacggccttcctatgagtctcggacacacgtcccacccgtcggtgtcagtcgtcccaggaacaaacggccaggactcacctgctcgtggatattcattacgaaccaaaaagtaattatacgtttggttacggttacagcaaggtaactcgaggaccaccggtcccttagtactggtacacgttccagtcggacgccagtccgaccgactaccggtccgggacttccgaggagtacgtactttccgtacgtccgacccttaccgaacggccgttacgggaacgggtaacctcggttccgggaaccctttaacccggttgtaaacccgttcgtaccgggtaaacgggttccgggggacccgtagggggttacggaaaccgtattacgggaaacgttcgtacggtaaacctttagttacggtttacgttacccgactaacccggtagtaaaccgtgggttaacggttacggtacgtaacgttcgggggtaaagggtttaccgtaccggggacgggtaacggggtaacctaacggggttccgtaacccgtttcccgggttaaggcccggaaccgtaccccggacggtcccttccccggggtaaccccgttcggttaccccgtacccgtttcccggtttaccccc

SEQ ID NO: 90210 - DNA, 887 bp, Homo sapiens
  misc_feature: GYAE6OF02F5FB9.21.8.A08.1.454.CMB.1.raw
  modified_base (176)..(176): a, c, t, g, unknown or other
  misc_feature (176)..(176): n is a, c, g, or t
  modified_base (343)..(343): a, c, t, g, unknown or other
  misc_feature (343)..(343): n is a, c, g, or t
tcagtcgtcgctcgcacgaccggtgctcgatttagcatactctacagggggcgtggtgggcgtcgaggaggcgagagctctgggaatctcaccatggcctggacccctctcctcgcctcccctcctccactttcctgccacagtctctgacgtcctcctagtgacgtctagacacngaccctacccgtcggtgtacacgtcgtaccccgaggaaccgaaacgggcccaagggtctaccgaccgttcgctaccgtgggtaacgactttaccagtttacggaaacccgtaaaaaaagaaacttttaacgtaaccggtttttggttttaccggtaactaaaaccgngttaaacggtaaacggttacgtaccgggaccccgtaaccggtaccccccgtttaggttaaccggttccgggttaccgtaacttaccgaacgttacgggaacgggtaccacgggtttaccggaaccgacgtaacccgttccgggggtaaccttaccccggtaggtaaccggtaattaaccgtttccctgggttaccacccctcccggttaagcccgtacgttaaacggggtaacctgggttacccggaacccggttaacccttggaaaccttcgtaaccgggtcggttaaccggggtcccgggtaagggaccgggtaacgacggtacgaacggtcgtacggttactaacgttacgtttacgttacgaaccaccgtagaccgttaaggtagttcgtaacgtggtaaccggtagggggttcgtaacgggtaccggggacggtaacgttacggggttacccgtacgggttcgggtaccgtcgttaccgggaacccgtagggccccgttaccgtaccccggtccgggtccctacggtcccttaccccgg

SEQ ID NO: 90211 - DNA, 621 bp, Homo sapiens
  misc_feature: GYAE6OF02HJK5X.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagagtcaggccaggcccctgtactggtcatccatgaggccagtcgacgacacgtccgggatcccgtgagagattctctcgcctccagctcgagggacagtcggcctaccttgacttatcgacggtcggggcccgagggtcgggacgtagtaggaacgtcgtacggaccttacttacgtttacggtttaccgaccgtaccgaacgaacgtaggttacggtggtaccgtagtacggtagggggttacgttacgggacgggacgggtaccgtacggttacggtacccggttccgttacgggtaccgaccggtacccgtaacgggtcccgtccggtcccccgttccggtacctacccgttccgttaccccg

SEQ ID NO: 90212 - DNA, 720 bp, Homo sapiens
  misc_feature: GYAE6OF02F9DZE.21.8.A08.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggacggcctcctatgagcgtgacacgacgccctacccgtcggtgtcagtcgtacccgaaggaccaacggcgaggctccgactgcttcgnggacgtcttacattacgaacaaaagtaactaattacgtttggttcggtaccagacgtaagaacgtcgacggcctacggccccgttagtacgtcggtacaacgtaccgagtcggaaccggtccgaaggtaccgaacgaccgaccggtaccgggaccttacccgtaggtaacgtaggtactttccgtctcgtaccctcgacgtcgtacggaacgggtactcggtacgacccgtacgttcgaacttacgcggtacgggtccggggactaggggtcggaacacggtacgaacgtcgtacgttacgttaagttacgttacggtaccgaccaacgtacgtaagtcgttacggttcgtacgacggttacgggtaggggttaccgtacgggcgggtaacgaccgttacgggtacggttaccgttcggttacggaaccggtcccggtaccggtacggtccctacccggtccgttaccggtccctacgttccccgtacccg

SEQ ID NO: 90213 - DNA, 558 bp, Homo sapiens
  misc_feature: GYAE6OF02HTXDF.21.8.A08.1.454.CMB.1.raw
  modified_base (175)..(175): a, c, t, g, unknown or other
  misc_feature (175)..(175): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (418)..(418): a, c, t, g, unknown or other
  misc_feature (418)..(418): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtntcagtgtcccaggacagacgccaggatcacctgctctgcagatggactgccaaagaaatntgcttaattgtacaacanaagcaggccaggcccctgtgttagtgatagtaataaagacactgagacggcctcagagatcctgacgcgattctctggacttcagcctagaagggacaggctaggtcgtacgttggactaatcaagtagaagtacgaaggcagagacgagcgtgaactaatactntacgaaaacagtaagcgtaagtaagacgggtaatccgtaagttgggtaccgtttacgggacgggtaagggacccgtaaaggccgttaacggacccgttaccgttaagggtccgtaacggcccgtaacgggcctacccggg

SEQ ID NO: 90214 - DNA, 627 bp, Homo sapiens
  misc_feature: GYAE6OF02F3SUT.21.8.A08.1.454.CMB.1.raw
  modified_base (177)..(177): a, c, t, g, unknown or other
  misc_feature (177)..(177): n is a, c, g, or t
  modified_base (222)..(222): a, c, t, g, unknown or other
  misc_feature (222)..(222): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtntcagtcgtcccaggacaaacggccaggactcacctgctcgtgganattcattcgaccaaaagatatacttgttcgtccagcagaagtcaggccaggtccctgtactggtcatccagtgacgcctaggtccgacgacaccgtccggatcccgtagagagtacttctcgtccgcctcgagtcctacggagggacncggtcggaccctacgttgacctntcgtacggtcgggccgtagggtcggacggagtacggacgtcgtaggtaacttacgttagtttacggttaccgacctaccgaagtacgtaaggttacggttcggtactaaggtcgggtaagggggttacgtcgggtaacgggacgggtacgtaggttacggaccggttccgttacggactaccggaccgtaacggtccgtcccgtccccgtacggtccctaccgttcctccccgg

SEQ ID NO: 90215 - DNA, 699 bp, Homo sapiens
  misc_feature: GYAE6OF02HEKQ7.21.8.A08.1.454.CMB.1.raw
tcagtcgtcgctcgcacgaccggtgctcgatttagcatactctacagggggcgtgtgggctcaggaggcagagctctgggaatctcaccatcggcctggacccctctcctgcctccccctctcactttctgcacagtctctgaggcctcctatgagctgacacagcccaccctcggtgtcagtcgtccccaggaccaaacggtcaggatcgacctgctctggagattcattcgaccaaaagtattatactttgttggttccagcagaagtcaggccaacggcccctagtactggtacatccatgacggcagtcgacgacacgtccggatcccgtaggacgacgtattccgtacgtcgtccctccgagcttacgacgggtacacggtcggaccctaccgttagaaccttacgtccgtaagggttccggggaccccgtagggtacggaacgtagtacggagtaccgtacgtaacttaacttacgtttacgttaaccgactaaccgagtaccgtaaggttacggttcggtacctacggttacgggtaacgggggttactaccgggggaacgggtacgggtaacccgttaagggtccgttaacccggttccggtttaacgggtcgtaacccggtacccggtaaggtcccgttacccggttaccccccgttcgggtacccttacccgttccctttacccccggg

SEQ ID NO: 90216 - DNA, 611 bp, Homo sapiens
  misc_feature: GYAE6OF02HV126.21.8.A08.1.454.CMB.1.raw
  modified_base (174)..(174): a, c, t, g, unknown or other
  misc_feature (174)..(174): n is a, c, g, or t
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagccacctcggtntcaggtcgtccccaggaccaaacgggtccaggatccacctgctctggatattcattcgaccaaaagnttatacttgttgttacagcagacgtnagccagccctgtacngtcatcagtgacgcagtcgacgcactcgggatccgngacgtgatttccncgtnccttcagctacgagggacaggtcgcctacttgactagtcgaggtcgggaccgtagggtcggacgtataggaagcgttagtaaccttaacgttagtttacgttaccggaaccaccgtaaacgacgtaggttaacggttcgtacacgttaccggagggggtttacttaccgggcgggtacgggtacctacggttcgtaacccgggtcgttaggtaccgacggtacccgaagggtcctacccggtaccccttcgggtacctacccgttcgttaccccgg

SEQ ID NO: 90217 - DNA, 600 bp, Homo sapiens
  misc_feature: GYAE6OF02FM5CA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtcgtccccaggacaaacggccaggatcacctgctctggagattcattgaccaaaagaatatacttgttgttcagcagaagtcaggccacggcccctgtactgtcatccatgaggccaggtcgacgaccacgtccgggactcccgtgagagtattctcgtcgcctccagctacgagggacaggtcggccctacttcgaacctagtcgagggtcgggacccaggggtggaacgtagtgaaacgtctacgtacttaacgtagtttcggtaccgacaaccgagtaacgtaggtacggtcgtacgaagtcgggtagggggttacgtcgggagggtaccggaacgtaggttcgtaccggttcgttcggaccgacgtacccgtaaggccctaccggtccccgtccggtactaccgttccgtccccgg

SEQ ID NO: 90218 - DNA, 924 bp, Homo sapiens
  misc_feature: GYAE6OF02IZWE5.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgacggcctcctatgagctgacacacgcccaccctcggtgtcagtcgtccccgaggaacgaaaccggccaggactccacctgctcgtggagtattcagttacgaaccaaaaagtaattacttacgtttggtttcggttaccaaggacctaaggtaacgtcgaacgggtacccgaaccggtcccccttaggttacgtacggtcctaactaccgagtggacggccgtaacggtaccggaaccgtaccgtaccggttacccggggaaccttcccggtaggtaaccggtacgttaacctttccgtccgtaccgtaccccttaccgaacggtccctacgggtaacggggaaccgtacgggttaccccgggacccctttaaccggttttacggaaaccgttttaaccgtacgggtaaccgggggttacccgggggaccccggtaagggggttaccgggtaaacgtaggtaaccggggtaaacggttcccggttaacgttaaaccgtttaacggttttaacgttttaccgggtaaacccgtacccgtaaaccgtaaacggtaaccggttaagggttacggttaccggtcgttaaaccggttacgggggttaacggggttccgggttacccgggaaccggggtaacgggttaacccgttaacggggttcccgggttaaccccgggttttcgggttaaccggaacccgggtaaccgggtaacccgttaaccggggccccgtttacccggccccccggttacggttaaccccttaccgttccccggtttacccccg

SEQ ID NO: 90219 - DNA, 733 bp, Homo sapiens
  misc_feature: GYAE6OF02H6OKC.21.8.A08.1.454.CMB.1.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtcccaggacaaacggccaggactccacctgcctcgtgganattcattcgacaaaagatatacttgttgttccggancagagtcacggccacggcccctgtacgtggtcactccagtggacggccgagtccgaacgacctaccgtcccggggattcccgtagagacgtattcctcgtcgcctacgacgctacgagggactaggtcggaccctacgttgaccttagtcgacgggtcggggaccgtagggtcggaacgtagtacggacgtcgtacggtaacttacgtttacgtttacggttaccgtaccgaaccgtacggtaacgtacgggttacggttacggtacgtaacggttacggggtaacgggggtttacgggtaccggggtaacggggtaaccggggtaaccggttaacgggtttacccgggtacccggtttccggtttacgggtaccgtaaccgggttaccccggaacgggttcccggttaccccggttccccccggtttaccgggttacccgttacccggtttaccccggtttaccccccggg

SEQ ID NO: 90220 - DNA, 600 bp, Homo sapiens
  misc_feature: GYAE6OF02IW67V.21.8.A08.1.454.CMB.1.raw
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaaagaggtgtccagtgtcaggcgcaactggtggagtctggggagcatggtccagccgtgggaggtccctgacgcctctcctgtgcagcgtctggattcagtatcggctccttgccangcactgggtcccncagtctccaggcaaggggctggagtgggtgcgtattatctaggtntgagtgaagtgagagtatattattcaagtactcgtgaagggcctaattcaacctactctaccgagtaagaacaatcgaccaaactaaccacgtacctagttaacctacttaacaaaacttcggaaccccggtacgtacggtaagaccggacccggaaggaccgtaacggtacccttagtacttaacgttaacgttacgtaacggacgtccgttttaggtaccgtagttaccggggactaacgggtacccctaggtacccg

SEQ ID NO: 90221 - DNA, 725 bp, Homo sapiens
  misc_feature: GYAE6OF02FSJS3.21.8.A08.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacctcggtgtcagtcgtcccaggacaaacggccaggatcacctgctcgtgggatattcattcgaaccaaaaagtaattattacgttgtttcggttccagcaaggaagtcgacggccacggtcccctgtacctggtcatccatggacgccagtcgacgacacgtcgggactcctagagatacttctactcgcctacgngcctacggaggacctagggtcggacccttacgttacgactacgtcgacggtaccggggaccgtacgggtacggaacggtagttacgaacggtccgtacggtaacctttaaccgtttaagtttacggttaccgtaccgtaaccgtacggaacggtacggttaggttacgggtacgttaggtaccgggttaagggggtttaccggttacggggtacggggtaacggggtaaccggttacggttaccgggttaaccgggtttcccggtttacgggtaccggtaacccggtacccgtaaccgggttcccgttacccgggtacccccggttaccggtacccgttacccgttcccgtttacccccgg

SEQ ID NO: 90222 - DNA, 662 bp, Homo sapiens
  misc_feature: GYAE6OF02HOPX6.21.8.A08.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgagcctcctatgagctgacacagccaccctcggtgtcagtcgtcccaggacaaacggccaggatcacctgctctgganattcattcgaccaaaagatatacttgttcggttccagcagaagtcaggccagcccctgtacgtggtcatccatgagccagtcgacgacacgtccgggactcccgtgacgagtacttctcgtcgccctccgagtctcgagggacaggttcggccctaaccgttgacctatcgacggtcggggccccgagggtcgggacgagtcggaagtacgtagtaaccttacgttattacggttacgaccgtaaccgacgactaacggttagttacgggtactagtaccgggtagggggttacgtccggggtacgggacgggaaccgttaacggtaccgtaccggtttccgtttacgggtacgtaaccggtaccccgaagggtcccgttacccggtccccccggttacggttacccgtaccgttttaccccgttccccgtttacccccgtacccccg

SEQ ID NO: 90223 - DNA, 685 bp, Homo sapiens
  misc_feature: GYAE6OF02INCMB.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtcccaggaccaaacggccaggatccacctgctcgtaggagtattcattacgaaccaaaaagtattacttacttgttcggttccagcaagaagtcacggccacggcccctgtactggtcatccagtggacgccagtcgaccgacacgtccggactccgaggagacgtattcctctcgccctccgagtcctacggagggacaggtcggaccctacgttagaccttagtacgtacgggtcggggacccgtaaggggtcggaacggtagtacggaacggtcgtacgtaacttaacgtttacgttacgttaccgacgtaaccgagtaacgtaacggtagtacggtactaacggtacgggtaaggggttacgtaccgggacggtaacgggtaaccgtagggttaccggtacccggttacgttaccggtaccgtaaccggtaacccgtaacgggtcccttacccgggtcccccgttaggtcccttacccggttcccgttacccccgg

SEQ ID NO: 90224 - DNA, 800 bp, Homo sapiens
  misc_feature: GYAE6OF02IE9VE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcacttttctgcacagtctctgacggcctcctatgagctgacacacgcccaccctcggtgtcagtcgtcccgaaggacaaacggccaggactcaccgtgccttgtaggatattcaattacgaaccaaaaagtatattactttggttaggtaccagacgaagtaacgtcgacggccacggtcccctagttacgtcggtaccacttccgaagtcggaacgaccgtaggtaccgaagaacccgtaccggttacccggaccttcccgagacggtacgttattccctcgtcgcccgttaccagtacgaacggacggggtaactacggtaccggaccccttaaccggttagtaaccgttacgttaacggtacgggtttaacccgggggccccgtaaagggggtaccgaacgggtaagtaacggtaacggtccttaacgggtaaaccttaaaccgtttagtttacgggttaaaccgaaccgaaataacgaacgttaagggttaacggtacggttaacacgttacggggttaaacggggttcgggttaaccggacgggtaacgggtaacccgtagggtttaccggtacccgggtttacgttcgggtacccgtaaccggttaacccgacgggttacccgtccccggtaccccgtttaccggtaccgttaccccgttccgttacccccgg

SEQ ID NO: 90225 - DNA, 802 bp, Homo sapiens
  misc_feature: GYAE6OF02ILHVO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctctactttctgcacagtctctgacggcctcctatgagctgacacacgcccaccctcggtgtcagtcgtacccgaggaacaacggccaggactcacctgctcgtggagtattcattacgaaccaaaagtaattattacgtttggttcgttaccagacgaagaacgtcgacggccgacggccccttagtacgtcggtacacgtccagtaggacgaccgtaggtaccgacgaccgtaccggtccgggtacctccggtaggaacgtacgttacttcctacgtaccgtccctaccgacgtccgtacggacgggtacgtacggtaccggtaccctaccgttaacgacgttacgtaaccgggtcggggtacccggggacccggttaagggtaccgggtaacggtacgtaacgggtaacgtaccgttacgtaaccgtttagtttaacggttaccggttaacccacgtaaaccggtaacgtaacgtacgggttacggtaccggttacgtaacgggttacggggtaacgggggtttacggtacccgggggtacgggaaccggtaaccgttacggggttaccgttaccccgggttacggttaccggacccgtaaaccgggtacccggtaacgggtccccgttaccccgggtcccccggttacggtacccttacccgttccggttaccccccg

SEQ ID NO: 90226 - DNA, 818 bp, Homo sapiens
  misc_feature: GYAE6OF02HSRK1.21.8.A08.1.454.CMB.1.raw
  modified_base (483)..(483): a, c, t, g, unknown or other
  misc_feature (483)..(483): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtcctctgacggcctcctaatgagctgaccacacgacccacccgttcgggtgtcacggttccgtacccccgaagggaaccaaaaccgggccgtaacggactaccgaccgtcgcgttccgtaggacgtacttactaagttacgaaccaaaaacggtaattaacgttacgttttggttacggtttaccacggaccaaggtaacggtccgaacgggtcccaaccgggtcccccttaggttacgttcggtcctaactcccaagttccggaacggcccgtagtaccggaaccgtaccgtaccggtccgggtaactccccgttaaggacgagtacttcctcgttcgtccctacgngacccgttacggacggggtacctacggggttccgtaacccgtacccttcgggaactttaaccggtaccgtacggggtccggggtacccgtagggtacggacgtacgtaacggtaacgtcggtaacgtacttaacgtttacgttacgttaccgactacgacgtacgacggttaacggttgtaaccgtagttcgggaacgggggtttacggtacgggaaccgggtaacggtaaccgttaggttaccggtaccggttccggttaccggtacgaccggtaaccccgtaggtcccgttcccggtcccccggttcggtacccgtccgtccgtttcccccgg

SEQ ID NO: 90227 - DNA, 658 bp, Homo sapiens
  misc_feature: GYAE6OF02I0C8D.21.8.A08.1.454.CMB.1.raw
tcagtcgtcgctcgcacgaccggtgctcgatttagcatactctacagggggtgggctcaggaggcagagctctgggaatctcaccatggcctggacccctctcctgcctcccccctcctctactttctgcacagtctctgaggcctcctatgagctgacacagcccaccctcggtgtcagtcgtcccaggacaacggcaggactcacctgctgtggatattcattcgaaccaaaaagtatactacttgttcgtccagcaagaagtcaggaccaggcccctagtacgtggtcatccagtggacgccaggtacgaacgacgtaccgtccgggactcccgtagagagtattctctcgcctcgacgtcctcgaaggactaggtcgtaccctacgttgaactacgtacgacgggtcggggacccgtagggtcggaacgtagaggtaacgtacgtacgtaaccttaacttagttacgttaccgaccaaccgtacgtaacgtaagttaggtgtactacgtacgggtaggggttacgtacgggacggtacggtaaccgtaaggttcgtaccgttcgttaggtaccgtacggtacccgtaacgggtccttacccggtcccccgttcgggttaccctaccgttccgttcccggtacccccgttccccg

SEQ ID NO: 90228 - DNA, 706 bp, Homo sapiens
  misc_feature: GYAE6OF02FJUKA.21.8.A08.1.454.CMB.1.raw
  modified_base (176)..(176): a, c, t, g, unknown or other
  misc_feature (176)..(176): n is a, c, g, or t
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtntcagtgtccccaggacaaacggccagatcactgctctgganatcattgaccaaaagaatatacttgttgttccagcagagtcaggccaggcccctgtactcggtcactccatgaggaccagtaccgaccgacaccgtccgggactcccgtagaagagtatttctctcgcctccagtcgtcgacgggacaggtcgacccgtaccgtttaggaaccttagtccgtacggttacgggggccccgtaaggggtaccggtaacggtaagtacgggaacggtccgtacggttaaccttacgtttaacgtttacgggtttaacccgacgtaacccgaaccggtaacctaaggttaacgggttgggttaacctacgttaacgggtacgggggtttaaggttcccggggaggggaaccggggtaacctaagggttacggtaccccgggttcgtttaccgggaccgtaaccggtaccccggaaggtcccgttacccggtcccccgttaccgggtaccctacccgttccgtttacccccgg

SEQ ID NO: 90229 - DNA, 720 bp, Homo sapiens
  misc_feature: GYAE6OF02JUPM8.21.8.A08.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (531)..(531): a, c, t, g, unknown or other
  misc_feature (531)..(531): n is a, c, g, or t
tcagtcgtcgctcgcacgaccggtgctcgatttagcatactctacagggggcgtgtgggctcaggaggcagagctctgggaatctcaccatggcctggacccctctcctgctccccctcctcactttctgcacagtctctgaggcctcctatgagctgacacagcccacctccggtctcacgtcgtccccggaacaaccggccaggatccacngctctggagntcgcagttcgaacctaaaaaatttgtttacgttttttaggaaccctagtcgaaggtaagtacgacggtaccgacggtccccttaggttcgttggtctaacttccagtggacgacgaggaacgaccgacccgtccgggactacccgtgacgtagtacgttcgtacgtcgctaccgtaacgtcgacgggtacggtcggtaccgtcggtttacgtacttcgtacggtagggtccgggtacccggtagggtacggacgtacgtaggacgtcgtaagtacgtacttacgtattaccgctaacgaccgagaccngtacggtacgttacggcgtaacgttacggggacggtacgtaacggtcgggtaacgggtaaacggccggttaacgggttaccgacccggttaccgtaacgggtccgaaccggtaccggtaaccggccgttaccccgtacccgggttccggtaccgtacccgtttccggttaccccgtaccccttaccccg

SEQ ID NO: 90230 - DNA, 868 bp, Homo sapiens
  misc_feature: GYAE6OF02HB49K.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgacggcctcctatgagctgacacacgcccacccgttcggttgtacgaggtccgtacccccgaaggaaccgaaaccggcccgagggacttacccaccttggcccttacggtacgggaattaactttccgaatttaccggaaaacctaaaaaaggtaaacttaacgttttacgttttggttacgggtttacccaaggtaccaaaggtaacgttaccgaacggggacccctaacccggggtcccccgttaggttaaccgttcggttaacctacgtccgtaaggtcgaccgggtacccgaacggtccggaaaccgtacccgtaccggtcccggggtaactccccggtaggaacggtacgttacttccgtccgtacgtcccgtaccgaggtcccgtacggacgggtactaccgggtccgacccttacgttacgaccttacgtacggaccgggttccgggaccggtagggtacgaacggtagtacggtacgacgttaacgtacgttaacttacgttaccgttaaccgcccgaaacggtacgaacgttacgggttaacgttcggtaaccctagggttccgggtaacggggtttccgtaacgggaacgggtacggtaaccgtagggtttccggtacccggttcggttaccggaccggtacccgtaaccgggtaccggtcccgtaccccggttaccccgttaccgggttacccgttacccttaccgggtttccccccg

SEQ ID NO: 90231 - DNA, 696 bp, Homo sapiens
  misc_feature: GYAE6OF02HY37O.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgcccacccgtggtgtcagtcgtcccgaggaaccaacggccaggactccaccgtgctcgtggatacttcattcgaaccaaaaagtattattacgtttggttcggttaccagcaaggtacgtcacggccacggtcccctgtacgtcggtcactccagtggacgcctagtcgaacgacaccggtacggactaccgagagactacgttcctcgtcgtcctacgacgtcctacggacgggtacgtacggtccggtacccgtaaccgttgaaccgttacgtacgggacgggttccggggaccccgtaggggtacgggaacgtacggtacggtacgtacgttaccggtaaccttaacgttcggtttacgtacccgaaccacgacgtaactgggttaacgtgtacgtacgtcgggtaacggggttacgtacgggaccgggtaggtaccgtaggttccggtacccgttcggttaccggtacaccggtacccgtacggtccgtaccccggcccgttacgggacccttccgttccgttcccccg

SEQ ID NO: 90232 - DNA, 663 bp, Homo sapiens
  misc_feature: GYAE6OF02FTJYR.21.8.A08.1.454.CMB.1.raw
  modified_base (221)..(221): a, c, t, g, unknown or other
  misc_feature (221)..(221): n is a, c, g, or t
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgcccaccctggtgtcagtcgtcccaggacaacggccaggactcacctgctcgtagganacttcattgacctaaaaagtaattagttacgtttggtttcggttccagcaagaagtcaggccaggccccttgtacgtggtcatccagtgacgccagtcgaacncacgtcgggactccgtganagtacttcnctcgcccncgagcctacggacgggactaggtcggaccctacgttcgaactcgtacgaacgggtcgggacccgtgggtcggacgagtacggaaggtcgtagtaacgttacttagtttacgttaccgaccgtaaccgaacgggtactaaggttacggttacggtaccaacgttcggggtaaggggttacttccggggaacgggtacggtaaccgttaggttaccggaccgttttaccggtaggtacccgtacggtacccgtaggtccgttacccggacccccgtttcgggtacctaccgtttccgtaccccgg

SEQ ID NO: 90233 - DNA, 804 bp, Homo sapiens
  misc_feature: GYAE6OF02HE3O9.21.8.A08.1.454.CMB.1.raw
tcagtcgtcgctcgcacgaccggtgctcgatttagcatactctacagggggctgtgggctcaggaggcagagctctgggaatcgtcaccatggcctggacccctctcctgcctccccctcctcactttctgcacagtctctgaggcctcctatggagctagacacacgcccaccctcggtgtcaggtcgtccccgaggaccgaaaccggccaggatccacctgctctggagtattcattcgaaccaaaagtatattactttggttacggttccagcaaggagtcgacggccaccggcccctgtaccgtggtacactccagtgacggccgaggtaccgaacgaccaccggtccgggactcccgtagaacgagtacttcctcgtcgtcctcccgaagtcccgtacggacgggtaacgacggttccggacccctaaccgtttcgtaaaccgttaccgttccggtaacggggttacccgggggaacccggtacggggggttaacggaacggtaacggttacgggaaaccggtaccgttaacggtaaccgtttaaccgttttaaggtttaccggtaacccgtcccgtaaacccgtaaggtaaccgttaaggggtttacgtacgggtaccgttaagggttaccggggtaacggggggttttacggtaccgggtacgggggtaaccggaaccggtttacgggttacggtacccccgggtttcggttcgggtaacccgaaccggtacccggtaaccgggtccttacccccggggtccccttaccgggtacctaccgttccccgttacccggg

SEQ ID NO: 90234 - DNA, 680 bp, Homo sapiens
  misc_feature: GYAE6OF02HQSJ1.21.8.A08.1.454.CMB.1.raw
  modified_base (177)..(177): a, c, t, g, unknown or other
  misc_feature (177)..(177): n is a, c, g, or t
  modified_base (522)..(522): a, c, t, g, unknown or other
  misc_feature (522)..(522): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtntcagtcgtccccaggacaaacggccaggatccactgctctggatattcattgaccaaaagattatacttgtttcggttccagcaagaagtcacggccacggccccttagtacgtcggtactactccagtggacgggcctaggtaccggaacgtacctaccggtacccgggtactccccgtaggaagtacgtactttcctcgtacgccctaccgagacccgtcgaacggggactaagggtccggaccctacgtttacgtaacctacgtacgacggggtcggggacccggtagggtacgggacgtagtaggacgtcgtacgtaaccgttacttaagttcggttaacnccgtaaccgaagtaacgaggttagttggacgtagttacgggtaggggttacgtcggacggggtaagggtacctagggttccgtaccggttcgttaggtaccgtacgtcccgaggtccctcccgggtaccccgttccggtacttcccgtcgttccccgg

SEQ ID NO: 90235 - DNA, 811 bp, Homo sapiens
  misc_feature: GYAE6OF02J1334.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccacccgtcggtgtcagtcgtccccaggacaaacggccaggactcacctgctcgtaggatacttcagttacgaaccaaaaagtaattacttacgtttggtttcggttaccagtcaaggtaacgtcgaacgggcccgtaacgggtcccccttaggttaccgtggttaccactaccctagttagggaccggtccgaacgggttcccgaacggtaacccgaccggtcccggggtaaccttccccggtggaacgaacggttacttccgtcctccgacccttaccgacgtccgtacggaccgggtactacgggtccggacccttaccggtttacgtaacgttacgtaccgtacggggtccggggtacccggtagggtcggaacggtacgtacggtaacggtcgttacgtacgttaaccgttagtttacgtaccgtacccaaccgtacgtaacgtaacggtacggttacgttacgtaacggtacgggttacgggggttaaccggttccggggtaacgggtaccgggtaaccggttacggttaccggttaccccggtttaccggtttccggacgtaaccggtacccggtaaccggtcccggttacccggtaccccggttcccggtacccgtacccgtttcccgttacccccgg

SEQ ID NO: 90236 - DNA, 854 bp, Homo sapiens
  misc_feature: GYAE6OF02IG553.21.8.A08.1.454.CMB.1.raw
  modified_base (272)..(272): a, c, t, g, unknown or other
  misc_feature (272)..(272): n is a, c, g, or t
tcagtcgtcgctcgcacgaccggtgctcgatttagcatactctacagggggctgtgggctcaggaggcagagctctgggaatctcaccatggcctggacccctctcctgccttccccctcctcactttctgcacagtctctggacggcctcctatgagctgacacagcccacccgtggtgtcagtcgtaccccaggaacaaacggccgagactccacctgctcgtggagtattcacttcgaaccaaaagattatactttggttcgttaccancaagaatcgagccgacggtccctagtacgtcggtactactccgagtcggacgccgtagtccgaccgtacaccgtccggggacttcccgtaggaagtacgtacttttcctccgtcggtcccacccgagtaccccgtacgggaacggggtaccgtacggttacccgggaccccttaaccggttacggtaaccctttagttacccgggtaccgggggtcccggggaccccggttaaggggtccggaaccgggtagttaccggtaaacgttccgtaaccgttaaaccgttaacgtttaaccgtttcggtaaaccccggacttaacccggtaacggaaacgttaacggggttagggttaccggttaaccgtaacggtttaacgggtaaacgggggggttttacggttcccggggtaaaccgggggtaaccgggtaccgggttaaaccgggtttccgggtttacccggtttaacccgggttttccgggaaccggttccggaaccccgggttaaggttcccccggtaaccggtttcccccccgggtaaccggtttaccccggttacccgtacccgttttcccccccggg

SEQ ID NO: 90237 - DNA, 740 bp, Homo sapiens
  misc_feature: GYAE6OF02FYWM2.21.8.A08.1.454.CMB.1.raw
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
tcagtcgtcgctcgcacgaccggtgctcgatttagcatactctacagggggctgtgggctcaggaggcagagctctgggaatctcaccatggcctcggacccctctctgcctcccccctcctctactttctgcacagtctctggacggccttcctatgagctgacacagcccacccgtcggtgtcaggtcgtccccgaaggaaccaaaccggccaggatccacctgctctggatattcattcgaccaaaaagatattacgttgtttggttccagcaagaagtcaggccgacggccccctgtacgtcggtcaactccagtgacggccagtccgaacgaccacgtacccggactcccgtagacgtagtntttaccnctcgccttccagtctcggaacgggactaggacgtccctaacgtttcgaactacgtacgtacgggtccgggggacccgtaagggtcgggtaacgagtaacggaacggtccgtaacggtaaccgttaacgttaagttttcggttaaccgaccgtaaacccgtaaggaacgtaacgggttaggttacggtactaacggttacgggtaacggggggtttacttacggggaccggggtaaccggggtaaccgtaaggtttccgggtacccggtttcggttacgggtacccgtaaccgggtaaccccggaagggtcccgtaccccgggtaccccccgttacgggtcccgttacccgtccgtttaccccccgg

SEQ ID NO: 90238 - DNA, 647 bp, Homo sapiens
  misc_feature: GYAE6OF02HIPY6.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctcgtggatattcattgaccaaaagatatacgttgttggttccagcaagaagtcacggccacggcccctgtactggtcactccatgacggccaggtcgacgacacgtccggactcccgtagagacgtacttcgtactcgtccctaccgagtcctacggacgggtactacggtcggtaccctaccgttagaaccgttactaccggacgggttcggggaccccgtaggggtacggaaccgagtaaggaacgtcgtacgaacttaacgttagttacgtaccgacaaccgagaactaggtacggtgtacagttacggtaaggggttacgtcgggaacgggtacggaaccgtaggttacgtacccggttcgttacgggactaaccggacccgtaaggtccgtcccggaccccgttacggtcctaccgttccgttaccccgg

SEQ ID NO: 90239 - DNA, 661 bp, Homo sapiens
  misc_feature: GYAE6OF02GI4RV.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatccacctgctcgtggagtattcattcgaaccaaaaagtattacttacgtttggttcggttccaaggcaagaagtcaggccacggcccctgtactggtcactccatggacgccagtcgacgacaccgtccgggactcccgtagagacgtacttccgtctcgccctcgagcctacgagggacaggtcgaccctacgttgaacttagtcgtaggtcggggaccgtagggtcggacgtacgtaggaacgtcgtaggtaaccttacgttacgttacgttaccgaccgaaccgtaacgactaggtaacgtacggtactacggtcgggtaacggggttacgttacgggacgggtacggtaaccgtaacggttcggtaccgttccggttacggtcgaaccgtccggaacggtccgtcccgtaccccgtccggtccgtaccgttccgttcccgttcccctacccccg

SEQ ID NO: 90240 - DNA, 711 bp, Homo sapiens
  misc_feature: GYAE6OF02IIRJ7.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgacggcctcctatgagctgacacacgcccacccgtggtgtcagtcgtccccaggacaacggccaggatccacctgctcgtggatacttcagttcgaaccaaaaagtaattacttacttggtttacggttaccagtaccgaaggtaaacggtcacgggtaccgacgggtccccctaggtaccgttcgggtacaacttccgagtacgacggcctacggtaccgaacgaccgaccgtcccggggaacttccccgtaggacgtaaggtacttccgtcgtcgtacccctacgacgtccgtacggaggacctcggtacgtcctaccgttgacctagtcgacggtcgggacctagggtacgacgtagtacgaacgtcgtacgtcttaacgtgttaccgtacgacaccgtagtaacgaggttcgtaggtacaggttaccgggtagggttaccgttccgggacgggaacggtacgtacggttccgtaccgttcggtaccggtacgtaaccggccggtaacggtcccgtacccgtccccggttaggtcccttaccggttacccgttcccgtacccccgttccccg

SEQ ID NO: 90241 - DNA, 909 bp, Homo sapiens
  misc_feature: GYAE6OF02FKX6P.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggccttcctatgagctgacacagcccacccgtggtgtcagtcgtcccgaggacaaaccggccaaggctaccgacctggcctctagggatacttcattcgaaccaaaagtacttatacgttgttcggtaccagcagagtcacggccacggccccttagtaccgttggtacctatccgtataggacggaccgtaggtccggaacgaaccgaccggtccgggtaccttccccgtaggacggtacgtacgtttccgtcttccggaccccgttaccgaacggtcccgtaccgggaacgggggtactaaacgggttccggtaccccttaacccgtttcgggaaccttaacgtaccgtaacggggtccggggggtaccccgtaaggggttccgggaaaccgtaaggttacggtaaaccggtcgttaacgggttaaccgttttaacctttaacgggtttttaccggtttaaacccggccgttaaacccgggttaaccgggaaccgttaacggggttaacggtttacgggttaaccgttaacgggttaaccggggtttaaaccggggggggttaacctttaccgggggtaacgggggtaacccgggggttaacccggttaagggttacccggggtaccccggttttaacccgggttcgggttaaacccgggtacccggtaacccgggtaacccggggttaccccgttacccggttaccccccccgggtttccggggttaacccttacccgggtttccccggttttaacccccccggg

SEQ ID NO: 90242 - DNA, 653 bp, Homo sapiens
  misc_feature: GYAE6OF02IEISN.21.8.A08.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctcggtgtcagtcgtcccaggacaacggcaggatcacctgctctaggatacttcattacgaccaaaaagtaattattacgtttggtttcggttccagacaagaacgtcaggccacggcccctgtactggtcatccagtggacgcctagtccgacgaccaccggtccggactcccgtagacgtagtactttccnccgtcgtccctcgacgtcctacggaacgggacctaggtccggccctaccgttacggacttaacgtcgaacgggtccgggacccgtagggtacggacgtataagggacgtcgtacgtaccgttaacttagttacgttaccgaccgaaccgtagaacggtagtacggtcggtacgtagtcggtaggggttacgttcgggacgggaggtaccgtaggtccgtaccgttcgtcggtacgacgccggacgtccgacccgtcccgtacggtcctacgtccgttcccgttccccgtccccg

SEQ ID NO: 90243 - DNA, 839 bp, Homo sapiens
  misc_feature: GYAE6OF02H44PN.21.8.A08.1.454.CMB.1.raw
  modified_base (128)..(128): a, c, t, g, unknown or other
  misc_feature (128)..(128): n is a, c, g, or t
  modified_base (138)..(138): a, c, t, g, unknown or other
  misc_feature (138)..(138): n is a, c, g, or t
  modified_base (180)..(180): a, c, t, g, unknown or other
  misc_feature (180)..(180): n is a, c, g, or t
  modified_base (248)..(248): a, c, t, g, unknown or other
  misc_feature (248)..(248): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctntgacggccctcctatgacgctgacacacgcctaccgtcggtntcagtcgcccgaggtacaacggcaggactcacctgcttcgtggatattcacttcggacctaaaaagtnttacttacgttgttcggttaccagtcaaggtaacgtcgacggtacccacgggtccccttaggtaacctcggttacacttaccgagttcggacgacctaggtaccgactacgtaccgtccgggtacttcccgtaggaacgtacgtacgtttcccgtacgtccgtacccgttaccgtaagtcccgttacggaaccgggtaactacgggttcccggaccccgtttaaccggttacgttaaacccgttacggtcccggtaacggggtttcccggggaacccccgtttaaggggttacccgggtaacgtaaggtacggtaaaccggttcttaacggtaaaccttttacgtaacgtttacgttaacccggaccctaaaccgggtaacgttaaccggtaacggtttacggtacccggttacgtaaccgggtccggggttaaacgggggtttaccgtaccgggggtaacgggtaaccgggtaacccttaaggggttcccgtaccggttccggttacgggtaacaacccgggtacccgtaagggttaccccgtcccggttaccccgtaccgggttaccttcccggttccgttacccccgg

SEQ ID NO: 90244 - DNA, 537 bp, Homo sapiens
  misc_feature: GYAE6OF02I6H9N.21.8.A08.1.454.CMB.1.raw
  modified_base (219)..(219): a, c, t, g, unknown or other
  misc_feature (219)..(219): n is a, c, g, or t
  modified_base (332)..(332): a, c, t, g, unknown or other
  misc_feature (332)..(332): n is a, c, g, or t
  modified_base (457)..(457): a, c, t, g, unknown or other
  misc_feature (457)..(457): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtgtccccaggaccaaacggccaggatcacctgctctgganattcattgaccaaaagatatacttgttggttccagcagaagtcaggccaggcccctgtactggtcatccatgaggccagtcgacgacacgtccgggatcccgtgagagattcnctgcctccagctcgagggacaggtcggaccctacgttgaacctagtcgaggtcggggacccagggtggacgagtgaagctagactatattgtacgcaccagacagtagtgtacagtcgaggggtntcggcggagggacctagttcgaccgtcgttggtcacgtcccgaaggtcctcggtcccccgtcggtctaccgtcttcccgg

SEQ ID NO: 90245 - DNA, 734 bp, Homo sapiens
  misc_feature: GYAE6OF02IWROA.21.8.A08.1.454.CMB.1.raw
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggaggcagtcggtccagccgtgggacgtccctgacgcccttctcctgtcgcgacgtcgttccgtggactttcgagttacgtccggtccttccgtttcggaccctagttcgaccgtaccggttcggggtccccggacccgaagggtcctacccggaggggaccggaacggggggtcctagggggtagggttcggggggttggacggttaagtttacgttcgtaggggttaatggaacggttagggaagttcggaaggtagtattacgtttaatccgaagtaccgtcggtagggaacggtaccgtacttaccaaccgtacttccgtacaagacgaactaacgtacgaacccaaacgaactaacgtacttacgttaacttaccgttaactaaacgtccggtacccgtaccgtaggacggaccggaaccgacggaacgtaccgacttagtacgttatacggttacgtacggtacgttcgtttacgtacgttacggtttaccgggaccggtaaccggtaccggtcggtacccg

SEQ ID NO: 90246 - DNA, 715 bp, Homo sapiens
  misc_feature: GYAE6OF02I7BM3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggactcacctgctctggagattcattgaccaaaagaatatacttgttggttccagtcagtaagtcaggccacggcccctgtactggtcatccagtgaggccagtcgacgacacgtccgggatcccgtagagtagtacttctctcgaccctccgagcgtacgagggactaggtcggaccctaccgttggactacgtacgacgggtacggggacccgtaacgggtcgggaccgtagttaggaacgtccgtacggtaaccttaacgttagtttacggttacgacctaaccgacggtaacgtaaggttacggttacggtacgtaacggttacgggtaacgggggtttaacgttacccggggacggggtaacggggtaacccgttaagggtttaccgggtaccccgggttcccggttttaccgggtaccgtaacccggtacccggtaaacgggtcccgttacccgggtacccccccgttaccgggttacccgtaacccggtttccgtttaccccccggg

SEQ ID NO: 90247 - DNA, 792 bp, Homo sapiens
  misc_feature: GYAE6OF02HHCEF.21.8.A08.1.454.CMB.1.raw
  modified_base (173)..(173): a, c, t, g, unknown or other
  misc_feature (173)..(173): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccacccgtcggtntcagtcgtccccaggacaaacggccaggactcacctgctcgtggagtacttcattcgaaccaaaaagtaattacgtacgtttgtttcggttaccagacgaagtaacgtcacggccacggcccctgtactggtcactccagtcggacgccagtccgacgacaccggtccggactcccgagagactacttacctcgtccgtccctaccgagtccctaacgggaacgggacgtacgggttaccgacccgttaaccgttcggtaaaccttacggtaccggtacggggttccggggacccgtaaggggttaccggaaacggtacgttaggaaaccggtcgttacggttaaaccctaacgtttagtttccggttaaccaccgtaccgaacgtaacgtaggttacggtcgttaaacgtaggttccggggttaagggggttacgttaccggggacgggtaaaccgggaaccgttaacgggtttaccggttacccgttaccgggtttacggtaacccggtacccgggtaaccccgtaacggggttccccgttaccccgggttacccccggttaggtaccccgttacccggtttacccggtttaccccgttaccccccttaacccccgg

SEQ ID NO: 90248 - DNA, 704 bp, Homo sapiens
  misc_feature: GYAE6OF02IOJWJ.21.8.A08.1.454.CMB.1.raw
  modified_base (121)..(121): a, c, t, g, unknown or other
  misc_feature (121)..(121): n is a, c, g, or t
  modified_base (127)..(127): a, c, t, g, unknown or other
  misc_feature (127)..(127): n is a, c, g, or t
  modified_base (215)..(215): a, c, t, g, unknown or other
  misc_feature (215)..(215): n is a, c, g, or t
  modified_base (408)..(408): a, c, t, g, unknown or other
  misc_feature (408)..(408): n is a, c, g, or t
tcagtcgtcgctcgcacgaccggtgctcgatttagcatactctacagggggctgtgggctcaggaggcagagctctgggaatctcaccatggcctggacccctctcctgcctcccctctcnctttcngcacagtctctgaggcctctatgagctgacacagtccacccgtggtgtcagtcgtcccaggacaacggcagactcactgctcgagganattcattcgaccaaaagtatatacttgtcgtaccagacgaagaagtcgacggaccacggtcccctgtactggttacactccagttacgaacggtccagtccgaaccggacctaccgtaccgggtctacccgtaggaagtacgtactcgtcgtcgccctcgacgtcgtacgagggactagtcggacctaccgtntaaccgtacgtacgaggtaccgggtaccgtaacggggtacgacggtaacgtaggtaaacggtaccgttacgtaaccgttaacgtttaacgttaccggtttaccgaacgaaccgtaaggtaaccgtaagggttacgtacggtaccgtaagtacccgggtaaggggtttccggttacgggtacgggtacgggtaaccggtaccggttacggtacccggttccgttacgggttacccgtaccggttaacccaacggtccgtacccggtcccccgttgtacccgttacgtcccgttcccg

SEQ ID NO: 90249 - DNA, 706 bp, Homo sapiens
  misc_feature: GYAE6OF02JTM7I.21.8.A08.1.454.CMB.1.raw
  modified_base (225)..(225): a, c, t, g, unknown or other
  misc_feature (225)..(225): n is a, c, g, or t
  modified_base (347)..(347): a, c, t, g, unknown or other
  misc_feature (347)..(347): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtggtgtcagtcgtccccgaggacaacggcaggatcacctgctcgtaggatnttacagttcaaccgaaaaagtaattacttacgttgttcgtccagtcagtaagtcgaggccacggtccctgtactgcatccgagtcgacgcacgtccgaacgaccaccggtcggacttaccgnggaacgtacgtacttcctacgccgtcctacacgtccgtcggaacgggacgtacggtaccggccctaaccgtttacggaactacgtaccggtaacgggtccgggtaccggagggtacggaacggtagtaacggacgtaccgtacgtaacgttaacgttaggtttacgtaccgaccgtaacgagtaccgtaaggtacgtacgtacgtaaggttcgggtaacgggtttacggccggggtaacggtacggtaacgttacgggttcggttaacccgggttcgttaaccgggaccgtaaccggtacccggtaacggttcccgtcccggtacccccgtcggttacccaccgttacccgttcccccg

SEQ ID NO: 90250 - DNA, 784 bp, Homo sapiens
  misc_feature: GYAE6OF02H9321.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctcactttctgcacagtctcgtgacggcctcctagtgacgctgacacacgcccacccgtcggtgtacaggtccgtaccccgaggaaccgaaaaccgggccaagggtactccacctgaccgttcgtagggagtaacttctagttacgaaactaaaaagtaacttattacgttttggtttcgttaccgagacgaacgtaacgtcgacgaccgtacggcccctagtacgtacggtatactccgtagtaggacggcacggtaccgaaccgacgtaccggtaccggacctcctggaacggtctcgtttaccgtcgtcgtccctcgacggtcctacggacgggtactacggccggtaccctacttacgtaaaccgttgtacggtacgggtccgggacccgggtagggtacggaacgtaggtacggtaacgtacgttacgtaaccgttaacgtttagtttacgttaccgtaccgaaccgtaacggtacggttaacgtacggttacggtaccgtaacgggtacgggtaacggggttcgggttaccgggtaacgggtaaccggggttaacctacgggtacccggttaccggttcggttccggtacggacccgtaacggaccggtccgtaccccgttccccggtaccgggtttccacccggttcccgtccccgg

SEQ ID NO: 90251 - DNA, 730 bp, Homo sapiens
  misc_feature: GYAE6OF02I1PM1.21.8.A08.1.454.CMB.1.raw
  modified_base (140)..(140): a, c, t, g, unknown or other
  misc_feature (140)..(140): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctcngaggcctcctatgagctgacacagcccacccgtggtctcagtcgtccccaggaccaacggcaggactccacctgcctgtggatcttcgattcgaaccaaagtaatatacgttgttacgttccagcaagtagtcgacggccgacggtcccctagtaccgtggtccgaatccagtggacggccgagtaccggaccgaacgtaaccgtccggggtacttcccgaggaggtacgtacttcgtacgtccggtaccttaccgcgtacctacggacggacgacgtccgggtcccttaaccgttcggaaccttacggtaccgacggggtcccgggggtaccccgtaggggtcgggtaacccgtaggttaccggaacgttccgtacggttaaccttaacgtttaccgttttacgtaaccggtaccctaacccgtaaggtaacctagggttacggtaacgtactaaccggtacggggtaggggttaaccgttcgggaaccgggttacgggacgttacgggtcgaccggtttcggtcgtaccgaccggaccgacggtccgtcccggtaccccgttcggaccttcccggttccttaccccgg

SEQ ID NO: 90252 - DNA, 746 bp, Homo sapiens
  misc_feature: GYAE6OF02GE0PN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccaggacaaacggccaggatcacctgctcgtggagtattcagttcgaaccaaaagtatatacgttgttggttccagcagaagtcaggccacgcccctagtactggtcacgtccagtgacggccagtcgacgcaccgtccggctcccgagagacgtacttctacgtcgtccctccacgtctacggacgggacgtacggtcggaccctaccgtttacgaaccttagtaccgtagggtcccgggaccgtaggggtacggtaaccggtagtacggaacgacgtcggtaaccttacgttacgtttaccggtaaccacccgtaccgaagtaacgtaacgggttacgttacgggtacctacggttacggggttaacgggggttaacggttccggggaaaccgggtaaccggggaaccccgttaaacggttccgggtaaaccccgggttaaccggttaaccgggtacccgtaacccggtaacccggtaaccggttccccggttaccccggtaccccccggttaccgggttaccccgttaaccgtttccccggtttacccccccgg

SEQ ID NO: 90253 - DNA, 883 bp, Homo sapiens
  misc_feature: GYAE6OF02F36D3.21.8.A08.1.454.CMB.1.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccacccgtcggtgtcagtcgtccccaggacaaacggccaggatcacctgctcngganattcattgacaaagatatacttgtgtcagcagatcgagccacggcccctgtactggtcactccagtggaggccaggtaccgacgaaccaccgtcccgggacttccccgaggagtacgtattcctcgtaccgccctacccgagtccgttaccgaacggggtactacgggtccggtacccttacccggtttacgtaaaccgttacgtaccgtacggggggttcccggggggtaccccgtaaggggggttaccgggtaaccgggtaacgttaacggggtaaaccggttcccgttaacgggttaaacccgttttaaaccgtttaaaggttttaccgggtttaacccggtaacccgtaaacccgttaaaccggggtaaccgtaagggtttaacggggtttaaccgggttaccgtaaaccgggtttacgggttaaacgggggggggttttaaccgttacccgggggggtaaccgggggttaaaccgggtaaacccggttaaacggggtttaaccggttacccccgggttttaccgggttacgggttaacccggtaccggtaaccccggtaaacccggggttcccgttacccccgggtaccccccggtttccgggttaaaccccgttcccggttaccccggtttacccgggttccccccccggttcccccgg

SEQ ID NO: 90254 - DNA, 770 bp, Homo sapiens
  misc_feature: GYAE6OF02HQ5X8.21.8.A08.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgcctcgtggagtacttcattcgaacctaaaaaatttntttagttttttacggaaccagtaccgaagtaacgttcgacggccacggccccttggttcggttggtcgacttccgagtggtaggacgagggacgaccgaccccgtccgggacttcccgtagagtagtacttccgtctcggcctacccgaacttcgaacggggcggttacggaccgtaacggtttgtacgtttccgtacgtacgggttaccggggaccccgtagggggttacgggaacgggtaagtacgggtaacggtacggttcggtaaaccgttaacgttaccgtttacggtttaaccgtaccgaaaggtccgaaacggtaccgaacggtacgttaacgggttgggtaccgtaacggttacgggacgggggtctaacgggttccgggacgggtacggaaccggtaagggttccgtaccggttaccgtacgggtctaccggacccggtaacggtcccgtacccggtccccggtccggttacccgtaccgttcccgtttaccgtacccccgttaacccccg

SEQ ID NO: 90255 - DNA, 796 bp, Homo sapiens
  misc_feature: GYAE6OF02GVTFE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagtctgacacacgcccacccgtcgggtgtacacggtcgtacccccgaagggaaccgaaaaccggccgaagggactaccgaccgtcgtcttccgtgggaacgtactttacattacgaaccgtaaaaagtaacttaattacgtttggtttaccggttaccgagtacaacgaagtaccgacggcccgtaacggtcccccgttcggtacgtcggtacctactacccagtacggacggccgacggtaccgaacgacctaccggtccggaccttacccggtagaacggtatcttaccgtccgtcctccgtaccacgtcccgtacggaacgggacgacgggttccgaccctaaccgttacgaacgttacgacgggtacgggtaccggggaccgtagggtacggaacgtaaggtaacgaacggtcgtacgtaacttaacgttagtttaccgtaccgactaccgtaacgaacgtacggtaggttcgtacgtaacgggtcgggttaacgggggttacgcgggtaaccgggtaacgggtaccgttaacggttccggtaccggttttccgggtaaccggtaccggtaacccggtacccggacggtcccggtttacccggccccggttcgtacccgtcccgttcccgttcccccgg

SEQ ID NO: 90256 - DNA, 833 bp, Homo sapiens
  misc_feature: GYAE6OF02HEHRN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctagacacacgcccacccgtcggttgtacgaggtccgtaccccgaaggaaccgaaaccggccgaaggactccaccgtgctcgtaggagtattactagttacgaaccaaaagtaattacttacgtttggttacggttaccagacctaaggtaacgtcgaccggaccaaccgggtcccccttaggtaccgtggtaccacgtacccgtaggtcggaccggtaccgtacggtaccggaaccgaccgtacccggtacccgggtaacctcccggtaggaacgtacgttaccttaccgtccgccgtaccctaccgagtacccgtacgggaacgggtaccgtacggtacccggtaccctaaccgtttagtaacccttacggtacccgggtacggggtacccggggtaaccggtaggggtaaccggaacgttacggtacggtaacgtaccgtacgttaaccgtttaagttacgtttaccgtaacgacctaaaccgtagtaacggtaggttacggtacggtacgtagggttaacgggttacggggttacggtacccgggtaaggggtaaccggttaaccgtagggttaccggtaccggttcggttacgtaccggtaacccgaccggtaaccggtcccggttacccgtcccccggtagttacccgttacccgttccggtttacccccg

SEQ ID NO: 90257 - DNA, 727 bp, Homo sapiens
  misc_feature: GYAE6OF02IEESA.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctcggacccctctcctgcctccccctctctactttctgcacatctctgacggcctctatgagctgacacacgcccaccgtggngtcagtcgccgaggacaaacggcagctacgactgtctcgtaggatattcattacgaacgaaaaatattaacttacgtttcggtttcggttaccaggacgtaaggtaacggtccgacggaccgaccggtccgtacggttacgtacggtacactccgtagtcgggaacgccgacgtaccgacgaccgtaccgtccgggacttccgaggtacgagtacttcctcgacgtccacgacgcgtacgacggcgagtccggacctacgtatactacgtgaacgggtccggccgtagggtaccggacgtagtacggacgtacgtacgtaaccttaacgttacggttacgttaccgacgtaaccgtaaggtacgtaagggtaacggttctaacgggacgttacggggtaaaccgggggttgttaacccggggagggtaacggacggttaacggtttccggtaaccggttcggttaccggttacgaaaccccgggtccggtaaacgggtccccttacccgggaccccggttccggtacctacccgttcccgttaacccccgg

SEQ ID NO: 90258 - DNA, 631 bp, Homo sapiens
  misc_feature: GYAE6OF02F4XTN.21.8.A08.1.454.CMB.1.raw
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccacctcggtgtcagtgtccccaggacaaacggccaggatcacctgctctggagattcattcgaccaaaagaatatacttgttggttccagtcagagtcaggccaggcccctggtactggcatccatgaggccagtcgacgacacgtccgggatccctgagancttctctcncctcgagctcgagggacaggtcgccctacgttcgactgtctcgggtcggggccccgaggggttacggacgtaagtacgggaaacgtccgtaggtacttacttaggtttacggttacacccgtaccaacgtacgtacggtaaggtcgtacgtacgtacgggtaggggtcgtttcggggacgggtacggggaccgttacggttggtaacccggttccgttacgggtacccgacggtaccccgtacggtccgtcccgggtacccccgttccggtacccgtaccgttcccgttaccccgg

SEQ ID NO: 90259 - DNA, 640 bp, Homo sapiens
  misc_feature: GYAE6OF02G1TIR.21.8.A08.1.454.CMB.1.raw
  modified_base (140)..(140): a, c, t, g, unknown or other
  misc_feature (140)..(140): n is a, c, g, or t
  modified_base (175)..(175): a, c, t, g, unknown or other
  misc_feature (175)..(175): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (403)..(403): a, c, t, g, unknown or other
  misc_feature (403)..(403): n is a, c, g, or t
  modified_base (551)..(551): a, c, t, g, unknown or other
  misc_feature (551)..(551): n is a, c, g, or t
  modified_base (574)..(574): a, c, t, g, unknown or other
  misc_feature (574)..(574): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttctgcacagtctctgnggcctcctatgagctgacacagcccaccgtcggtntcagtcgcccaggacaaacggccaaggatcacctgctcgngganactcatgaccaaaagatattacgttagttggtaccagacaagaagtcgacggcccgtaggcccccttaggtacctggttaccaacttccatgaccggctacggcaaccggacttaccgacggacttcccgaggacggaatcttcttccgacgtccctcctaggaccttacggaacgggtaaccncgggttacggacccgtaacccgttttagactttaacctacggtaacggttaccggggacccgaagggttcgggaacgtacggtacgtaaagccgtaagtacgttaaccttagttacgtacgtacacctaagagtacgtaggttcgtanagttacggagggtacgttacggngggtacgacgtagtcgtacgtcgtgttacgagaccgacgcgtccgcccgtcgactctaccttccgg

SEQ ID NO: 90260 - DNA, 819 bp, Homo sapiens
  misc_feature: GYAE6OF02I6W2U.21.8.A08.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgccaccctcggtgtcagtcgtaccccgaggacaaacggccaggactcacctgctctggatnttcattcgaccaaaagatatacttggttgtccagcaagagtcaggccgacggccctagtacgtggtcacgtccagtcgacgccgagtcgaccgacaccgtccggactccgtagagtacgtattccgtccgtcgtcctaccgacgcccgtacggaacgggtacgtaacggttcggtaacccgtacctttaccgtaacgttcgtaccggtaccggggtaccggggaccccggtagggtacgggacgtaacgtacgggtaacgtaccggtacggtaccttaaacgtttagtttcggttaaacccggacccgtaacgaaaccggttacggttaaacggttacgttccgggttaagtaaccgggttacggggtaaccggggggttttaaccggttaaccggggggtaaacccggggtaacccgggtttaacccggggtaaacgggttttacccgggtaacccgggttttccccgggttaacgggttaacccggttaaccccggggaacccgtaaacccggggttccccgttacccccggggttaccccccgggtttacccggttaacccgggtaccccgtttccccggtttaacccccgg

SEQ ID NO: 90261 - DNA, 889 bp, Homo sapiens
  misc_feature: GYAE6OF02H7C87.21.8.A08.1.454.CMB.1.raw
  modified_base (442)..(442): a, c, t, g, unknown or other
  misc_feature (442)..(442): n is a, c, g, or t
tcagtcgtcgctcgcacgaccggtgctcgatttagcatactctacagggggctgtgggctcaggaggcagagctctgggaatctcaccatggcctcggacccctctcctgcctcccctcctcactttccgcacagtctctgaggtcctcctatgagctgacacacgcccacccgtcggtcgtcgagtccgtccccgaggaaccgaaaccggccgaggactcaccgtcgctacgtggaagtacttctaagttacgaaccgaaaaagtaacttattaacgttttcggtttacggttccaagtaccgaaggtaaacgtcgaacgggcccgtaccgggtacccccttacggtttaaccgttcggttacctacgttaccccaaggtccggtaacggacccgtaacggttcccggaaccgtaacccgtaccggttaccccgggtaacnccccgttaggaaccggtacgttacctttccgttaccgtccgttacccgttacccgaggtcccgtacggtaaccggggtaacctacgggttacccgtacccgttaccggttaccggtaaacttttacgtaccggtaacggggtccggggtaccccggtaggggttaaccgggaacgtacggtaggtaaccgtcggtataacgttaacgtttcgtttacgttaaccgcctaacgtacggaacgtaggttaccggtacggtaccgttaggtaccggggttaacggggtttacgttacggggtaccgggtaacgggttacgtaaccgggtttaccgtacccgggtttccgtaccggggtacccgaaaccggtacccggtaaccggtcccgttccccgggaccccgtttcccggtacgtttaccccgttcccggttacccctttacccccgg

SEQ ID NO: 90262 - DNA, 679 bp, Homo sapiens
  misc_feature: GYAE6OF02JL9US.21.8.A08.1.454.CMB.1.raw
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
  modified_base (508)..(508): a, c, t, g, unknown or other
  misc_feature (508)..(508): n is a, c, g, or t
  modified_base (516)..(516): a, c, t, g, unknown or other
  misc_feature (516)..(516): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgccacagtctctgacggcctcctatgagctagaccacacgcccacccgtcggtgtcagtccgtccccgaggaaccaacggccaggactcaccgtgctcgtaggactacttcagttacgaacctaaaaagtattattacgttgttacggttccagacgagaagtcgaggacctcggccccttagtactggtaccacgtccgatcggacgccgtagtacggaccgacacggtccggattcccgagtagacgtattccgtcgtacggccctaccgagtcgtcgaacgggacncggttcgccctacgttanacgtagtcgaacggtccgggccgtaagggtcacggtagcgaagtcgtaagtactactttacgttcgtaccncgtaaacnggtatacggtagtcgactaggtcggtaaggggttcgtacgggagggacgttaaaccggtggttaccgtccgggtttaccgtagggtacccgtacgacccggtaagggtccgttcccggtaccccggtttccggtaaaccgttccgttaacccggttcccccgg

SEQ ID NO: 90263 - DNA, 707 bp, Homo sapiens
  misc_feature: GYAE6OF02JE22J.21.8.A08.1.454.CMB.1.raw
  modified_base (161)..(161): a, c, t, g, unknown or other
  misc_feature (161)..(161): n is a, c, g, or t
  modified_base (218)..(218): a, c, t, g, unknown or other
  misc_feature (218)..(218): n is a, c, g, or t
  modified_base (419)..(419): a, c, t, g, unknown or other
  misc_feature (419)..(419): n is a, c, g, or t
  modified_base (483)..(483): a, c, t, g, unknown or other
  misc_feature (483)..(483): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggcctctatcgagctgacncacgcctacccgtggtcgtcagtccgtacccgaggacaaccggcaggactcaccgtnacctgaggactcttcgtattcgaacgtaaaagattctacgttgttacgttcgagcgaagacgttcgacggccgacggtccttagacgttcggacacgtcctagtacgggactaccgacggtaccgaacgaccgtccgggtaacccggactcccggtgaaacgtcggtacttcctactcggtcctacgcgtcacggacgganacgtccggactccgtgactacgtcgacgggttccgggaccgtagggtcgacgtagacggtaacnccggttcgaaacttcgttagttcgttaaccgaccacggtacgaacgtagggtcgttaggaccgtacgtaaccgggtaggggttccgtacggggaaggtacccgggtaactaccggggtttacgccccggtttaacgggtttacgggacccgaccggttaaccgggacccggttacccgtccgttacccccgggttacttccgtaccggttccgttacccccggg

SEQ ID NO: 90264 - DNA, 976 bp, Homo sapiens
  misc_feature: GYAE6OF02HW3BJ.21.8.A08.1.454.CMB.1.raw
  modified_base (131)..(131): a, c, t, g, unknown or other
  misc_feature (131)..(131): n is a, c, g, or t
tcagtcgtcgctcgcacgaccggtgctcgatttagcatactctacagggggctgtgggctcaggaggcagagctctgggaatctcaccatggcctcggacccctctcctgcctccccctctctactttccngcacagtctctgacggcctctatgacgctagacacacgcccacccgtggtcgtcagtccgtacccaaggaaccaaacggccaggactccaccttgctcgtaggactattcatacgaacaaaagtatacttacgttgttcgtaccagacgaaggtacgtacgacggcccgacggtaccccttggttaacctcggtacctacgtcctaggtacggtacgccgtacgtaccggaaccgaaccgtacccggtacgggaccttccggaaggtacgaacgttccttaccgtaccgtccggtacccctacggtacggtacccgttaacgggaacgggggtaccgtttaccgggaacccgttaacccccgtttaccgtaaaaccgggttacccgtttaaacggttaccggggtaccgggggtttacccgggggaaaccccgggttttaagggggaaaccggggtaaacccggttaaagggttaaccgggtaaaccggttaccgttaaccgggtttaaacccttttacgggttttaaaccgtttaacccgggtaacccgtaaccggtaaaaccggtaacggttaaccgggttaacgggttacggggtttaacccggttaaggttaaccggggttaaccggggggtttaacggggtttaacccggggtaaacccggggtaacgggggttaaacccgggttaacccgggttaccggggtttaacgggtttaacccccgggtttggttacccggttaccggaaacccccggtaacccgggtcgggtttaccccggtcccccgggttacccgtttacccggggtacccttaccccgggtttcccctttaaccccccgg

SEQ ID NO: 90265 - DNA, 685 bp, Homo sapiens
  misc_feature: GYAE6OF02JFF1H.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcactgctctgganttcattcgaccaaaagatatacttgttggttccagtcagaagtcaggccaggcccctgtactggtcatcatgagccagtcgacgacactccgggatccctgagagtattcctctcgtccctccagtcctacggaagggaccaaggtcggaccctaccgttagactacgtcgtacgggtcggggccccgtaaggggtcggacgtaagtacgggaacgtcgtacggtaacttaacttagtttacgttaaccgcctaaccgaggtaaccgtaggttacggttcggtacagttacgggttaaggggggttacttaccgggggacgggtaacggggtaaccgtacggtttacgggaccccggtttccgggtttaggtcccggaaacccggtaccccggtaagggtaccccgttcccgggtaccccccccgtttaccgggttacccgtaccgtttcccggtttaaccccccgg

SEQ ID NO: 90266 - DNA, 805 bp, Homo sapiens
  misc_feature: GYAE6OF02HW12W.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctcctatgagctgacacacgcccaccctcggtgtccagtcgtccccaggaccaaacggccaggactcacctgctcgtggatatcattcgaacaaagatatacttgtcgtaccagacagaagtcgacggccacggtcccctaggtacctggtacactccaagtcggacggtccacggtacgaccgaccgtaccgtccgggactccctaggacgtagtactttctacgtcgcctaccgagtcctacggacgggacacgggtccgtacccgtaaccgtttacgaacttacgtaccggacgggttccggggaccccgtaggggtacggaactacggtaacgaacggtccgtaacgttaaccttaaacgttttacgttacggttaaaccccgaccgaaaccggtaaccggtacgtttaaaggggtaccggttaaggttacccgtaaacggggttaccggggtaaagggggtttaccggttaaaccgggggaaccggggtaaacgggggtaacccgttaacgggtttcccggggtaacccgggtttccccggttttaggggaacccgtaacccgggtaacccgggtaacccggttccccggttaccccgggtaccccccgtttaaaccgggtacccttaccccgggtttaccccgttaaccccccgg

SEQ ID NO: 90267 - DNA, 705 bp, Homo sapiens
  misc_feature: GYAE6OF02GPBYY.21.8.A08.1.454.CMB.1.raw
  modified_base (310)..(310): a, c, t, g, unknown or other
  misc_feature (310)..(310): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagaatatacttgttggttccagcagaagtcaggccacggcccctgtactggtcatccatgacgccagtcgacgacncgtccgggatcccgtagagagtacttctcgtcgccctccaagtctacgaacgggacaggtccggaccctaccgttagaacttacgtcgtacgggtcggggaccccgaggggtacgggaacgtaagtacggaaacgtccgtacggtaactttaacgttaagtttacggttaaccgacctaaccgtaagaaccgtaaggttacggttacggtactaacggttacgggttaagggggttacgttccggggaacgggtaacggggtaacccttaaggggtttcccggtacccgggtttccggtttaacgggtacccgaaccggtaccccggtaaagggtccccgttacccggtccccccggtttaccggtaccgtacccgttcccggtttacccccggg

SEQ ID NO: 90268 - DNA, 841 bp, Homo sapiens
  misc_feature: GYAE6OF02HMQRA.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtggtgtcagtcgtccccaggacaaaccggccaggactcacctgctcgtggatattcagttgaccaaaaagattatactttgttggttaccagcagaagtcaggccagcccctgtactggtcatccatggacgccagtcgacacctaccgtcgggactcccgtagaacgagtacttcgtactcgtccctcgacgtcgtacgaagggtacaagtccggaccctaccgttggaacctacgtacgtacgggtccggggacccgtagggtacggaacggtagtacggaaacgtccgttaacgtaacgttaaacgtttacgtttacggttaacccgaccgtaaacccgtaaacggtaaccgttaacgggtttaacgggtttcgggttaaaccgtaaccgggtttaccggggttaaacggggggggttttaaccgtttaacccggggggaacccgggggttaaaaccgggggttaaccccggttaaacggggtttttacccggggtaaccccccggggtttttacccggtttaaccgggggttacccggtaaacccggtaaccccccgggtaaagggttcccccggtttaaccccccggggtacccccccccgggttttacccgggtttaaccccggttaccccgtttacccccgggtttttaaccccccccggg

SEQ ID NO: 90269 - DNA, 765 bp, Homo sapiens
  misc_feature: GYAE6OF02HALMW.21.8.A08.1.454.CMB.1.raw
  modified_base (104)..(104): a, c, t, g, unknown or other
  misc_feature (104)..(104): n is a, c, g, or t
  modified_base (127)..(127): a, c, t, g, unknown or other
  misc_feature (127)..(127): n is a, c, g, or t
  modified_base (163)..(163): a, c, t, g, unknown or other
  misc_feature (163)..(163): n is a, c, g, or t
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctntcctgcctcccctctcactttcngcacagtctctagacggtcctctatcgagctgacancgcccaccgttggtgtcagtcgtcccgaaggaacgaaacggctaggactccactgcttcgnggatattcagttcgaaccaaaaagtattacttacgttttcggttcgttaccgaacgtcgaaaggtaaacgttccgaacggtaccgtaccggtcccccttaggttaccgttacgggtcctaaacgtccgtaacgtacggaacggtacccgaggtaccggaaccgtaaccgtaccgtaccgggtaccttccgtaggaacgtagtacttccgtacgtccgtcaccgtacgtcgaaccgaggtccaggtaccgacctaccgttacgacgttactacggtcggggacggtaaccccgtaggggtaaccgtacggaagttaacgggaattcggtaccgttaaacgttaacctttacgggttactaaccggtacaacgaaaccgtaacgtaggtaccgtttacggcgtaacgtacgggtagggttaccggtacgggagggaaccgtaaccgtacgttaaccggtccgttacggttacggtaacctaccggtaccgaacggttccctccggttaccccgtccggttaccgacgtttccgttacccccgg

SEQ ID NO: 90270 - DNA, 715 bp, Homo sapiens
  misc_feature: GYAE6OF02JZAA2.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctctactttctgcacatctctgacggcctcctatgagctgacacacgcctacccgtcggtgtcaggtctcccgaggacaaaccggccaggatcactgctcgaggactattcattacgaaccgaaaaagtacttattacgtttaggttacggttccagtacctaagaacgtacgacggtaccgacggaccccttggtactacgggtactaaccgtaccgtagtacggtacggaccgtacggaccgtaaccgaaccgccgtaccgggtacctacccgtaggacgtacgtacttcctctccgtaccgtacacgtcgtacgacggactcgtaccggtcctaacgtgtactacgcgtacgggtcggaaccgaggtacgacgtatacgagctagtaacttatacgttctaccgacacgactacgtaggtacgtcgtacgagtaacgggtcgggttacgtaccgggaacggtacggtaacgttaacggtacgtacccgggtttcgttaccgggtacgaaccgtcccgtaaacggtcccggtttacccgacccggttaccggtacccgttaaccgtcccggtttaccccggtaccccttaacccccgg

SEQ ID NO: 90271 - DNA, 894 bp, Homo sapiens
  misc_feature: GYAE6OF02HJ4HN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggccttcctatgagctgacacgacgcccacccgtcggtgtcagtcgtccccgaggaccaaacggccaaggactccaccgtgctccgtaggagtacttacagttcggaaccctaaaaagtaacttaattacgttttggtttcgggttacccacggtacgaaggtaaacggttaccgaacggggcccgaaccgggtcccccgttaggttaacccgttgggttacctaaaccgttccccggtacgttacggaccggggtaccctaacggtaccggaccgtaaaccgacccggttaccccggggggaaccttcccccggttaagggaacggtaaccgttaaccgttttccgtaccccgtttccggtacccccgttaccccgtaacgggtccccttaaccgggaaccggggtaaccgtaacccgggggttccccgggtaccccttaaaccccgggtttacggttaaacccgttaccgttaccgggtaaccggggggtttcccgggggtaaccccgggtaacgggggtaccgggtaaacgggtaaccggtacgggaaacggttccgtaacgggttaaccttaacgtttacggtttacgtacccggtaacctaaccggacgtaacgtaggttaggtcgtacgtaacgtcggggtaagggttacggttcgggacggtaggtaaccggtaggtcgtaccgttccggtaggtcccgagacccgtaggccgttcccggacccgttcgtactctaccggttccg

SEQ ID NO: 90272 - DNA, 769 bp, Homo sapiens
  misc_feature: GYAE6OF02G9L2Q.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacacgccacccgtcggtgtcagtcgtccccaaggaccaaacggccaggactcacctgctcgnggagattcattacgaccaaaagaatatacgttgttaggttccagcaagaacgtcacggccaggcccctgtacgtggtccacgtccatcggacgccagtaccgaccgacaccgtccgggactcccgtaggacgaatcttacctcgtacgcccttaccaaggtcctaccggaagggtaaccacggggttaccggacccttaaccggttttacgaaaccgtttacggtaccggttaccggggtttacccggggggacccgttaacgggggttacggtaaccgggtagtaaccgggaaaggtacccggttaagggtaacctttaacgttaacgtttttcggtaaaccgtaccgtaaaccgacggtaaccgtaagggttacgtacggttacgacggtttacgggtaacgggggtttactccggggtacggggaaccgggtaacgtacggttacggtaccccggtttggtttccggtaacggtacccgacccgggtaacggtcccgttacccggtccccggtaccggtaccccgttccgttccgtttcccccgg

SEQ ID NO: 90273 - DNA, 638 bp, Homo sapiens
  misc_feature: GYAE6OF02GX6MN.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganattcatgaccaaaagatatacttgttgttccagcagaagtcaggccacggcccctgtactggtcatccatggacgccagtcgacgacacgtccgggactcccgtagagagtacttctcctcgcccttaccgacgtctacggacgggacagggtcgaccctaccgttcgacttactcgagggtcggggacccgtagggtcggacgtagtacgaacggtcgtacgtaaccgttacttagtttacgttaccgacctaccgaagaccgtaaggttacggtgtactaggttacggagggggttactcggggacggtacgggtaccgtacggttccggtacccgttccggtttacggtaccgtaaccggacccggtaggcccttaccgggtcccccgtacggtcctacccgttcgttacccccg

SEQ ID NO: 90274 - DNA, 721 bp, Homo sapiens
  misc_feature: GYAE6OF02F1FQA.21.8.A08.1.454.CMB.1.raw
  modified_base (268)..(268): a, c, t, g, unknown or other
  misc_feature (268)..(268): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctcggtgtcagtcgtccccaggacaaacggccaggactcacctgctctgggatattcattcgaaccaaaaagaattatactttggttcggttccagnagaagtcacggccacggcccctgtacgtcggtcactccatcggacggccgagtaccgacgaccaccgtaccgggactcccgtaggacgagtacttctcgtccgcctccgagtcctcggacgggactacgggtcgtaccctacgttcggaacctgtacgtagggtccggggacccgaggggtacggaacggagtagggaacgtccgtaggtacctttaacgttacgtttacggttacccgaccgtaacccgacgtaacgttaacgggttaaggttcggtaactacggtacggggttaaggggggttaccgttaccggggacggggttaaccggggtaacccgttagggtttaccggtaaccccgggtttcggttacgggttaccggaacccggtaccggtaacgggcccgttcccggtacccccggtccggtaccgtaccttcccgttaccccg

SEQ ID NO: 90275 - DNA, 780 bp, Homo sapiens
  misc_feature: GYAE6OF02IJGXN.21.8.A08.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtcctctgacggcctcctatgagctgacacngcccaccctcggtntcagtcgtacccaaggaccaacggccaggactccacctgccttcgtaggagtacttcattaagaccaaaaagtattattacgttgttacgttaccgagacgtaaggtaacgtacgacggaccgtacggtacccccttaggttacctcgggttacaacctaccgtaagttacgggtacggacccctaaggtaccgaaacggtaccgtaacccggtacccggggtaacttccccggttaggaacggtacggtaactttcccgtccgttaccggcccttaacggaccggtcgtaaccggacgggaacgtacggtaccggtacccgttaccggttcgtaccttaagtccggtacgggtaccgggacccgaagggtcggacgtacgtaacggaacgtccgttacgtaacgttaacgttagtttcgtaacccgtcaaccgtaagtacgtacggttagtacggtacgtaacgttacggtaacggggttcggtaccgggcggtaacggttaccgaacggtttcggaacccggtttcggtaagtccgtaacggtaccccgaggttccggtacccgtcccccggttacggtcctaccgttcgttaccccgg

SEQ ID NO: 90276 - DNA, 760 bp, Homo sapiens
  misc_feature: GYAE6OF02GYATT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacgacgcccaccctcggtgtacagtcgtacccccgaaggaaccgaaaccggccaggactccacctgctcgtaggagtacttcattagaacccaaaaagtaatacttaccgtttaggttcggttccaagcaacggaagtcgacggcctacggtcccctgtaccgtgtacactaccgtagtcgacggccgtaggtaccggaaccgaccgtaccggtacccgggtactccccgtaggacggtagtactttccgtccgtcgtccctaccgacgccgtacgacgggtaccgtacggtccgtacccttaccgttacgaaccttacgtaccggtacgggtccggggaccgtaggggtacggacgtaggtaacggtaacgttcgtaacggtaacttaacgtttcgtttaacggtacctaccgtaacgtaacggtaacgttacgggttaggttcgtaacgttacggttacgggtaacgggggttactaccggggaacgggtaaccggggtacgtagggttaccggtaccggttcggttacggtaccggtaccgacccgtaacggtcccgtcccgttccccgttggtaccctaccgttccgttacccccg

SEQ ID NO: 90277 - DNA, 589 bp, Homo sapiens
  misc_feature: GYAE6OF02F14M4.21.8.A08.1.454.CMB.1.raw
  modified_base (216)..(216): a, c, t, g, unknown or other
  misc_feature (216)..(216): n is a, c, g, or t
  modified_base (484)..(484): a, c, t, g, unknown or other
  misc_feature (484)..(484): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagcccaccctggtgtcagtgtccccaggaccaaacggccaggatcacctgctctgganattcattgaccaaaagatatacttgttgtccagcagatcagccacggcccctgtactggtcatccatggaggccagtccgacgacacgtccgggactccctgagagtattctctcgcctccgagctacgagggactaggtcgcctactttgactagcgtaggtcgggccgagggtcggacgtagtagaacgtctgtactacttagttacgtacgaccacgtagacctaaggttcgtgtactaggtcggtaggggttacgttccggggnggaacgggactaaggttcgtacccggttcgttcgggtccacgacccggtaaggccttccgggtccccttcggtccgtaccttccgttccggttaccccctccccg

SEQ ID NO: 90278 - DNA, 872 bp, Homo sapiens
  misc_feature: GYAE6OF02GTP47.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcatgtctctggacggtcctcctagtgacgctagacacacgccctacccgtcggttgtccaggttccgtccccgaaggaaccaaaccgggccaaggactaccaccgtgcctcgtaggatacttactagttaccgaaacctaaaaagtaacttacttaacgtttcggggtttacggttaccaggtaccgaaaggtaacggtccgaacgggtccgaccggtcccccgttaggtaccgttcggtacctaccgtaccgagtcgggaacggtccgtacgtaccggaaccgtaccgtaccgtacccgggtacttacccggtggaaacgtagtacctttcccgtcggtccctcccgttacccgacggttccgtaccgggaagggtaacccggcgggtacccgtacccgttaaccgttacgtaaccgttacgacggtacgggggtccgggtaccggtggggtaacgacggtagtacggaacggtaccgtacgtaacgtttaccgttacgttaccggtaccgaccgtaaaccgtaaggtacgttaaagggttgggttaccgtaacgttaccgggtaagggtaacgggggtttcgggtaccgggaaccggggtaaccgggtaaccgtttaaccgggtacgggttaccccggttttaacggtccgggtaaccgtaacccgggtaaccccggacgggttcccgttaccccggtcccccgttacgggttccctacccggtttcccgttccccccggg

SEQ ID NO: 90279 - DNA, 721 bp, Homo sapiens
  misc_feature: GYAE6OF02IRP4J.21.8.A08.1.454.CMB.1.raw
  modified_base (137)..(137): a, c, t, g, unknown or other
  misc_feature (137)..(137): n is a, c, g, or t
  modified_base (250)..(250): a, c, t, g, unknown or other
  misc_feature (250)..(250): n is a, c, g, or t
  modified_base (347)..(347): a, c, t, g, unknown or other
  misc_feature (347)..(347): n is a, c, g, or t
  modified_base (712)..(712): a, c, t, g, unknown or other
  misc_feature (712)..(712): n is a, c, g, or t
tcagtcgtcgctcgcacgaccggtgctcgatttagcatactctacaggggctgtgggctcaggaggcagagctctgggaatctcaccatggcctcggacccctctcctcgcctccccctcctctactttcctgcacngtctctgcggcctacctagtcgagctagacacacgtaccctcccgtcggtgtactacggtccgtaccccaggaaccgaaaaccgggcctaaagggctaccacgtcgcttcggnggattacttactagtacaaaccgaaaagtaactactttacgttgttcgtaccgagtacaagaacgtgacggaccgtcgtcccctgtcgtacggtcanaccgtagtcgaacggccacggtacaacgacctacgttccggacgtccgtagaacgagttactccgtcgtacctccgtacgtacgtacccggaaaggtccggaacggtccgtacccggtacccgttaccgttactaacggtaaccgtacggtaccgggtacgggtaccggggtaacggtacgggaaccgaggttaacgacggtacgtacgtaaccgttacttacgttacgtcgctaacgtaaccgagtaacgtggttcgacgtcggtacggtacgggtagtacgggaacggtaggtaacgacggttacgtaccggtcgttaaccggtgtaccgacgtaccgacgtcccgaccgtccgtccgttacncccttacgg

SEQ ID NO: 90280 - DNA, 658 bp, Homo sapiens
  misc_feature: GYAE6OF02JO8QU.21.8.A08.1.454.CMB.1.raw
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (217)..(217): a, c, t, g, unknown or other
  misc_feature (217)..(217): n is a, c, g, or t
  modified_base (328)..(328): a, c, t, g, unknown or other
  misc_feature (328)..(328): n is a, c, g, or t
tcagtcgtcgctcgcacgaccggtgctcgatttagcatactctacaggggggagaggagcccagcactagaagtcggcggtgtttccattcggtgatcagcactgaacacgaggatcaccatggagtttggctgagctgggtttcctccttgctgaaaacccgtagtgtctcgtgtgngngcgacacgtggtggtggtgggacggcgagtggtccgnttccgtgggacggtcccgtgtacgccgtctcctgtgtcgagcgtcgtggtagttcgtagtacttcggttcccgttcgtccgtcgtcgcgccgtcggtccggaccgacgcgnaacctagtacggtacgggttaggtggtggtacggtacgtagtgccgttagtagtagtagtcggtagtagtagtagtacgtagtacgtacgtacgtaccgtacgtacgtacgacgtacgaaccgtaccgtacgtaccgtacgtacgacgtaaaccgaaccgtaacgaaccgtaacgtaacgtacgtaaccgtaacgtacgcgtcgtttaccgtacgaccggacggacgtacgtacgaacgtacggaacgtacgtacgtacgttagtacgtacgttggactggtaccgtaggtaccgttacggtacgtacggtacggtaccgtaccgtaccg

SEQ ID NO: 90281 - DNA, 775 bp, Homo sapiens
  misc_feature: GYAE6OF02FKJP9.21.8.A08.1.454.CMB.1.raw
  modified_base (709)..(709): a, c, t, g, unknown or other
  misc_feature (709)..(709): n is a, c, g, or t
  modified_base (715)..(715): a, c, t, g, unknown or other
  misc_feature (715)..(715): n is a, c, g, or t
tcagtcgtcgctcgcacgaccggtgctcgatttagcatactctacagggggggagaggagcccagcactagaagtcggcggtgttccattcggtgatcagcactgaacacagaggactcaccatggagtttgggctgagctgggttttcctccttgcttctttaaagaggtgtccagtgtcgaggcgctaacgtggtcggagtcgtggggggacgcagtcggtccagccgtgggacgttccctaggaccgcccttacttcccgttggtcgccgtaggccgttcgtaggtacttaccgtaggttacgtccggtcctttacccgtttcgaccctagttcggtcccgttaaccgggttccggggttcccccgaaccggtacgggtccccttaccggacggggaccgggtaaacgggggtcgtacggggtacgggtggggtccggtaacgttaagttactcggttaggtagtggtaaggtacgggtaagtacgggtaagaacggttagtttaactacgttacgaggtacccggttacgggtaacgggtaaaccgggtccgttaaactcccgaacgttaccgtacgtaaccgtagtaaacgaactaccgaccggtaaaccctaaacgaacccgttacggtacttacggtaactttaaccgttaacgaaccggtacggacccgttcgacggtacgaccggacgacgtacgacgtnttacgnttacggtatcgtacgtacgttcgttcggacgtacggtcgggacgtacggtacgtcgtacc

SEQ ID NO: 90282 - DNA, 970 bp, Homo sapiens
  misc_feature: GYAE6OF02JC9WV.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctctcactttctgccacagtctctggacggcctcctatgacgctagacacacgcccaccgtggtgtcagtccgtacccaggaaccaaacggccaggactacacctggacctcgtaggacgtacttacagttacgaaacctaaaaagaattacgttaccgtttggttacggtaaccgagacaagaacgtacgacggaccgaccggtcccgtgttcggttagtaccgattaccgaagtggaacggaccgtaagggacgtaccggacccgtacggacctaccgtagacgtagtaccttcgtacgtcggacctaaccgtacgtacgggaacgggtaccggtacggaccgttaacggttacgtacgttccgtacggtacggggtacccggggtaacgtaaggggtacgggtaacgggtaacgtacggtaaacggtaccgtttaaacggtaaaccgtttaaacccgttaacgggtttaccgttttaaaccgacgttaaacccgggtaaaccggaaacgttaacccggaacggggttaacggtaaaccgggttttaccgggtaaacccgtttaacgggggaaacccgggggtttaacgggggggaaccttttaaaccgggggggttaaaccccgggggtaaccgggggtaaacccggggttttacccgggtaaacccgggggttttaccggtaaaccccgggttttaaccccggggtaaaccgggtttaccccgtaaaaccccgggggttaacccccggttaaacggggttcccccggttaacccccccggggttaaccccggtttaccccgggttaaacccccgttacccggttttaccccccgggttttaacccccccgg

SEQ ID NO: 90283 - DNA, 887 bp, Homo sapiens
  misc_feature: GYAE6OF02INRAR.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgccacagtctctgacggtcccttacctagtgacgctacgaccacacgtcccgtaccgttcggtagtcgtaggtccgtccccgaggaaccaaccggcaggactcgaccgtgtcctgtaggatacgttcacgttacgaaccaaaagtactacttacgttggttacgtaccgacgtagaacggtaacgtccgacgggtacccaccgggtaccccgttggtaaccgttcggtacctacgttaccgaaggtcggtaaccggtacctaacgggttccggaaccgtaacccgttaccgggacccggggttaacctcccggttaagggaacgttacggtcctttaccgtccgtaccgttaccccgagtaccgttccggtacggacggggtaactcggggttaacccctaccttacggtttaacgtaaccgttcgggtaaccgggtaccggggttacccgggaccgggttacggggtacgtaaccgtacgtaaagggtaccctacggttaccttaaaccgtttacggtttaaccgttaaccggtaccgtacccggtaaacggtccggtaacgggtttacggttacggtttacggtaacgttacgggtaccggggttaaggggttaaccggttcggggaaaccgggtacgttaacgttaccgggttacccggtaccgtttcggtaacccgttaccggaccggtccggaaccgttcccggtaccccgttacccgggtctttcccggtaccgttccccggttcccccgg

SEQ ID NO: 90284 - DNA, 725 bp, Homo sapiens
  misc_feature: GYAE6OF02IPPTP.21.8.A08.1.454.CMB.1.raw
  modified_base (122)..(122): a, c, t, g, unknown or other
  misc_feature (122)..(122): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (305)..(305): a, c, t, g, unknown or other
  misc_feature (305)..(305): n is a, c, g, or t
tcagtcgtcgctcgcacgaccggtgctcgatttagcatactctacagggggtgggctcaggaggcagagctctgggaatctcaccatggcctggaccctctcctgctcccctctcactttcngcacagtctctgagcctctatgagctgacacacgccacctcggtgtcagtcgtcccaggacaacggcaggatcactgctgngganattcattgacctaaaaagatactacttggttcgtccagacaaggacgtcgaggaccacggcccctagtacgtggtcatcagtgacggccagcgacacncgtcggactccgagacgagtcttctacgtcgcctacgcgtcacgaggtacacggtcgacctacgtagactagtcgacggtcggggccgtaagggtacggaacgtaggtacggtaaacgtcgtacgtaaccgttaacgttacgtttacggttaaaccgaccgtaaaccggtaacgtaaccggtaagggttacgggttacgtaaccggtacggttaaccgggtaacggggggttacgttaccggggaaccggggtaaacgggtaacccgtaacgggtttacccggtaacccgggtttccggtttacgggttaacccggaccggtaaaccccgggtaacgggttaacccgttccccgggcccccgttaaccggggtacccttaacccggttccgtttaccccggttacccccggttcccccgg

SEQ ID NO: 90285 - DNA, 640 bp, Homo sapiens
  misc_feature: GYAE6OF02FO8OC.21.8.A08.1.454.CMB.1.raw
  modified_base (105)..(105): a, c, t, g, unknown or other
  misc_feature (105)..(105): n is a, c, g, or t
  modified_base (179)..(179): a, c, t, g, unknown or other
  misc_feature (179)..(179): n is a, c, g, or t
tcagtcgtcgctcgcacgaccggtgctcgatttagcatactctacgagggggctgtgggctcaggaggcagagctctgggaatctcaccatggcctggacccctntcctgctccccctctcactttctagcacagtctctgacgcctcctagtgagctgacacagccctaccctcggtntcacgtcgtccccaggacaaacggccaggactccgacctgcctcgtgggactattcgaattcggaccaaaaagtattatacttggttcggtccagtcgagtaacgtcaggccacggtcccctaggtacctggtacagtccatgacggacctaggtccgacgacacgtccggatcccgtaggagtacgtacttctacgtcgtccctcgagtccctacgacggacgtacggtcggtcctacgttcgaacttacgtacgaacggtcggggaccctagggtcggaaccgtagtaggaacgtcgtacgtaaccgttaacgtacgtttacgtacgcgtaaccgaagacgtagtacggtggtaccagtcgggtagggttactcgggaggtacgacgtaggttccgaccgttcgtaggtaccacggtccctacggtccgtccgcccgttacgtcctaccgtcgtccccg

SEQ ID NO: 90286 - DNA, 730 bp, Homo sapiens
  misc_feature: GYAE6OF02JACJU.21.8.A08.1.454.CMB.1.raw
  modified_base (153)..(153): a, c, t, g, unknown or other
  misc_feature (153)..(153): n is a, c, g, or t
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgaggcctcctangagctgacacagcccaccctggtgtcagtctccccaggaacaaacggccaaggctcactgctctggatattcattcgacaaaagatatacttgtgtcagcagaagtcagccacgccctgtacgtggtcatccatggacggaccgagtccgaacgacaccgtcccgggacttcccgaggaacgagtacttcgtccgtcgtaccctccgacgtccgtacggacgggaccgtacgttccgggacccctaaccgttttcggaaccttacggttaccggtacggggtccgggggaaccccgtagggggtaccgggtaacgtaacgtaacgggtaacggttaccgtaacggtaccgttaaccgtttagtttaccggttaaccgaccctaaccggtaacgtacgttaagtaacggttcggtaaacctacgggtacggggttaaggggttacggttaccgggacggggttaacggaacccgttaaggttccggacccggttttccggtacggtaccgtaaccggacccgtaagggtccctcccggtacccccggttaccggccgttaccgtcccggtttaccccg

SEQ ID NO: 90287 - DNA, 828 bp, Homo sapiens
  misc_feature: GYAE6OF02JXRZD.21.8.A08.1.454.CMB.1.raw
  modified_base (420)..(420): a, c, t, g, unknown or other
  misc_feature (420)..(420): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgaggcctcctatgagctgacacgagcccacccgtcggtgtcagtcgtccccgaggaccaaaccgggccgaaggactccacctgcgtcgtggacgtattcatgaaccaaaagtaatattacgttgttcggttcagcaaggtacgtcgacggaccacggtccccttagtaccgtggtaccacgtaccgtagtacggaccggccgacggtaccggaccgacccgtaccggtacccggggaccttcccggtaggaggtaacgtacttccgtccgtcgtacccnccgtaacggtacgtcggaacgggtccgtacgggtccggtaccctaaccggtttctaaccgtcgttaccggtacggggtccggggtaccccggtaagggtccggggtaacgtacgtaacgggtaacggtacgtaccgttaacgttaccgtttaagttaccgttaaccgaaccgtaaccgtaacgggtacgtaacgggttaaggttacgtacggtaacggtacgggttaacgggggtttacgggtaccggggtaacggggttaacggtaccgggttaccgggttaacgggtacccgggtttccgggttaccgggttacggtacccggttaaccccggtaagggttccccggttaccccgggtacccccggttccggtaaccccgttccgggttaccccgtttcccccggg

SEQ ID NO: 90288 - DNA, 660 bp, Homo sapiens
  misc_feature: GYAE6OF02F9EQF.21.8.A08.1.454.CMB.1.raw
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcactagtctctgaggccttcctatgagcttgaacacacgcccaccctcggtgtcaggtcgtcccccgaggaaccaaacggccaggactcacctgctcgtggagtattacattgaccaaaagaatatacttgttgtcagcagagtcacggccacggccctgtacctggtcactccagngacggccagcgacgacacgtccggntcccgtgagacgtattccgtcncggtcctaccaattccggaagggtccggttacggccgttacggttacgacgtttcctacggacggttcggggacccgtaggggacgggtacggtagtaggaacgtcagtacctacgttacttagttacctcgacgacgagaccgtaggttagtaggtacacggttacgggaaggggtttacgttaccgggcgggtaacgggtaccgtaacggttcggaacccgttcggttacggttccaaccgggtaccgtacggtccgttacccggtcccccgtacggtacctaccggttccctccggttcccccg

SEQ ID NO: 90289 - DNA, 702 bp, Homo sapiens
  misc_feature: GYAE6OF02FZKJD.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatcacctgctcgtggatattcattcgaaccaaaagatatacgtttgttacggtccagcagaagtcaggccaggcccctggtactggtacactccagtggacgccagtccgacgaccaccgtccgggactccgtagagtacgtatttcctcgtccgtccctaccgagtccgtacgaagggaacctggtaccggaccccttaacgtttcgaacgttacgtaccggtacggggtaccgggggaccccgtaagggttaccggggaaaccgtagtacgggtaaaccgtccgttaaggtaaccctttaaacgttcgttttaaccggttaccgacctaaaccgtaggaaccgtaggttacggttcgtaacgtacggtacgggtacgggggtttatccggggagggtaccggtaactacgggttacgtaacccggttcggttaaccggctaaccggaccgtacgtccgtccgtaccccggttggtccctacgttcccgttacccg

SEQ ID NO: 90290 - DNA, 955 bp, Homo sapiens
  misc_feature: GYAE6OF02G6BT7.21.8.A08.1.454.CMB.1.raw
  modified_base (162)..(162): a, c, t, g, unknown or other
  misc_feature (162)..(162): n is a, c, g, or t
tcagtcgtcgctcgcacgaccggtgctcgatttagcatactctacagggggctgtgggctcaggaggcagagctctgggaatctcaccatggcctggaccccttctcctgccctccccctctctactttctgcactagtctcgtgacggtccctctatgacnctgacacacgccctacccgtggtctacgtacggttccgtaccccgaagggaaccaaacccgggccaagggtactcccgtaccttggtccttacggtagggtaacttactttaccgtaacgttaccggaaaccgtaaaaaaggtactttaagttttaaccggtttttggtttaccggtttacccgtaggtaacgaaacgggtaaacggttaccggaacgggaaccccgtaccgggtcccccgttaggttaccggtacggtaccacgttaccgacgtcgggaaccggtaccgaaccggtccggtaaccgaacccgtaccggtacccggggtaacttccccggtaggaacggtaacgttaccttccgttccgtccgtacccgtaccgaacggtcccgttaacggaccgggaacgtacggtccggtaccctacgtacgtaactacgtacggtacgggttaccgggggacccgtaacggggtacggaaccggtaggtaaccggtaacggtcggtaaccgttaacgttaacgtttacggtttaaccgtaccggtaccgaacgaacgggttactaagggtttaccgtaggtaccgtaacgggttacggggttaacgggggtttacggtaccggggaaaccggggttaccgggtaaccggttacgggttaccggttacccggttcccggggtttaccggttacccggaaccgggtaaccccgttaaccggggtaccccgttacccgggtccccccggttaccgggtttaacccttccccgggtttacccgttaccccccgg

SEQ ID NO: 90291 - DNA, 1119 bp, Homo sapiens
  misc_feature: GYAE6OF02HK8JG.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctctctactttctgcacagtcctcgtaggacggtcccttcctagtggacgtcgtagaccacgacgcccctacccgtcgggtctccacggttccgtacccccgaagggaacccgaaaaccgggcccgaagggtaacctcccgtaacccgttcggccctttaccgggtaggggtaaccttaacgtttacctaacgtttaaccggaaaaccctaaaaaaaggttaactttaacggttttaacggttttggtttaccggttaccccgaaggtaacgtaacggtaacggttacgaccgggtacccgtacggtcccccgttaggtaacgttaccgggttacctacgttccgtaacggtacggaaccgggtacctacggtaccggaacccgttaaccggtacccggtacccggggtaaccttacccggtaaggggtaaccgtacggttacctttcccgttcccgttaccggtaacccccgttaccggtacgggtacccgtaacggggaaacgggggttccgtaacgggggttaccccgtaccccggttaaccgtttacggtaaacctttacgggtaccgggttacggggggttacccgggaaccccgggttagggggttaaacccggtaacgggttaacggtaaccggggtaacggtaaccgtttacgggttaaaccctttacgggtttaaccggtttaccggttaaaccccggaaaccgttaacccgggtaaacggtaaaccgggtttaacgggttaacccggttaccgggtaacgtttaacccggggtacggggggtttaaaccgggggttacccggggttaaccgggtaacgggggttaaacccggggtaacgtttacccggggttaccgggtttacccccgggttaacggtttcccgggtaaacccgtacccgggtacccggtaacccgggtttcccggtacccccgggttaccccccgtttagggtaacccccgttaccggttttcccccggttaccccccggg

SEQ ID NO: 90292 - DNA, 702 bp, Homo sapiens
  misc_feature: GYAE6OF02GM45Q.21.8.A08.1.454.CMB.1.raw
  modified_base (178)..(178): a, c, t, g, unknown or other
  misc_feature (178)..(178): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctcctatgagctgacacacgcccaccctcggtntcagtcgtccccaggacaacggcaggatcacctgctcgtgganattcattgaccaaaanatatacttgttgttccagtcagaagtcaggaccacggcccctgtctggtcatccatcgacggccagtcgacgacctacgtccgggactccgagacgagtacttcctctcgcccttcacgtcacgaacgggacacggtcggaccctaccgttcgaactatacggacggtccgggtcccggtagggtacgggacggtcgtacggtaaagccgtacgtaccgtttaacgttggtttacgttaccgacctaccgtaagtactaagggttacgttcggttacgaacggttcggggtaacggggggtttcgttaccggggacggggtaaccggggttaaccgtaacgggttttaccggtaccccgggtttaccgttacgggttaccggaaccgggtacccccggtaagggttcccttaccccggggtccccccgttacggtccccgttacccgttcccggtttacccccgg

SEQ ID NO: 90293 - DNA, 716 bp, Homo sapiens
  misc_feature: GYAE6OF02ISGXM.21.8.A08.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctcggacccctctcctgcctccccctctctactttctgcacagtctctgacggcctcctatgagctgacacncgccaccctgggtntcagtcgtccccaggacaacggccaggactcacctgctcgtaggatattcattcgaaccaaaaagattaatacttgttacgttaccagacgaagaagtcgacggccacggcccctgtacgtcggtcaacgtccaagtcggacggacccgtaggtaccgaacgacctaaccgtccgggactccgtaggaacgagtacttcgtacgtcgacccttccgaagtcccgaggaacgggtaacagggttaccgaccctaacgttcgaacttaacgtaccggtagggtaccgggaccggtagggtacggtacgtaagtaacggtacgtaccgttacgtaaccgtttaacttaacgttcggttaaccgacgtaaccgaagtaaccggtaaggttaccgggtagtaacgtacggtaacggttaaggggggttacgtcgggaaccgggtaacggtaaccgtaagttcggtaccggttacgtccggtacgtaacgacccgtaagcccgtacccggtcccctacgggtaccttaccgtcccgttacccg

SEQ ID NO: 90294 - DNA, 790 bp, Homo sapiens
  misc_feature: GYAE6OF02IO7G0.21.8.A08.1.454.CMB.1.raw
tcagtcgtcgctcgcacgaccggtgctcgatttagcatactctacagggggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggaggcagtggtccagccgtgggacgtccctgacgcctcctccgtgtgcagcgtcgtggtattcagttagtcggtcttccgtttgcccagttcggcctacgttcggggtcccgaccgagggcctaccgacgggtccgaaaggggggtcctggggacggttgggggtcggacgtatttagtccgtgggtactaggagttgggaaagtggaagagtaagttagttacttcgaacgtccgttaccggtaggaaccgggtaccgtattacccgacctaacgtacctaccgaaggtaacgaacctaagtcgaacccgaaacgtaaaccgaaacctacgttacgttaactacctttaaacgtaaaacggttaccggtaccccgggtaccttaacggaacggtaaccgggaaacccgggtaaacgggtaacccaaccggggttacttaacggttaacggtttaaccgtttaaccggttaacggttaacccggtaacggtttcccggtttttaagggacccggttttaagggtttaccgggggaaccccggttaaccgggggttaacccccgttacggggttaacccccgg

SEQ ID NO: 90295 - DNA, 757 bp, Homo sapiens
  misc_feature: GYAE6OF02IUCJB.21.8.A08.1.454.CMB.1.raw
  modified_base (130)..(130): a, c, t, g, unknown or other
  misc_feature (130)..(130): n is a, c, g, or t
  modified_base (181)..(181): a, c, t, g, unknown or other
  misc_feature (181)..(181): n is a, c, g, or t
  modified_base (681)..(681): a, c, t, g, unknown or other
  misc_feature (681)..(681): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttcngcacagtctctgacggcctctatcgagtcctacacacgcccaccgtcggtntcgagtccgtacccgaggaaccgaaccggcgaaggactacctaccgtgtacctcggtaggtaacgtacttacgtagtacggaaacctaaaaagtattaacgttacgtttcggtttacggtaccaagacgtaaaggaacgtccgacggacccgaaccggtcccttaggtacgtcggtacactccgtaagtcgacgaccaggtacgacgacgtaccgtcgactcctaggacgtatacttccgatcggccctagacgtcgtacgagggaactcggtacctaccgtaacgttagtactaacggtcgggaacgggtcccggggactaacggggtacgaacgtaggtaacggaacgttcgtaacgtaacttaacggtttaacgtacggttaaaccgccgtaaaccgaaggtaacggttagttcggtagtaaccgtaggtaccgggtagggttcggacggggtaaacggacgggttaaaccgtacggttcggaaccggttttaccgngggaacccgtacaacccggtccggtacgaccccgttcccggtagtacccggtacttccccggtacccgttaccccg

SEQ ID NO: 90296 - DNA, 716 bp, Homo sapiens
  misc_feature: GYAE6OF02GF4LT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctctggagattcattgaccaaaagaatatacttgttggttccagcagaagtcaggccgacggcccctgtactggtcatccagtgaggccagtcgacgacacgtccgggactcccgtgagagtacttcgtctcgcctccgacgctacggaagggacgagtcggccctaccgttacgacctagtacgtacgggtcggggaccccgagggttacggaacgtagtacggaacggtcctaggtaaccttaacgttagtttacggttaaccgcccgtaacccgaacggtaccgtaaaggttacggttcggtaccgtaacggttaccgggtaagggggggtttaacgttaccgggggacggggtaaccggggaaacccgtttacgggtttaccgggtaacccggttcccggtttacggggttacccgtaaccgggtaccccgtaaggtccccgtaccccgggttaccccccggttaccgggttacccgttaccgtttcccgtttaccccccgg

SEQ ID NO: 90297 - DNA, 618 bp, Homo sapiens
  misc_feature: GYAE6OF02F61BE.21.8.A08.1.454.CMB.1.raw
  modified_base (222)..(222): a, c, t, g, unknown or other
  misc_feature (222)..(222): n is a, c, g, or t
  modified_base (476)..(476): a, c, t, g, unknown or other
  misc_feature (476)..(476): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccacccgtggtgtcagtcgtccccaggacaaacggccaaggactcacctgctcgtgganattcattgaccaaaagactatacttgtgttccagcagagtcagccagccctgactgtcatcgatcgacggccaggtccgacggacaccgtccgggatccccgtggaacgagtactttaccgtcgtacgcccttaccgagtcctacgacggggtacacggttcggcccgtaaccgtttcggaacttacgtcgtacgggtacgggtacccgagggtacggaacgtagtacgaagctacgacttactagttagtacncgacagtacgtagtacgtgtcgagtcgtacggggttatcgggacggtacgggacctaggtacgtaccggttccgttaggtaccgaccgccgtaacggtccgtaccggttaccccgtcggtaccctacgttccgttaccccgg

SEQ ID NO: 90298 - DNA, 620 bp, Homo sapiens
  misc_feature: GYAE6OF02IJCNA.21.8.A08.1.454.CMB.1.raw
  modified_base (223)..(223): a, c, t, g, unknown or other
  misc_feature (223)..(223): n is a, c, g, or t
  modified_base (336)..(336): a, c, t, g, unknown or other
  misc_feature (336)..(336): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctcgtgganattcattgaccaaaagatatacttgttgttccagcagaagtcaggccacggcccctgtactggtcactccagtcggacgccaggtccgacgtacaccgtaccgggattccccnggaagacgtacttctaccgtcgtcctccacggctcgaagggacaggtcgccacgttgacttactcgaacgggtcgggacccgagggtgacggtatcggaagtcgtagaccttagttacgtttacgttacgcctaaccgaagtacaggtacggttgacgtacgtagggtacgggggttacttcggggacggtacggaaccgtagttccggaccgttcgtaccggtacgaccggtacccgaacggtccgtcccggtcccccgtcgggtactccgtacgttccccgg

SEQ ID NO: 90299 - DNA, 774 bp, Homo sapiens
  misc_feature: GYAE6OF02JVSSZ.21.8.A08.1.454.CMB.1.raw
  modified_base (163)..(163): a, c, t, g, unknown or other
  misc_feature (163)..(163): n is a, c, g, or t
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
  modified_base (526)..(526): a, c, t, g, unknown or other
  misc_feature (526)..(526): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttcctgcacagtctctgaggcctcctatgagctagaaacngccaccctggtgtcagtcgtccccaggaccaaacggcaggatccacctnctctagggatacttcagttcgaccaaaaagtntacgttacttggttacggtccagtccaaggtaacgttccgaagggccccgtacggacccccgtttggtaaccgttcgggtactacgtccctaaggtcgaacggtccctaggtccggaaccgacctaccggtacccgggaacttccccggtaaggaggtacctaatttccgtactccggtaccctaccgagcctttacgggaacggggaccttaaggtccggtacccttaacggttcggtaacttacgcgtacgggtacggggccctagggtcggacgtaagnggaacgtccgtacgacttaacgttacgtttcgggtaccaccgaacgtactaacgtagttcgtacggtaccgtacgtagggtaacggggtttctaaccggggacggtaaccggaacgttacgttaccgggtaacccttccgggtttaacggtacccgtaacgggaccccgttaagggtcccgttacccgggtacccccggtttaccggtcccgtttaacccgttaccgttaccccggtttaaccccccg

SEQ ID NO: 90300 - DNA, 639 bp, Homo sapiens
  misc_feature: GYAE6OF02HB9O1.21.8.A08.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
tcagtcgtcgctcgcacgaccggtgctcgatttagcatactctacaggggctgtgggctcaggaggcagagctctgggaatctcaccatggcctggacccctctcctgctccccctcctccactttctgcactcgtctctcggagccctcctatcgagctgacacagccctacccgtcggtgtacagtcgtcccaggacaaacggccaaggactcactcgctcgtggantacgattcgacaaaagatatacttgttgtcagcagatcaggcaggtcccngtactggtcactcagtcgagcctagtcaacggacacgttaccggatcccgtgacgancttacnctacgcnccgtacgacctcgagggtaaccaggttacgaccctaaccgttagtacctaagtccgaaggttcgggacccgtaacgggtacggtaacgtacgtaacggtaacgccgtagtactaacgtacgtttacggttacactaacgaacgaacgtacgtagtcgactatcgtaggggttaacgttcggacgggtaacggaccgtaacgggttactcccgggttacgttacggtacctacggtaccgtaaccggtcgttaccgtacccctaccggggtactaccgttaccgttcccgg

SEQ ID NO: 90301 - DNA, 885 bp, Homo sapiens
  misc_feature: GYAE6OF02IONPP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggacaaacggccaggactcacctgctcgtggagtacttcattacgaaccaaaaagtaattacttaccgtttggtttacggtttacccaaggaccaaggtaaacggttccgaacgggtaccccgaacgggtccccccttaggttaaccgtcgggttacctacgttaccccgaagttacgggtaaccgggcccgtaaacggttacccggaacccggtaaacccgtacccggttaccccggggggtaactttcccccggtaggaacggtaacggttactttcccgtaccttcggtccccttacccgaggtcccgttacggaacggggaactacgggttccggacccttacccgttacgacctttaacgtacggtacgggtacccgggggacccgtaaggggtaccgggaaaccgtaggtacggaaacggtcgttacggtaaccttaacggtttacgtttacggttaaaccgaccgtaaccgaacggtaacgtaagggttaaggttccgggtaactacggttacgggtaacggggggtttaacgttacggggaccggggttaacgggtaaccgtagggtttaaccgggtcccggtttaccgtttaccggggtaccgtaaccgggtaccccggtaacgggtcccgttaccccgggtccccccgttacgggacccttacccggttaccgtttcccccggg

SEQ ID NO: 90302 - DNA, 713 bp, Homo sapiens
  misc_feature: GYAE6OF02HIFGV.21.8.A08.1.454.CMB.1.raw
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctgctctggacgattcattgaccaaaaagatatacttgtgttccancagaagtnaggcaggccctgtactggtcatcatgaggccagtcgacgacacgtccgggatccccgtagacgagtcttactcttcgcctaccgagtccgtacgaaggggtaccaggtcgggaccctaacccgttagaacctaagttaccgtaaggttaccggggggaccccgtaaggggttacgggaaaccggtaaggttaggaaaccgggtacgtacggtaaaccgttaaccgtttaagttacggtttaaccggacctaaccgaacgggtaaactaacggttagtacgggttacgaacgttacgggtaacggggggttacttacccggggacgggtaacggggtaacccgtaaagggtttccggtaaccccggtttccgttacgggtacccggtaacgtaaccccgaaggtcccgtaccggtaccccccgtcggttaccgtaccgtccgttacccgg

SEQ ID NO: 90303 - DNA, 822 bp, Homo sapiens
  misc_feature: GYAE6OF02IDVOA.21.8.A08.1.454.CMB.1.raw
  modified_base (126)..(126): a, c, t, g, unknown or other
  misc_feature (126)..(126): n is a, c, g, or t
tcagtcgtcgctcgcacgaccggtgctcgatttagcatactctacagggggtgggctcaggaggcagagctctgggaatctcaccatcggcctggacccctctcctgctccccctcctcactttcngcacagtctctgaggcctcctatgacgctgacacacgcccacccgttcggtgtcagtcgtaccccaggaaccgaaacggccaaggactccacctgctctagggatacgttcaagtttacggaaccctaaaaaagtaattaacttaccgttttaggtttacgggttaacccaaggtacctaaggtaaaacggttccgaacgggtacccgaaccgggtacccccttaggttactcgggttaccaacgttccgagttcggaacggcctaacggtccggaaacgtaccgaccggtaccggggtacttccccgtaggaacgtaacgtcttttccgtacgtaccgtccccgttacgaacgccgttacgaacgggtaacaacggtccgaccctaacgtttcgtaaactacgtaccgaggggtaccggggacccgtacggggttaacggaacggtacgtaacggtaacgtacgtaggtaacctttaacgttaacgtttacgtttaaccgactaacccgaaagttaaccgaaggttaacgttacggtacgtagtacgggtaacgggggttacttccggggaacggtaaggaaccttaaggttccggtacgttaccgtttaggccgtaaccgtaccggaacggtccgtaccggtacccgttccggttacccgtaaccgtttccggttcccgttccccgttaccccg

SEQ ID NO: 90304 - DNA, 627 bp, Homo sapiens
  misc_feature: GYAE6OF02GCM48.21.8.A08.1.454.CMB.1.raw
  modified_base (174)..(174): a, c, t, g, unknown or other
  misc_feature (174)..(174): n is a, c, g, or t
  modified_base (266)..(266): a, c, t, g, unknown or other
  misc_feature (266)..(266): n is a, c, g, or t
  modified_base (547)..(547): a, c, t, g, unknown or other
  misc_feature (547)..(547): n is a, c, g, or t
tcagtcgtcgctcgcacgaccggtgctcgatttagcatactctacaggggggggagaggagcccagcactagaagtcggcggtgtttccattcggtgaatcagcactgaacacagaggactcaccatggaagtttgggctggagcttgggttttccctccttgctcttttaagnggtgtccagtgtcaggcgcaactgggtggagtcgtggggggagctagtcggtccagccgtgggacgtccctgacgtccctctccgtgtcgcngccgttctggtacttcgagtacgtcggtccttccttcgcctatcggacctacggtcgggtccgccgaggtcctccggaggcgacggggctaggggagtggggtgacgtagttacgtcgtggtatcggagtaggagtgacgagtattacttagtcgagtaccgtcggtaaggacggcctatcacctctcgaccgagacgacacgtcgaaccaaacacactatacgtactactaacgaagtaccggaccgtccgtagacgtacggccgaacgtaccgtacgtnttacgtggttaactcggtagtaccgtacgttcggttacgtacgtacgggttccgggacccgtacggtaccgttgtaaccg

SEQ ID NO: 90305 - DNA, 928 bp, Homo sapiens
  misc_feature: GYAE6OF02GUXSY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccacccgtcggtgtcgagttcgtacccccgaggaaccgaaaccggccaaggactccacccgtggcctcgtggaagtacttactattacgaaccaaaaagtaattacttaccgtttggttcggttaccgagacgtaagtaacggtcgtaacggcccgaaccgggtcccccgttaggttaaccgttcgggtacctaacgttacctaagttacgggaaccggtacccgtaacgggtacccgggaacccggtaaccgtaacccggttccccggggtaaccttcccccggtagggacggtaacggtacttttcccgtcgttaccggtcccctaccggtaccgtcgtaccggaacgggaaccgtaggttcccgggacccttaacccggtttcgggtaaaccctttaaggtacccgggtaacggggtacccgggggtaccccgggtaaggggttaaccgggaaggtaaccggtacgggtaaacggtccgttaacggttaacccgttaaacgtttacgttttacgggttaccctaaccgaaacccgtaacggtaacgtaagggtttacgggttaccggtaccgttaaacgggttcggggggtaacgggggtttaaccggttaccgggggaaccggggaaccgggttaaccgttacgggttacccggtacccgggttttcccggtacgggttacccggtaaccgacccggtacggtccgtaccccggttcccccgttaccgggttccttacccgtttccgttaaccccccg

SEQ ID NO: 90306 - DNA, 801 bp, Homo sapiens
  misc_feature: GYAE6OF02HKZWW.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccacccgtggtntcagtcgtcccgaggacaaacggccaggatcactgctctggatattcagttgaaccaaaagtaatattacgttgttcggttaccagcagaagtcgaggccacggtcccctgtactcggtacatccagtcggaggccagtaccgacgactacgtccgggactcccgtaggaagtacgtactttcctacgtccgtccctaccgaacgtccgtacggaacggggtaccgtaacgggttccgggacccctaacccggtttaggtaaccctttacggtaccggtaccgggggttaccgggggacccccggtaagggggttaccgggaaacggtaagtacgggtaaacggtcgttaccggtaactttaacggtttaacgtttaccggtttaaccgaccctaaaccggtaacggtacgttaacgggttaacgggttcggtaccgtaagggttaccgggttaaggggggtttaacggttcccggggtaacggggaacgggttaacccggtaagggtttacccggttaacccgggtttcccgtttacgggtacgaaccggtacccggtaacgggtcccgttcccggtaccccccgttcggtttacccctcccggttaccgtttaccccccgg

SEQ ID NO: 90307 - DNA, 604 bp, Homo sapiens
  misc_feature: GYAE6OF02GF4M2.21.8.A08.1.454.CMB.1.raw
  modified_base (219)..(219): a, c, t, g, unknown or other
  misc_feature (219)..(219): n is a, c, g, or t
  modified_base (334)..(334): a, c, t, g, unknown or other
  misc_feature (334)..(334): n is a, c, g, or t
  modified_base (427)..(427): a, c, t, g, unknown or other
  misc_feature (427)..(427): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacaccagcccacctcggtgtcagtcgtcccaggacaacggcaggatcacctgctctggganattcattgaccaaaagatatacttgttggttccagcagaagtcacgccacgccctgtactggtcatccagtgacggcagtcgacgacacgtcgggatcctagagagtacttcctntcgccttacgacgtctacgaagggaccaggtcgacctacgttgactagtacgacgggtcgggcccgtaggtagacgtatacggaagtccgtanaaccttacgttattagtaccgacgacctagacgtaggtaggtcggtacgtagtacggtaaggggttagtcgggtacggaacgggaccgtacggttaggtaccggttcggttacggtccgacgacccggtaacgccgttccgggtacccccttcggtccctaccgtcccgttacccgg

SEQ ID NO: 90308 - DNA, 803 bp, Homo sapiens
  misc_feature: GYAE6OF02JS35V.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctctcactttctgcacagtctctgaggcctctatgacgctagacacacgtccctacccgtcggtagtcaggtcgtccccgaggaaccgaaacggccaaggtactccaccgtgccttcgtcggatattccagttacgaccaaaaagtatacgttaccgttggtttacggttccaggctaacgtacgtcgacggtaccacggtcccctaggtaccgtggtacacgtcagtcggacgtccgaggtcgaacgactcggtaccggactccgtaggacgaacgtactttaccgtcgtccgtaccgtactacggtccctacggtaacgggaactcggacgttaccgacccgtttggaacctcgtacgacggggtacgggtaccgtacggacgggtacgaacgttacgggaactctaccggtacttaacgtttaaccgtttacggtaccgacccgtaaaccggtacgtaacgttaagggtccggttaacggaccgtttaacgggacccgggtttaaggggggttaccgttacccggggggaaccgtaacggggttaacccgtagttttcccgggtaacccgggtttcgtttaacggggaaccctaccgggtaaacccccggttagggtcccccgggttaccccgtacccccgggtttaggttaaccccgttcccgtttacccggtttacccccggg

SEQ ID NO: 90309 - DNA, 658 bp, Homo sapiens
  misc_feature: GYAE6OF02JIQ5J.21.8.A08.1.454.CMB.1.raw
  modified_base (165)..(165): a, c, t, g, unknown or other
  misc_feature (165)..(165): n is a, c, g, or t
  modified_base (178)..(178): a, c, t, g, unknown or other
  misc_feature (178)..(178): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacatctctgagcctactatgaagctgacacgcgccnccgtcggtgtacngtcgtccccgagacaacggcaggatccgactgctcgngaagtnttacattgaaccaaaagtaacttacttacgttagttgttcagcagtaagtcggaaccgggcccctaggtaccctgtacctcgtccatcgagtcgacggccacgacgacgaccgactccgagtccgtagagtacgtacttcgctcgccgtcgtacgacggtacgacggtacgacgtcgtactacgttacgacgtacgtacggacggtacgggcgtacgggtacgtaacgtagtacgtaacgtacgttacgttaacgttacgttaacgtacgtaaccgtacgtaaccgtaacgtacgtacggtacgtacggtacgtacgggttacggtacgggtacgtacgggaccgtaaggtacgtaacggttacggtaacggttaccgttacggtacccgtaacggtccgtacggtcccgttaccggtacctcggtaccgtcgtccg

SEQ ID NO: 90310 - DNA, 646 bp, Homo sapiens
  misc_feature: GYAE6OF02G6JZ2.21.8.A08.1.454.CMB.1.raw
  modified_base (223)..(223): a, c, t, g, unknown or other
  misc_feature (223)..(223): n is a, c, g, or t
  modified_base (604)..(604): a, c, t, g, unknown or other
  misc_feature (604)..(604): n is a, c, g, or t
tcagtcgtcgctcgcacgaccggtgctcgatttagcatactctacggggggctgtgggctcaggaggcagagctctgggaatctcaccatggcctggacccctctcctgccttccccctcctcactttctgcacagtctctgaggcctcctatgagctgacacagccaccctcggtgtcagtcgtccccaggaccaaacggccaggatcacctgctcgtgganattcattcgaccaaaagtattatacttggttcggttccagcagaagtcaggccacggcccctgtactggtcatccatgagccagtcgacgacacgtccgggactccgtgagtagtacttccgtctcgccctaccaggtcctacgagggactaggtcggccctaccgttcgaacctagtccgacgggtcggggcccgtaagggtacggaacgtagtacggaacgtcgtacgtaaccgttacgttaacgtttacgttaccgacctaaccgagtaccgtaaggttacgtggtacctaagttcgggaggggttacgttcgggacgggtacggtaccgtaggttccgtaccggttcgttcggtaccaccggtacccgaacggtccncccggtccccggttcggtacctccgttccgtccgttaccccc

SEQ ID NO: 90311 - DNA, 677 bp, Homo sapiens
  misc_feature: GYAE6OF02J1RSE.21.8.A08.1.454.CMB.1.raw
  modified_base (337)..(337): a, c, t, g, unknown or other
  misc_feature (337)..(337): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagtccaccctggtcgtcagtcgtaccccaggactaacggccaggatccaccgtgctctggagtattcattggaaccaaaagtattatacttttgttagttccaagccgagaacgtcgaaggccctggtacccctgtacgtgtaccactccatacgacgtcgagtaccgacgaaccnccgtacggactcccgtagacgacggtattccgtcgtcgtacctccgtacgtactcggaggacgagttccggccttaccggtgtaactcgttacgacggtccgggaccgtacgggttaggactagtcgtaagggccgtagtaaccgttacgttagttaccgttaccgacgtaccgtaaggcctaaggtacgtcggtactaggttaccggtaggggtacggtaccgggtaccgggtaaccgggtacccgttagtaccggttacccggttccgtttaccggcgtaaccgtcccggacgttacccgaccggtcccccggtggttacccacgttcccgtaccccg

SEQ ID NO: 90312 - DNA, 618 bp, Homo sapiens
  misc_feature: GYAE6OF02GVJLU.21.8.A08.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaaccggccaggatcacctgctctggagtattcattgaccaaaagatatacttgttcgttccagcaagagtcacggccacggcccctgtactggtcatccatggacggccaggtaccgacgaccaccgtccgggactcccgtagagagtntttccgtctcgcccctccagtcctacgacgggtacaggtcgccctacgttgaacttagtcgacggtcggggaccagggtgaacgagtagagctagaacttagttattcgtaccgcacagacgtagtagttcgtataggtacgggtaggggttacgtcgggacggaacgggtaccttagggttcggtacccggttcggttacggtaccgaccgacccggtaaggtcccgtacccggtccccgttaccggtcccgttaccgttccgttacccccgg

SEQ ID NO: 90313 - DNA, 994 bp, Homo sapiens
  misc_feature: GYAE6OF02HJDEW.21.8.A08.1.454.CMB.1.raw
  modified_base (163)..(163): a, c, t, g, unknown or other
  misc_feature (163)..(163): n is a, c, g, or t
  modified_base (177)..(177): a, c, t, g, unknown or other
  misc_feature (177)..(177): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctcactttctgcactagtctctgagcctctatgagctgacacngcccaccgtcggtntcgtagtcgtaccccgaggaaccgaaaccggccgaggactcaccgtgcctcgtcggatacttctacgttacggaacctaaaaagtaattaacgttaacgtttcggtttacgggttacccaaggaccgtaaacggtaacgttaccggaaccgggtaccccgtacccgggtacccccgttaagttaccgggttacgggtaccctaaccgttaccggtagttaccgggaaccgggacccgtaacgggtacccggaaccggtaaccgtacccgggttaaccccggggtacttaccccggtaacgggtacgtaacgtcgtttcctaccggttaccgtcccgtacgtacggtaccgttacggggaacgggtaccggaacgggttaccggaacccgttaacccgtttacgttaaaccgttacggtacccgggtaaacgggggtcccggggttaaaccgggtacgggggtaacggggttaaacggtacgtaacggttaaacgggtaccgtaaccggttaaaccgtttaaccgtttaagggttttaacccggtaactcccgggttaaaaacctccgggttaaaaccgggttcggtttaaaccggtggtaaacccggttaggtttacccgggggtaaaccgggggtttaacgggaccggggttaaaccggggtaaccggggttaaacccttacgggggttaccgttaccccggtttacccggtttaacggggaccgtaacccggggtaccccggtaaggttcccccgacccccggggttcccccgttaacgggtaccccgtttacccgtttccccggtaaccccccg

SEQ ID NO: 90314 - DNA, 618 bp, Homo sapiens
  misc_feature: GYAE6OF02JJRGL.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccacccgtcggtgtcagtcgtccccaggacaaacggccaggatccaccgtgctcgtggagattcattcgaccaaaagattatacttgttgtaccagcaagaagtcaggccaggcccctgtactggtcatccatgagccagtcgacgacgaccgtccgggactcccgtagagtagtattctcgtcgcctccagtcctcgaggacaggtcgaccctacttgacttatcgaggtcgggaccagggtacggacgagtgaagtcgtacgtaactacgttattacggtacgacaaccgagtaaccgagttgtacggtactaacgtcggtaagggggttacttcggggaccgggtaacggtaacctagggttaccgacccgttccggtaggtaccgaacgtaccgaacggttccgtcccgtaccccggttcggtacctaccgttccttaccggtcccccgtcccg

SEQ ID NO: 90315 - DNA, 711 bp, Homo sapiens
  misc_feature: GYAE6OF02HHAO6.21.8.A08.1.454.CMB.1.raw
  modified_base (172)..(172): a, c, t, g, unknown or other
  misc_feature (172)..(172): n is a, c, g, or t
tcagtcgtcgctcgcacgaccggtgctcgatttagcatactctacagggggggggagaggagcccagcactagaagtcggcggtgtttccattcggtgatcagcactgaacacagaggactcaccatggagtttgggctgagcttgggttttcctccttgcttcttttaagnggtgtccagtgtcaggcgcaacgtggtggagtcgtgggggagcagtcggtccagccgtggggacggtccctgacgcctctccgtgtgcagcgtctggattccagtactccggtccttccgtttgcctatcgctacgtgggtcccgccgaggcctccgaggcgaacggggctggggaggttggggtggacgttaatttacgtcgttaggtatagtaagttagggaagtggtaaacgtagtaaactttaagtttacttacgaaggtacccttaccgggtaggaaccggggtcctactttacccgaacctacgtccctaccgaagtaacgaactaaacgtccgaacccaaacaaccactaaccgttattaccttactaacgtaacgtacccgtaccggtaccgtaggaacggacgtacccgggaacgtaaccgtaccggtacttagttacgttaacgtttaaccgaggttaacgtacggtttccgttttaggaccgttagggttccgggaacccggtaccgggtacccgtggttaaccccgg

SEQ ID NO: 90316 - DNA, 777 bp, Homo sapiens
  misc_feature: GYAE6OF02FSKAQ.21.8.A08.1.454.CMB.1.raw
tcagtcgtcgctcgcacgaccggtgctcgatttagcatactctacagggggctgtgggctcaggaggcagagctctgggaatctcaccatggcctggaccctctcctgctcccctctcacttctgcacagtctctgaggcctcctatgagctgacacagccaccctcggtgtcagtcgtccccaggaccaaacggccaggactcacctgcctacgtggagtacttcattacgaaccaaaaagtaactattaccgttgttcggttaccagcgagtaagtcgacggtccgacgggtccccttggtaccgtggtacctactcccgtagtcggacggtcctacggtaccggaacgtaccaaccggttcccgggtaactcccggttaggaacgtagtacgtttcgtccgttacggccccttaccgaccgtacctacggaccgggtaacgtacgggttccggaccctaccggtttacgaacttacgtacggtaacgggtcccggggtaccgtacggggtacggaaccggttacgtagggtaacctcggttaacggtaaccttaccggtttaacgtttaccgttaacccggaccgtaaccggtaactacgggttaacggtacggttcgggtaacctacggttaccgggtaggggttaacggtttccgggaacgggtaccggtaccggtaacggttccgtacccgggttcgtaggttaccggaccgtaccggacggttcccgtacccggtccccggttacggtaccttacccggttcttccccgg

SEQ ID NO: 90317 - DNA, 663 bp, Homo sapiens
  misc_feature: GYAE6OF02GE5ZT.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccacccgtcggtgtcagtcgtccccaggacaaacggccaggatcacctgctctggagacttcattcgaccaaaagaatatacgttgttgtccagcagaagtcagccaggcccctgtactggtcatccatgaggccagtcgacgacaccgtccgggactccctgacgtagattctctcgccctcagctcgaggacgagtcgacctacgttgactagtcacgggtcgggcccgagggtcgggacgtagtacggaacgtcgtacgtaacttaacgttagtttacggttaaccgaccgtaacccgtacgtaaacggtaggttacggttacggttacgtacgtaacggggtaacggggggttaagttcccgggggtaacggggacccgggtaaacgtaacgggttcggtaacccggtttcccgggttacggtaccgtaacggccccgaacgggtcccgtcccggttcccccgttaccggtcccgtaaccgttccgttacccccgg

SEQ ID NO: 90318 - DNA, 823 bp, Homo sapiens
  misc_feature: GYAE6OF02JA4CJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctctactttctgcacagttctctggacggtcctccttatcgacgtctagaccacagccctacccgtcgggtacgtacgacggttcgtacccccgaagggtaccaaaccgggccaaggtactccgaacctgaccgttcgtgggatacttccgacttcggaacctaaaagtattacttacgtttggttcgtaccgagaccaaggtaagtcgacggaccgtcggtaccccgtgtaaccgtggtacctacgtaccgtacgtcgaacggtccgtacgtaccggtaaccgtaccgtacccggttaccgggacttacccggacggaacgtaaccgtcctttcgtacctacggtacccgtaccttaaggccgtaacgtacggtaccgtacgttcggaccctaacggtttcaaacggttctaaccgggtcgggtccgggttaacggaccgggtacgggttaaccgtacggtaacggtacggttacgggtaactaaccggttacgtttacgttacggtaaccgtacccgtacgtaacgcggttaaaggtacggttcgtaagtacggtacgggtaaccggggtttgaaccgggtacgggaaccgttccgtaacggttccggtaagttccccgggttaatacggtaacccggttagggaaccgttcccgggtacccgttacccggtaacgtccggttacccgttcgtttaacccccgg

SEQ ID NO: 90319 - DNA, 812 bp, Homo sapiens
  misc_feature: GYAE6OF02GDMQS.21.8.A08.1.454.CMB.1.raw
  modified_base (155)..(155): a, c, t, g, unknown or other
  misc_feature (155)..(155): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctaatganctgacacagcccacctcggtgtaccagtcgtccccgaggacaacggccgaggactcaacctcgctcgtggagtattcattggaaccctaaaaagtaattaacttaacgtttcggtttacggttaccaagtcctaaggtaacgtccgaacggccctaacggcccctagttaccgtggtacctaacgttcccaagttacgggaccggacctaacggttccgaaccggacctaccggtacccggggaccttaccccgtaggaacgtacggttacgtttaccaccgttacgcccttaccgaacgtccgtacggaacgggtaacctaggtcgacccgtacctttacggaaccttacgtacgtacggtcggggacccgagggtcggaacgagtacggaacggtacgtacgtaaccgtttaacgttaacggtttcgttaaccggaccgtaaccgaaggtaaccgtacggttaagggttaccggtagaacggtttacgggtaaagggggttacgttaccggggtaagggtaccgggtaaaccggtagggttaccggtacccgggtttacccggttacgggttaaccggtaccgtaaccccggtaacggcccgttacccgggtacccccgttcgggtaaccccggttactcccgggtttaaccccg

SEQ ID NO: 90320 - DNA, 816 bp, Homo sapiens
  misc_feature: GYAE6OF02I1R5Z.21.8.A08.1.454.CMB.1.raw
  modified_base (462)..(462): a, c, t, g, unknown or other
  misc_feature (462)..(462): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgacgctgacacacgccacccgtcggtgtcagtcgtcccgaaggacaaacggccaaggactccactgctcgtaggactatctagttacgaaccaaaagtaacttattacgttggttcgttaccagacgaacgaacgtcaacggcccgaccggcccccttaggtaccgttcggtaccgtaatcccgtaatcgggaacggcccgtaggtaccggaaccggtacaacccggttcccgggtaactccccgtaaggacgtacggtactttccgtaccgtcggtacccctacacgtaccgtacggaacgggtaccgnggtaccggtccctaaccgttacgtaacctacggttacccgaggggttacccggggtaccgaggggttacgggaacgttaacgtacggaaaccgttccgtacgttaaaccgtttacgttttaaccgtttaacgggttaccctaacctaaccgggaacttacggtaaggtttaaccgggtcgtaacgtaaccggttacggggtacggggtttaaccggtccggggaaccgggggttaacgaccggttacggttccgggttaacccgggttcgttaaccggtacccggtaacgtacccggaaccggttcctccccgggtaccccgttcggcctttacccggttcccttaacccccgg

SEQ ID NO: 90321 - DNA, 754 bp, Homo sapiens
  misc_feature: GYAE6OF02HJ5VH.21.8.A08.1.454.CMB.1.raw
  modified_base (137)..(137): a, c, t, g, unknown or other
  misc_feature (137)..(137): n is a, c, g, or t
  modified_base (585)..(585): a, c, t, g, unknown or other
  misc_feature (585)..(585): n is a, c, g, or t
  modified_base (605)..(605): a, c, t, g, unknown or other
  misc_feature (605)..(605): n is a, c, g, or t
tcagtcgtcgctcgcacgaccggtgctcgatttagcatactctacagggggctgtgggctcaggaggcagagctctgggaatcgtcaccatggcctggacccctctcctgcctcccccctcctctactttctgcacngtctctgaggcctactatgagtctgacacacgcccacccgttcggtcgtctacgtcgtacccgaggaaccgaaacggcaggactccactgctgtggatcttcgacttacgaacaaaagtaattacttacgtttcgttcggttaccagcgaagtacgtacgacggccacggtccccttggttaacgtggttctaactccgtaagttcggaaccggccggtacgttaccggaaccgtaccgaccggttacccgggtacttccccgtaggtaaccgacgttacgttaccttccgttccggtacctaccggctacccgttacggacggaacgtcggtacggtaccctaccgttacgacgttacggtacgtacgggtacccggggaccgtaggggtacggacggtaggacggtaaggctacgtaattaccgttagttccgtaacgcctaccgnggtaacgtacggtaaggttntaaccggtagttaaccggtgggggttaaccgtccgggacgggtaacggttaccggtacggtttccggtaccgtcggtttcgtccgtaaccggtaccgaacgggttccgtcccggtacccgttcggacccttacgtcccggtttcccccg

SEQ ID NO: 90322 - DNA, 658 bp, Homo sapiens
  misc_feature: GYAE6OF02G4CQD.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagccaccctcggtgtcagtcgtcccccaggacaacggccaggactcacctgctctgganattcattgaccaaaagatatacttgttgtccagcaagagtcaggccagccctgtactggtcatccatgacgccagtcgaacgacgacgtccggatcccgtagacgagtactttctacgtcgtccctaccgacgtcgtacggacgggactaaggtccgggaccccaccgttttcggaacttacggtccgtaagggtccgggggtaccccgaaggggttacggaaccggtaagtcggaacggtctacggacttaacgttaagtttcgttaccgcaaccgacggtactacggttaggtggtcgagtacggtaagggggttaactcgggaaccgggtacgggtaaccgtaggttaccggtacccggttcgttacgggttacaccggacccgaacggtcccgtacccggtccccgtccggtaccgtaccgtcccgttacccgg

SEQ ID NO: 90323 - DNA, 826 bp, Homo sapiens
  misc_feature: GYAE6OF02IQODY.21.8.A08.1.454.CMB.1.raw
  modified_base (129)..(129): a, c, t, g, unknown or other
  misc_feature (129)..(129): n is a, c, g, or t
  modified_base (250)..(250): a, c, t, g, unknown or other
  misc_feature (250)..(250): n is a, c, g, or t
tcagtcgtcgctcgcacgaccggtgctcgatttagcatactctacagggggctgtgggctcaggaggcagagctctgggaatctcaccatggcctggacccctctcctgcctccccctctctactttcngcacagtctctgacggccttcctatgagctagaccacacgccctacccgtggttcgtcacggtccgtaccccgaaggaaccgaaaccggccgaaggtactccaccgtgcctcgtaggactnttctatcgaacgaaaagtattattacgtttggttacggttaccagtacgtaacgtaacgtcgacggaccccgacgggtccccttaggttaccgttcgggtactactaccgtaggtacggaccggtaccgtacggtaccgaaccgtaaccaaccgggttcccgggacttcccggtaagacggttaacgtctttccgtaccggttcccgacccgtaccggtacgtacccgtacgggaaccggtaacgtacggttaccggtaccccttaaccgtttgtaacgtttacgtaccggtacgggtaccggggtacccgtaagggtacgggaacggtaacgtaagggtaaccggtcgtttaacggtaaccgtttaacggttttaccggtttaaccgttaaccgtaacccgtaaccgtaacggtaacgttacggttaggttacggtaccgttaacgggtacgggttaggggttacgtcggggaacggtacggtaaccgtagggttccggtaccgttcggtaccggtcgaaccggtaccggtcggtcccgtccggtacccgtcgtcgtacccgttccgttaccccg

SEQ ID NO: 90324 - DNA, 802 bp, Homo sapiens
  misc_feature: GYAE6OF02IBIW6.21.8.A08.1.454.CMB.1.raw
  modified_base (132)..(132): a, c, t, g, unknown or other
  misc_feature (132)..(132): n is a, c, g, or t
  modified_base (138)..(138): a, c, t, g, unknown or other
  misc_feature (138)..(138): n is a, c, g, or t
  modified_base (248)..(248): a, c, t, g, unknown or other
  misc_feature (248)..(248): n is a, c, g, or t
  modified_base (774)..(774): a, c, t, g, unknown or other
  misc_feature (774)..(774): n is a, c, g, or t
tcagtcgtcgctcgcacgaccggtgctcgatttagcatactctacgagggggctgtgggctcaggaggctagagcttctgggaatctcaccatggcctggacccctctcctgcctccccctcctcactttcngcacgngtctctgtacggccttctatgagctacgacacgacgcccaccgttcggtgtaccgaggttcgtaccccgaaggtaccaaacggcctaggactccacgtgccttcgtaggnacgtcggactgaactaaaagaatgtactactttagttacggaaccaaagaagaccgaccgacggacccggtaccggccccgttgttacggttacggtagtaagttaagttaaagtaaaaccggtctaaccggttaggaccgtaccggtaccctagaacggtacgtaaccgttcccgaggacgttaccgtaattccgtacgtacggcttaccgacggtactaacgggcgaacgacgtaccgagttaccgtaacgttcgaacttacgtagacggtttagaacccggttacggacggacggaaacggtacggaaacggtacgcgtacgttaaccgtttaacgttacgtacctaaaacgtaccgtaaaggttacgtaaaccgtagggtaaacgttaacgggttaaaccctttgggttaaaccgggttttagggggttacccggtagggtacccgggggtaacggtaccctaacggttaaccggtcccggttacggttaaccggtaaccggtccgaaccggtaaccccggngtaccccctccgggcccctttaacccgg

SEQ ID NO: 90325 - DNA, 826 bp, Homo sapiens
  misc_feature: GYAE6OF02JEXN9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccacccgtcggtgtcagtcgtaccccgaggaaccaaacggcaggatccacctgtcctcgtagggatacttacattacgaaccaaaagtaattactaacgtttggttcggttaccaagtctaaggtaacgtccgaacggtaccccgaacggtcccccttaggttaacgtcggtaccacgttaccaggtcggacggtcctaggtaccgaaccgtacgaccgtccgggactcccgtaggagtacgtacttccgtcgtccgtcctaccgtacgtcgtaccggaagggtacctacggggtccgtaaccccttaccggttcgtaacgtacgtaccgggtacggggtacccggggaccgttacggggtacggacgtaacgtagggtaaccggtacgttaccgtaaacgtttaactttacgtttaaccggtaccgaccgaaacccgtaggtaacgtaaggttacggttccggtaagtaacgttacgggggtaacggggttaaccgtaccgggggaacggggtaaccggtaaaccgttcgggttacggtacccgggttcccggtttacgggtaaacccgtacccggaaaccccggtagggtcccccgtttaaccccgggtacccccggtttaggaccccgtttaccggttccccgtttccccccgggg

SEQ ID NO: 90326 - DNA, 894 bp, Homo sapiens
  misc_feature: GYAE6OF02JLR5O.21.8.A08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggtcctcctatgagctgacacacgccaccctggtgtcagtcgtccccgagaaccaacggccaggactccacctgctcgnggatcttcattcgaacctaaaagaatacttacgtttggttacgttaccagtacaagtaacgtcgacggccgtacggcccccttaggtaccgtacggttacctactacccgagtacggaccggaccctacggtaccgaaccggacctaacccgggttcccgggtaccttaccccgtaggaaacggtacgtaacctttcctacgtacccggtaccctacccgaaggtccctaaccgggtaaacgggtaccctaacgggttacccggacccccgttaacgttttacgggtaaccctttaacgtaccgggtacggttacccggggggtaaccccggttaacggggtacgggtaaaccgttaacggtaccgggaaacgttacccgggttaaccgtaaaccgtttaacgtttaccgggttttaaccggttacccgaccgtaaacccgtaaggtaacccgttaagggttaacgggtacggttaccgtaaccgggttacggggttaacggggttaccggttaccggggacggggttaaacccggggtaccttaacgggttaccggacccggtttcccgggttaacggtccggtaaacccggtacccggtaaacggttccccgtaccccgggttcccccggttaacggttcccttaccccggtttcccgtttaacccccgg

SEQ ID NO: 90327 - DNA, 713 bp, Homo sapiens
  misc_feature: GYAE6OF02FSMAX.21.8.A08.1.454.CMB.1.raw
  modified_base (154)..(154): a, c, t, g, unknown or other
  misc_feature (154)..(154): n is a, c, g, or t
  modified_base (165)..(165): a, c, t, g, unknown or other
  misc_feature (165)..(165): n is a, c, g, or t
  modified_base (178)..(178): a, c, t, g, unknown or other
  misc_feature (178)..(178): n is a, c, g, or t
  modified_base (227)..(227): a, c, t, g, unknown or other
  misc_feature (227)..(227): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggcctctatgancgtgacacacncccacccgtggtntacagtcgtccccaggtaacaaacggcaggactcacctgcttcgtgganattcagttcgaacaaaagacttatacgtttgttcggttaccagactaagaacgtcgacggcccgtacggcccccttaggtaccgtcgggttaccaacgtcccgaagttggaccggacccgtaaggttccggaaccggacctaacccggtccgggacttccccgaggacgtaggttacttaccgtcttacgcccttccgaagtcctcggaacgggtactacggtcggacccctacttcggtaacctgtaccggaggtccggggtaccggtagggtacggaacggtgtacgaaacggtcgtacgtaaccgtttacgttacgttgttaaccgccaacccgtagaacgtagtaggtcgtacgtactacggggttaggtacggttcgggaacgggtacggaccgtttacggtacggtccttcggttacggtaccgtaaccggtacgaccggtccgtaccgtccccggtaggtccttctaccgttcccccgg

SEQ ID NO: 90328 - DNA, 660 bp, Homo sapiens
  misc_feature: GYAE6OF02F7AT4.21.8.A08.1.454.CMB.1.raw
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctagtgacgctgacacagcccacccgtggtgtcagtcgtccccaggaaccaaacgaccgaggactccaccgtgcctcgtggatattcattgaccaaaagaatattacttgttggttccagcagaagtcgagccacggcccctgtactggtcatccagtcggacgccagtccgaacgccaccgtccgggactcccgtagacgagtacttctcgcgtccctaccgacgctacgacgggtacnggtccgccttacgtgactacncgaggtcgggaccgtgggtacgacgtagtggacgtcgagtaaccttacgttagtttaccgttacgaccaaccgtaagtaccggtaaggttacggttcgtaaccgtaggttcggggtaacggggttacggtccgggacggggtaacgggtaccgtaacggttcggtacccggttcggttacggtccggtaaccgtacccggaacgtcccgtaccggtcccccgttacggtccctacccgttccgtacccccg

SEQ ID NO: 90329 - DNA, 699 bp, Homo sapiens
  misc_feature: GYAE6OF02HKMMZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctctgcctcccctctcactttctgcacagtctctgagcctctatgagctagacacacgccctacccgtggtgtacgtacgtcgacccgaggaaccaaaacggccgaaggactacactgtctcgtaggatatacattacgaacaaaagtatatacgtttgtacgtaccagtactaagaacgtcgacggaccgacggtccctagtacgtcggtacactcagtacgcggtacgagtacgacggactaccgtacggtacctccgagacgaactagttctcgcgaccttacgacggtacgtacggaaggtacacggttaccggaccttacgtactaacgtacgtaggacgggtacgggaccggtaagggtacggaacgtgtacggtaacgcgttaagtacgttaacgttagtacgttaccgaactaccgaagtaacgtaggtacgtacggtatacgggtacggtacgggggttaccggtaacgggacgggaaaccggtacgtaacggtacccgtaccgggttaaccggagttaccggaaccgtaacccggaaccgtaccctaaacccgtagtaccggttaacccacgtcccgttaaccccg

SEQ ID NO: 90330 - DNA, 725 bp, Homo sapiens
  misc_feature: GYAE6OF02HWMLH.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgccacagtcctcgtggacggcctcctatgagctgacaccagcccacctcggtgtcagtccgtcccaggacaaacggccaggactccaccgtgcctcgtaggatacttcattaccgaacctaaaaaagattattaccttggtttcggttccagacaagaacgtcgacggccacggtcccctgtactcgtccaatccagacgacggtccaggtaccgaacgaccgccgtaccgggactcccgagacggatacttctccgcgtccctacgacgtctacggacgggacctgcccggtacctacccgtttagaccgtacgtaccggtacgggtccggggacccggtagggtacggtaaccggtagtaacggagtaccgttacgtaaccttacgtttagtttacgttaccaccgtaaccgaagtaccgtagttaggttaccggtacacggttacgggtaacgggggttcgtacggggtacgggtacgggtaccgttaacggtaccgtacccgggtttaacgttccgggaactacccggtaaaccgaccgggtcccgtcccgggtcccccgttacggtccccgttaccgttcgtttacccccg

SEQ ID NO: 90331 - DNA, 688 bp, Homo sapiens
  misc_feature: GYAE6OF02F5INL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacacgccacccgtcggtgtcagtcgtccccgaggaacaaacggccaggactcacctgctcgtggagattcattcgaccaaaagataatacttgttgttccagcaagaagtcgaggccacggcccctgtactcggtacactccgatggagtccaggtcgaacgacaacgtccgggactccccgtagaacgtagacgttctacgtcgtccctcaactccgtacggaacggaccaggtcgtacccaccgtttacgactagtacccgaagggtccgggacccgagggtacgggacgtaacgtacgaagtccgtaacgtaaccttacgttaagtttcgtaaccggacaccgtaagtaccgtaagtacgggttacgtaccgtagggttaccgttaacgggggtacttccgggtaacggggaacgggttaaccgtacggttacggtacccgggtttcgtacggttaccggaacccgttaccggaaaccgggtctcccggttccccgtacggtcccgttacccgttcgttaccccgg

SEQ ID NO: 90332 - DNA, 825 bp, Homo sapiens
  misc_feature: GYAE6OF02GU8LY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctcgcctccccctcctctactttctgcacagtctctgacggcctctatgagctgacacacgcccacccgtcggtgtacaggtcgtaccccaggaaccaaacgggccaggactccaccttcgactcgtagggatacgttacctagttacgaaccaaaaaggtaacttacgtttacgtttaggtttcgggttacccaggaccgtaaggtaaacgtcgaaccgggaccccacgggtccccgttacggtaccgttcgggtacctaacttaccgacgttagggaccggtccgtaacgtacggaaccgtaacctaccggttaccgggacttcccgaggtaagtacggtactttccgtaccgtaccggtccctaccggacgtacgtaacggaacggggtacctaaggggtcccgtacccgttaacgttcgtaacctacgttcgggacggggtccgggtaccggaagggttacgacggtacgtaggacgtaccgtaggtaaccttcgttaacgttcgtaaccgtacgtacaacgtaacgtaggtagttaccgggtacaacggttaccgggtaagggggttccgtaacgggtacgggaacggtacggttaccgggttacgtacccgggtttaccggtaccggttccggaaccggtaccggtaacggttccggttaaccccgtcccccgggtttacggcccccgtttacggttccccgttaacccccgg

SEQ ID NO: 90333 - DNA, 767 bp, Homo sapiens
  misc_feature: GYAE6OF02H2VNI.21.8.A08.1.454.CMB.1.raw
  modified_base (135)..(135): a, c, t, g, unknown or other
  misc_feature (135)..(135): n is a, c, g, or t
  modified_base (235)..(235): a, c, t, g, unknown or other
  misc_feature (235)..(235): n is a, c, g, or t
tcagtcgtcgctcgcacgaccggtgctcgatttagcatactctacagggggctgtgggctcaggaggcagagctctgggaatctcaccatggcctcggacccctctcctgcctcccctcctcactttctgccacncgtctctgacggcctcctatgagctggacacacgccacccgtcggtgtccagttcgcccaggaccaaacggctaaggatccaccgtgcctcgtggacgtnttcattcgaaccaaaaaggtattataccgtttggttcgttccaggctaagagtcgacggccacggcccccgtgtaacgtcggtactactaccgactaggaaccggtccttaacgaccggaaccgtaaccgtaacccgttccggggacttccccggtaggaacggtactacctttccgccgttcgacccttaccgacggttaccgaccggtaaacgggcgtaacgttccggaccgtaaccctttagacgtttaacgacggttacggtacccgggggaccgtacggggtaccgtaggaacgtacgggaacgttacgtaacgtaccttaaccgtttaacgtttacgttaccgtaccgtaaccgacgtacggtaaggtacggtcgtacgtagtacgggttaacgggtcggtaccgggtcggaaacggggtaccgaacggttccggtaaccggttccggtaacgggttcaacccggggttacccacgggtcctcccggtaccccggttaccggtaccgttacccgtccgttccccgg

SEQ ID NO: 90334 - DNA, 831 bp, Homo sapiens
  misc_feature: GYAE6OF02GMV9L.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttcctgcacagtctctgaggcctctatcgagctcgacacagcccacccgtggtgtcgacgtcgtccccaaggaacaaacgggtccaagggacttccgaacctgtccgtacgttagggactattaccagtttacggaaccaaaaaagggtaacttagtttaaccttgggtttacgggttaccaagtccgtaaaggtaacgttccgaaccggcctaacggggcccccttggttaacctgggtaccactaccagtcgggaacgcctaggacggtaaccgactaccggtccgggtacctcctagggactaaggttacttcctaccggtcggtacccctacgaaccgtcgtacccggaaggggtactaacggggtttcgaccccctttagtttaacggaccctaacgttacgtaacgggtccgggtaccggagggtacggtaacggtacgtagaaacggtccgtacgtaacgttacgtacgtttacgtaccgtaaccgacgaaccgtacgtagtaaccggttacggtaccgtaaggtaccgggtaggggttaaccgtaccggggtaacggggtaccgtaaaccggtacggttaaccggtacccgggttaccggtttaaccggtaacggtacccgggtaacccggtaaccggtaccccggttacccggtacccccggtagggtttacccctaccggttacccgtttaccccg

SEQ ID NO: 90335 - DNA, 720 bp, Homo sapiens
  misc_feature: GYAE6OF02GIHCM.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgagctgacacagccaccctcggtgtcagtcgtccccaggacaaacggccaaggactcacctgctcgtgganattcagttcgaccaaaaagacttatactttgttggttaccagcaagaagtcaggccacggcccctgtacgtggtcactccatcgaggccaggtcgaacgactaccgtccgggatcccgtagacggacgtacgtttcctaccgtgccccttcgacggtcgtacggacggggtaaccacgggttccgggaccccttaaccggttacggaacttacgtaccgtaacgggtccgggggacccggtaggggtacggaacgaacgtacggaaacgtcgtacgtaacttacgttagttacgtacgacctaacgacgtaacgtaggtacgttacggtactaggttacgggtaacggggttagttaacgggaccggggtacgggtaaccgttaacgggtttacggtacccgggttaccggtttacggggttacaaccgggttaccccgaagggtcccgttcccggtccccccgttacgggtacccgttacccgttaccgttaccccgg

SEQ ID NO: 90336 - DNA, 759 bp, Homo sapiens
  misc_feature: GYAE6OF02I407O.21.8.A08.1.454.CMB.1.raw
  modified_base (405)..(405): a, c, t, g, unknown or other
  misc_feature (405)..(405): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggtcctcctatgagctgacacagcccacccgtcggtgtcagtcgtaccccaggaccaaacggccgagactccaccgtgctcgaggacgattcgacttcgaaccaaaagtatacttacgtttgttcgttccagacagtaacgtcaacggcccacgggcccctgttaccgtggtactaacgtccaagtcgggaacgccgtacgtaccggaaccgaccgaccgttcccgggaactcccgtaggaacgtctacgtttccgttaccncgtttccccaccgtacggtaccgtacggaacgggacgtacggttccggaccttaccgtttacgaactacgttcggaacgggttccgggtacccgtaggggtcggtaacgtagtacggtaacgtccgttacggtaacctttaacgtttacgtttaaccggttaccgtaacccgaaccgagttaaccggtaggttaacggtcggttaccgaacggttacggttacgggggttaagttacccgggtaaggggaacgtaccggttacggttacggtacccgttcgttacgggtacgtaccggccggtaacggtcccggtcccgttaccccgtccggtaccttccgttccgttaccccg

SEQ ID NO: 90337 - DNA, 664 bp, Homo sapiens
  misc_feature: GYAE6OF02H87L7.21.8.A08.1.454.CMB.1.raw
  modified_base (180)..(180): a, c, t, g, unknown or other
  misc_feature (180)..(180): n is a, c, g, or t
  modified_base (336)..(336): a, c, t, g, unknown or other
  misc_feature (336)..(336): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcacttttctgcacagtctctgaggcctcctatgagctgacacagcccacccttcggtntcagtcgtccccaggaccaaacggccaggatcacctgctctggatattcattgaccaaaaagatatacgttgttggttccagcaagaagtcaggccaggccccctgtactggtcactccatggagccagtccgacgacacgtcccgggatccccgngacgagtattctcctgccctccgagccgtcgaacgggcaaggtcggaccctaacgtttgaccttagtcgagggttcggggaccccgtagggtcggaaacggtatacggaagtaccgtggaaccttaagtttacgtttcggttaaccgtctaacccgaaggacgtaacggttagttcggtactaacgttacggtaaggggggttacgttaccgggcggtaaccggggtaccaaggtttaccggacccggtttccgttacgggttaccacggtaccccgaagggtccgtcccggtcccccgtccgggtacctaccctcggtttcccccgg

SEQ ID NO: 90338 - DNA, 785 bp, Homo sapiens
  misc_feature: GYAE6OF02GT7RY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagtattcattcgaaccaaaagtaatattactttggttaggttccagcagaagtcaggccaggcccctgtactggtcatccatggacggccaggtcgacgacaccgtccgggatcccgtagagagtacttcctctcgtaccctccgacgtccgtacgaacggggtacagggttacggaccctactttcggaaccttaatccgtaagggttcccgggggaccccggtaggggtacgggaaccggtaagtacggaacgacgtacgaaccgtttaacgttaagtttccggtttaacgacctaaccgtaaaggaccttaaagggttacgggtacggttactaacggttcggggttaaacggggggttaccgttttacgggggaccgggtaacgggggttaacccggttaacgggtttaccgggtaaccccggtttcccggtttaaccgggggtttacccgaaaccgggttacccccggtaaaccggggttaccccggttacccccgggttaccccccccgggttaccggggttttacccctaccccggttttaccccggtttacccccccggg

SEQ ID NO: 90339 - DNA, 732 bp, Homo sapiens
  misc_feature: GYAE6OF02H90JJ.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgcctccccctcctcactttctgcacagtctctgacggcctctatgagctagacacacgccacccgtcgggtgtcagtcgtccccgaggacaaaccggcaggatccacctgctcgtaggagtacttcattacgaacctaaaaagatacttacgttgtttcggttaccagcgaagaacgtcacggccgacgtcccctaggtaccgtggtacactccgagtcggacggccgagtacgaacgacaccggtccgggactcccgtagacgtaacgtcttacctcgtacgccctacgtaacgtcgtacggaagggacctacggtaccggtacccttaccggtttacgtaacccgttaacgtacggtaccggggttacccggggacccggtacggggttaccgggaacggtaagtaacggtaaacggtcgtaacgtaaccgttaaactttagtttacgtaaccggacaacccggaaagacggttaaggtaacggtgtacgtagttacgggtaaggggttacggtacgggacggtaacggggaactaggttaccggtaccggtccgttacggtacgaacccggtaccgacggtcctccggtccccgtacggtccgtacccgtccgttccccg

SEQ ID NO: 90340 - DNA, 695 bp, Homo sapiens
  misc_feature: GYAE6OF02HGYP4.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctcactttctgcactgtctctgaggcctcctatgagctgacatacgcccaccctcggtgtcagtcgtccccaggacaaacggccaggatcactgctcgtgagtatcattgaccaaaagatatacttgttcgtccagcagagtcacggccacggcccctgtactgtcactccagtgcggacctaggtccgacgtacgaccgtaccgggacttcccgtagacgacgtacttccgtcgtcggtacctccgacgtcctacggagggtaaccgtacggtccggacccttaaccgtttcgaaccttacgtacggtacggggttcccggggacccgtaaggggtacggtaacgtaagtacggtaacggtccgttacgtaacctttaacgtttacgttacggttaaccgcctaacgaacgacgttaaggtacgttcggtacacggttcgggtaaggggttacgtaccggggaacggtacgggtaaccgtaggttaccggtacccggtcggttacggtacctaccggtacccggaacggtcccgttaccggtcccccgtacggtaccctccgttcccggttaccccg

SEQ ID NO: 90341 - DNA, 1086 bp, Homo sapiens
  misc_feature: GYAE6OF02IMG7J.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgagcctctatgagctgacacacgcccacccgtcggtacgtcgacgttccgtaccccgaagggaaccgtaaaccggccaagggtactacccgacccgtcggccgttccgtaggacgttactttacgtacgtttcgaaaccaaaaagtaattactttacgtttggttcggttaccgaggtacaaggtaacggtacgaccgggacccgtaccgggtcccccttaggttaccggtacggtaccctagtacccgtacgttacgggaccggtacctacgggtaccggtaaccgaacccgtacccggtaccccggggtactttaccccggtaaggtaacggtaacgttaacgtttcccgttacccgttaccgtacccccgttacccgacgttacccggtacccgggtaaccggggaacgttaaccggggtaccccgtaaccccgttacccgtttacggtaacccgttacggtttacccgggtaacgggggttccccgggggaaccccggttaagggggtaccgggtaaaccggtaacggttaaacggggtaacccgttaccggttaccggttaaaccgtttaaaccgtttttaacgggttaccgggttttaaaccccgaacccggtaaacccgggtaaaccggtaaacgttaaaccggggtttacggttaaccggggtttacccttaaacggggttaaccgggggttttaacggggggtttaaaccggggtttaccggggaaaccggggggttaaccgggttaaaacccggggtttacgggtttaccccgggtttaaccccggggttttacccggtttacggggtaaccccgggttaaacccggtacccccggggttaaaccggggttcccccgtttaccccggggttaaccccccccgggtttacggttaccccggtttaacccccggttcccgggttttaccccccccggg

SEQ ID NO: 90342 - DNA, 661 bp, Homo sapiens
  misc_feature: GYAE6OF02JNQHA.21.8.A08.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (445)..(445): a, c, t, g, unknown or other
  misc_feature (445)..(445): n is a, c, g, or t
tcagtcgtcgctcgcacgaccggtgctcgatttagcatactctacagggggtgggctcaggaggcagagctctgggaatctcaccatggcctggactcctctcctgcctccccctcctcactttctgcacagtctctgacgcctcctatgagctgacacagccacccgtggtgtcagtcgtccccaggaccaaacggccaggacncacctnctcgtggacgattcagttcgaccaaaagtctaatacttggttcgtacagcagacgtcgaggccacggtccccttagtacgtcggtacacgtaccaagttcgaacgggacctaggtccgaacgacaaccggtccgggactccgagtaagacttatcctcacgccctanaccggcgtacgacgggancggtaccgctacccgtgaactttgcgaggccggtaccagggtcgaacgngtcgaacgtcggtacgtactacgttattgtaaccgcgtaactaggagttagttcgtacggacgacggtagggtacggggttacctccggggacggtaacgggacttaagggttccggtccgtacggtttcggacccgtaacggacccgtaacgggtccctttaaccccgggccccggtacgtaacccggttaccttccgttacccggttcccccgg

SEQ ID NO: 90343 - DNA, 802 bp, Homo sapiens
  misc_feature: GYAE6OF02HY4Q3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgacggcctcctatgagctgacacagcccaccgtcggtgtcagtcgtcccaggaccaaacggccaggactccacctgctcgtacggagtacttcagttacgaaccaaaaagtaattacttacgtttggttacggttaccaaggtactaaggtaacggtccgacggtacccgacggtacccccgttaggtaaccgtcggtacctacttaccgaagtcgggaacggcccgtaacggtaccggaaccgtaacccgtaccgtacccggggtacttccccggtaggtaacgtacgtaactttccgtaccgttcccgtccctaccgaacggtcccgtaacgggaacgggtacgtacggtaccggtacccttaaccggttacgtaaccgttacgtacggtaacggggtaccggggacccggtaggggtacggtaacgtaagtacggtaacgtactacgtaacttaacgttaacgttacggtaaccgaccgtaaccgaacgtaacgtacggtacggttacggtacgtacgtacgggtaacggggttacgtacgggtacgggaacggtaaccgtagttccggtaccggttcggttacggtaccgtaccggtacccgacgggtcccgtacccggtcccccggttcgtaccccgttacggttcccgttaccccgg

SEQ ID NO: 90344 - DNA, 615 bp, Homo sapiens
  misc_feature: GYAE6OF02G2X3Y.21.8.A08.1.454.CMB.1.raw
  modified_base (174)..(174): a, c, t, g, unknown or other
  misc_feature (174)..(174): n is a, c, g, or t
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
  modified_base (546)..(546): a, c, t, g, unknown or other
  misc_feature (546)..(546): n is a, c, g, or t
tcagtcgtcgctcgcacgaccggtgctcgatttagcatactctacagggggggagaggagcccagcactagaagtcggcggtgtttccattcggtgatcagcactgaacacagaggacctcaccatggagtttgggctgagctgggttttcctccttgcttcttttaagaggtntccagtgtcaggcgcaactggtggagtcgtgggggagcagtggtccagcctggggacgtccctgacgcctctcctgtgcagcgtctggattcagtntcggctccttgcctatcgcacgtcgggtccncgaggcctcgaggtcgaagggctggagtgggtgacgtatacgtctggtatgatagggtaagtgaagtagtattagtaattcgaaggtacctacggtaggaacgggcctagttaccaacgtactcctcctaagacgacaagtcgaaccaaacaacctacacgttcgtaattcttacgaaactacggaccgtaccgtagaacgacgcccggaacgtaacgtacggaccttagtacgttattaaccgnggttaaccgtgttacggttttaggaccgttagggttccgggaccctaaccgggtacccgtggtaccccg

SEQ ID NO: 90345 - DNA, 968 bp, Homo sapiens
  misc_feature: GYAE6OF02HDYGN.21.8.A08.1.454.CMB.1.raw
  modified_base (133)..(133): a, c, t, g, unknown or other
  misc_feature (133)..(133): n is a, c, g, or t
  modified_base (159)..(159): a, c, t, g, unknown or other
  misc_feature (159)..(159): n is a, c, g, or t
  modified_base (162)..(162): a, c, t, g, unknown or other
  misc_feature (162)..(162): n is a, c, g, or t
  modified_base (586)..(586): a, c, t, g, unknown or other
  misc_feature (586)..(586): n is a, c, g, or t
tcagtcgtcgctcgcacgaccggtgctcgatttagcatactctacagggggctgtgggctcaggagcagagcctctgggaatctcaccagtcggcctcggaccccttctcctgcctccccctctactctttcngccatagtctctaggcgccctctaangancgtagacacacgcccaccgtggtgctagtccgacccgagtaaccgaaccgcgagtacaccgactcggcttcgaggaacttacttacgacgttaaccggaacctaaaaaggtaactttaacgtttaccggttttggtttaccggtttaacccgaggtaacctaacggtaaacggtccggtaacgtaccccgggtaaccccggttaccccgttaacggtccggttaccggttaacgttaaccgtacccgtacggtaaccgggtaaaccggcccggttaaccggtaacccggtaaacccgtaaccgtaacccggggtccccggttaacgtacccccggtaagggtaaccggttaaccgttacgtttccggaccttcccggtaccccgtaccgtaaccggtacccgtaccgggtaaagggttaacccncggggtaacccgttacccgtaaccggttacgttacccggaacgtttacccggggaccggggttacccgggtaaccgggttaaccggggtaccgggtaacggtaacggttaaacgggtaccgtttaaccggtacgttaaaaccggttcgttacggtttaccgtacgaacctaccgtaacgtcgtaaaggttacgtcgacgttacggttaacgggttcggggttaacccggagggtaaccggggtaacgttaacgggttacggttacccgggtttaccgggttaccggtttcggtaacccggacccggtaaccgggttacccgccccggttaccgggtccccgttcccggtttaaccggttacccgttcccggtttacccccgg

SEQ ID NO: 90346 - DNA, 776 bp, Homo sapiens
  misc_feature: GYAE6OF02G8MDN.21.8.A08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagcatactctacagggggtgggctcaggaggcagagctctgggaatctcaccatggcctggaccctctcctgcctccccctcctctactttctcgcacagtctctggacggtcctcctatgagctagacacgacgccaccgtcggtntcgagtcgcccgagacaacggcaggactcacctgctcgtaggacgtacttctagtacggaaccaaaagtattagttacgttggttacgtaccgagtaccgaaggtacgtacgacggaccgtaccggtccccgtggttaccgtacggtcctaacgttccgtaaggtcggtaccggtaccgtaacggtccggaaccgaccgtacggtacccggtcttacccgagacgtacgtactccgtcgtaccgtcccgtacacggtaccgtaccgggaacgggtaacctcgggtaaccgtaccgtaccgttacggtaacgtacgtcgaccggggttaccgggacccgtagggtaaccggacggtagtaggaaccgtctaaacgtaccgttagttacggtttcgtaaccgacgaccgtagtaaccggagttcggtaccgggtaaccgtaggttacggggtaggtttacgggccggggtaacgtaaccgggtacgttaacggggtcgtaccgggtttacctaaccggccgaaccggttcgggaccgttcccggttacccgtacccggtggttacccgtacccggttacgtcccccgttaccgtcccg

SEQ ID NO: 90347 - DNA, 692 bp, Homo sapiens
  misc_feature: GYAE6OF02GKI9Y.21.8.A08.1.454.CMB.1.raw
  modified_base (155)..(155): a, c, t, g, unknown or other
  misc_feature (155)..(155): n is a, c, g, or t
  modified_base (175)..(175): a, c, t, g, unknown or other
  misc_feature (175)..(175): n is a, c, g, or t
  modified_base (304)..(304): a, c, t, g, unknown or other
  misc_feature (304)..(304): n is a, c, g, or t
tcagtcgtcgctcgcacgaccggtgctcgatttagcatactctacagggggctgtgggctcaggaggcagagttctgggaatctcaccatggcctggacccctctcctgcctccccctcctcactttctgcacagtctctgacgcctcctatganctgacacagccaccctggtntcagtcgtcccaggacaaacggcaggatcactgctctggatattcattgacaaaagatatacgttgtgtccagcagagtcacggccacggccctgtacgtggtcatccagtggacgccagtcgacgacncgtccggactcccgtgagtagtacttctctcgcctcacgtctacgaggacaggtcgaccctacgttagactagtcgacggtcgggacccgtagggtcggacgtagtacggaacgtcgtacgtaacgttaacgttagtttacgttaccgaccaaccgtaacgtacgtaaggttacggtacggtaccgtacgttacggggtaacggggttacgttacggggaaccgggtaaccggggtaaccgttaaccgggtttaccggtacccggtttaccgggtttacggtaaccggaacccgggtaaccccggtaacgggttcccctacccgggttaccccccggttaccgggttacccgtaacccgtttcccggttaccccgtttacccccccgg

SEQ ID NO: 90348 - DNA, 603 bp, Homo sapiens
  misc_feature: GYAE6OF02GLW53.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgaaacagccaccctcggtgtcagtgtccccaggaccaaacggccaggactcacctgctctggagattcattgccaaaagatatacttgttggtccagcagaagtcaggccacggcccctggtactggtcatccatgaggccagtccgacgacaccgtccgggatcccgtagagacgtattcctctcgccctaccgagccttacgagggacaggtcggccctaccgtttgactacgtcgaggtcggggacccagggtcggacgagtagaacgtctcgactactagtttcgtacgcaccgagacgagtaggtggtacagtcggaaggggttacgtcgggacgggagggtaccgtaaggttcgaccggttcgttcgggtaccgacggtacccgtaacggccgttaccggtcccccgttcggtaccgtaccgttccggtccgttacccccg

SEQ ID NO: 90349 - DNA, 870 bp, Homo sapiens
  misc_feature: GYAE6OF02I0COY.21.8.A08.1.454.CMB.1.raw
  modified_base (567)..(567): a, c, t, g, unknown or other
  misc_feature (567)..(567): n is a, c, g, or t
tcagtcgtcgctcgcacgaccggtgctcgatttagcatactctacagggggctgtgggctcaggaggcagagctctgggaatctcaccatggcctcggacccctctcctgcctccccctcctctactttctgcactagtctctgacggcctcctatggacgctagacacacgccctacccgtcgggtgtccaggtccgtaccccgaaggaaccgaaacggccgaaggactaccaccctgcctacgtgggaactacttctaagttaccgaaccgtaaaaaagtaactttactttaacgttttacggttttaccggttaccaacgtaccgaaagggtaaacggtccgaacgggtccccgaacccgggtacccccttaggttacccgttcgggttacctaaccgttacccgtaagtccggggtaaccgggtaccccgtaagggttaccccgaaccgggaaacccgttcccgggttaccccggggtacttaccccggttagggaaacggtaagttaccctttcgtaccgtccgtaacccctccgtacgtaccgtacggaacggggtaaccncggtcggaccccttacgttacgtacttactacgggtacgggtccgggaccggtaggggtacggaacgtagaggaacgtcgtaacgtacgtttaacgttacgtttacggtacctaccgaaccggacgtaacggtaaggtacggttacggtaacgttacggtacggggttagggggtttaccgtacggggacgggtaaccgggtaacgttaccggttcgggtaacccggttccgttaggacccggtaccgtaccggaccggtcctaccggtcccccggtacgtacgtcccgttaccgttaccccg

SEQ ID NO: 90350 - DNA, 722 bp, Homo sapiens
  misc_feature: GYAE6OF02G3E43.21.8.A08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganattcattgaccaaaagatatacttgttggtccagcagaagtcaggccacggcccctgtactggtcatccatgacggccagtcgacgacacgtccgggatcccgtgacgagtacttctcgtcgcctccagctacgaaggggactaggtacggaccctaccgtttcgaacttacgcgaacggggttccggggacccaaggggtacggaaccggtaagtacggaaagtccgtagtaaccttaaacgttacgttacggttaaccgaccctaaaccgaacggaacgttaacggttaacggttcgggtttaaccgaacggtttaccgggtaacgggggggtttaacgtttaccggggaacgggggtaaccggggaacccggttaagggtttacccggtaaccccgggtttaccggttacggggtacctaacccgggtaacccgaaacggggtcccctccgggtaccccccggtttccgggtaacccttacccgttacccgttaccccgg

SEQ ID NO: 90351 - DNA, 757 bp, Homo sapiens
  misc_feature: GYAE6OF02JYKGL.21.8.A08.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgccacagtctcgtgagcctctatgagctgacacacgcccaccgtcggtgtcagtcgtcccgagacaacggccaggactcactgctnggatatcgattcgactaaaagatatacgttgttacggttccagacgtacgaagtacgacggaccgtacggtcccctggtaaccgttgggtcctacgtacccgaattcggaacggccgacggttccgactacgaccgtccgggactaccccgtaggacgtactacggttcttaccgtgcccgttaccgagtcccttacggacgggaacgttaccgtacggtaacccgtacccgtagttaccctttaacgtaccggtacgggtaccggggtaccggtacgggtacgggtaacggtagtacggaacggtcttacgaaccgtttacgtttacgtttacggttactaccgaccgtaacggtaacggttaacgttacgggacggttacggaacgtacggggttacggggttaacggttacgggaccgggtaacgggtaaccgtacgggtttcggtaacccggtttccggttacggtccgtaaccggtacccgtaacggtcccgaccggttaccccccgttaggtcccgtaacccgttcgttccccccgg

SEQ ID NO: 90352 - DNA, 733 bp, Homo sapiens
  misc_feature: GYAE6OF02HGKBE.21.8.A08.1.454.CMB.1.raw
  modified_base (174)..(174): a, c, t, g, unknown or other
  misc_feature (174)..(174): n is a, c, g, or t
tcagtcgtcgctcgcacgaccggtgctcgatttagcatactctacagggggtgggctcaggaggcagagctctgggaatctcaccatggcctggacccctctcctgctccccctctcactttctgcacagtctctgacggcctcctatgagctgacacacgcccaccctcggtntcagtcgtccccaggaccaaacggccaggatcacctgctcgtaggatattcagttcgaaccaaaaagtactacttaacgttggttcggttccaggcaaggaacgtcgacggccacggtcccccttaggtaccttggtactacttaccgagtcggacggaccctagttacccggaccgtacctaccgggttacccgggacctttccccggtaggacgtaacggttactttccgtaccgtcgtccctacccgaggtcctacggacgggtaacgtcggtccggacccttaacgttcggaaacctcgttaccggacgggtccggggacccgtagggtacgtacggtacgtacggagtcgtacgtaacctacgttagttacgtacgacctacgacgtacgtacggtacgtcgtacgtcgtacgggttacgggttacgttcggggacggtacgggtaaccgttacgttacggtacccgttcggtttacggaccgtaccggacccgtaacggcccgttaccgtccccgttacggtaccctaccgtccgttccgttccccgtccccg

SEQ ID NO: 90353 - DNA, 835 bp, Homo sapiens
  misc_feature: GYAE6OF02F4N22.21.8.A08.1.454.CMB.1.raw
  modified_base (141)..(141): a, c, t, g, unknown or other
  misc_feature (141)..(141): n is a, c, g, or t
  modified_base (489)..(489): a, c, t, g, unknown or other
  misc_feature (489)..(489): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgnggcctctatgagctgacacagcccacccgtggtcgtcacgtcgtccccgaaggaaccgaaaccggccgaggactccaaccgtcgtccgtcgtagggaatacttacaacgtttcggaaaccctaaaaaggtaaactttaactttacggtttaggtttacgggttacccaacggtaccgtaaggtaaacggtaccgaacggggcccctaaccgggtcccccgttaggtaccggttaccggtactaacgtcccagttacggaccggtacccgtacgggaccggaaccgtacgtacccgggtccgggtactccccggtaggaggtacgtactttccgactccgtcctaccgngtaccgtcggtaacggacgtacggttcccgacccgttactacggaacttaggtcgtacggggtacccgggaccgtaggggtacggtacggtataacggtacggacttaacggtaacttaacgttacgttacggttaaccactaaacccggtaggaaaccgttacggttagggttacggtaccgtaacggttaccggggtaaggggggttaacttccggggtaggggtaaccgggtaccgttaggggtccggttaacccgggttcgttaaccggtaacccggcggtaaccccggtaggtcccgtacccggttccccggttacgaccggttcccttccggtacccccg

SEQ ID NO: 90354 - DNA, 657 bp, Homo sapiens
  misc_feature: GYAE6OF02FSFNS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatcgagctgacacagccaccgtcggtcgtcacgtcgtccccaggtacaaacggccaggatccacctgctcgtggatattcattcgaccaaaagatatacttgttgttccagcagaagtcgaggccagccctgtactggtcatccagtcgacggccagtccgacgacaccgtccgggactcccgtagacgtacgtattccgtactccggaccttccaggccttcggaacgggactagtcggaccctacgtttacggacttacgtcgacgggtccggggaccgtagggtcggaacggtagtacggaaacggtctaacgtacgttacgtacgttttacgtaaccgttaccaccgtacgtaactacggttacgttcggtacttaacgggtacggtaggggttacggtcggtaccggtaagggtaccgtacgttcgtacccggttcgtacgggtacctacggaccgtacggtactccggtccccgtacgggttactcccgtttaccgtccccgg

SEQ ID NO: 90355 - DNA, 862 bp, Homo sapiens
  misc_feature: GYAE6OF02H77LZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaccacacgcccaccctcggtgtcagtcgtccccgaggacaaacggccaggatccacctgctcgtggacgattcattcgacctaaaagaatattacttgttgttccagcagagtcaggccacgccctgtactcggtactactcctagtacggacggccaggtaccgaccgtaccaccgtacccggggctccccgtaggaacgtagtactttcctccgtacgccctaccgagtccgttacgggaacgggtaccgtaggtacccggacccgttaacccggtttaccgtaaccgtttaaccgtccggtaacgggggttaccccggggggtaccccgaagggggtttaccgggaaacgggttaacgtaccgggtaaacggttacccggtaacggttaacctttaaccggttttaacgtttcccggtttaaccggttacccgtaaaccgtaaccggtaacgttaagggttaaccgggttcggttaaccgttaccgggtttaccggggttaacggggggtttaaccggttccggggggtaaccggggtaaacgggggttaacccgttacgggttttaacccgggtacccggttttacccggtttcggggtaaacccggtccggttaacccccggaagggttccccgttacccgggttacccccccgttccggggtacccctttacccggtttcccgttttacccccccggg

SEQ ID NO: 90356 - DNA, 719 bp, Homo sapiens
  misc_feature: GYAE6OF02GYLYW.21.8.A08.1.454.CMB.1.raw
  modified_base (104)..(104): a, c, t, g, unknown or other
  misc_feature (104)..(104): n is a, c, g, or t
tcagtcgtcgctcgcacgaccggtgctcgatttagcatactctacagggggctgtgggctcaggaggcagagctctgggaatctcaccatggcctggacccctntccctgcctccccctcctcactttctgcacagtctctgaggcctcctagtgagctgacacagcccacccgtcggtgtcagtcgtccccaggacaaacggccaggatccacctgctctaggatagttccagttcgaaccaaaaagattacttacgttgtttggttccagcaagaagtcaggccacggccctgtactggtcagtccagtgacgccaggtccgacgactacgtccgggactcccgagacgtagtactttccgtcgtcgtccctccgtagtcctacgaacgggtacgtacgttccggccctaccgtttcggaaccttcgtaccggacgggttcggggacccgtaagggtacgggacgtacggtacgaaccgtcgtaacgtaccgttaacgtttacgtttaccgttaaccggcctaaaccggacgtaacgtaagggttacggttcggtaacgtaggttaccgggtagggggtttacgttaccgggaacgggtaaccgggtaaccgttacgggttccgttaacccgggtcctttacgggaccctcggaaccccggtaggtaccccgttcccggtacccccgttcggtcccgttaccgttacccgttccccg

SEQ ID NO: 90357 - DNA, 873 bp, Homo sapiens
  misc_feature: GYAE6OF02F5A4Z.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctagacacagcccaccgtggtgtcagtcgtcccaggacaacggccaggatccacgtgcctcgtacggagtattccagtttcgaacccaaaaagtaattattaacgttggttcggttaccgagtacgaaggtaacgtcgaacggccgtaacggtcccccttagtaccgttcggtacctacgttaccgtaggtcggaacggtacctaacgggtacccggtaaccggacgtacccggttaccggggtaaccttacccggttaggaacggttacggtaacctttccggttaccgtaccggtacccgttaccgtaaccggtcccggttacggaacgggtaaccgtacggggttaccggtaccccttaccggtttacgtaacgtttaccgtacggtaacgggtaccggggtaccccgtaggggttaccggaacgtacgttcggtaaacggccgttaacggtaaccgtttacgtttaacggttaccggttaacccgaccgtaaccgtaccggtaacgtacggttaacggttccggtaccgtaacggttaaccgggggtaagggtttaccgtaaccgggggtacgggtaaccgggtaaacccgttacggttacccggttaccgggtttacccgtttacgggtacgtaacccgggtacccgtaacgggtcccctacccggggttacccccgttacggtacccgttcccgttaccggtttccccccg

SEQ ID NO: 90358 - DNA, 728 bp, Homo sapiens
  misc_feature: GYAE6OF02J2P9V.21.8.A08.1.454.CMB.1.raw
  modified_base (180)..(180): a, c, t, g, unknown or other
  misc_feature (180)..(180): n is a, c, g, or t
  modified_base (232)..(232): a, c, t, g, unknown or other
  misc_feature (232)..(232): n is a, c, g, or t
  modified_base (437)..(437): a, c, t, g, unknown or other
  misc_feature (437)..(437): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacggcccttctatgacgctagacacagcccacccgtggtntacagtcgtacccgaggaccaacggcaggactccgactcgctcgtaggactnttccagttacgaacctaaaaagtattacgttacgttttggtttcgtaccagacgaacgtaatccgaacggcccgacggtcccctaggttacgtggtaccacgtcagtcggaccgacgtacggccgaacgaccgtaccgtaccgggactccgtaggaccgtataccgttctaccgtcgtccctcgacgtccgtacggagggtaacncggtacccaccgtacgttcacgttacgtacgggtacgggtccgggaaccggtacgggtacgtaggtactacgggtaccaggtaccgttagttaaccgtttaggttacctaccgacgttaccgaaggttacgtaacggttgtacggtactacgggtaggggttacggttaccgggtcggaagggttaccggaactacggtcggtcccgttaacggttacggactaacccggttaccggaccgtttcccggcccggtacccgttaccggtacttacccgttcccgtaccccgg

SEQ ID NO: 90359 - DNA, 731 bp, Homo sapiens
  misc_feature: GYAE6OF02FWS6O.21.8.A08.1.454.CMB.1.raw
  modified_base (180)..(180): a, c, t, g, unknown or other
  misc_feature (180)..(180): n is a, c, g, or t
  modified_base (530)..(530): a, c, t, g, unknown or other
  misc_feature (530)..(530): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgacgctgaacacagcccaccctcggtntcagtcgtcccaggacaacgcaggactcacctgctctggactattcaattgacctaaaaagactatacgtttggttcggttaccagtctaaggaacgtccaggcccacggtccccttgtaccttggtacacgtccagtggaccggtaccaggtaccgaccgtacgacccgttccgggaacttccccgtaggagtaacgtctttcccgtacgttccgtacccctaccgaacgttcccgttaacggaacgggacttaacggtcccgggaacccctaaccgtttaggaaccttacgttaccgtaacgggtccggggtaccccgtaagggtacgggaacgtacgttacggaacnccgttaagtaccgttaacgtagtttaccgtaaccgacaaccgtagacgtaggtacgtagtactacggtacgggtaaggggttaccgtcgggacgggtaacggtaccttacgggtccggttaccggttcggttacggtaccgtaccggtacccgaagtcccgtacccggtccccgttccggtacctaccgttcccgttcccg

SEQ ID NO: 90360 - DNA, 744 bp, Homo sapiens
  misc_feature: GYAE6OF02JA96B.21.8.A08.1.454.CMB.1.raw
  modified_base (164)..(164): a, c, t, g, unknown or other
  misc_feature (164)..(164): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (314)..(314): a, c, t, g, unknown or other
  misc_feature (314)..(314): n is a, c, g, or t
  modified_base (415)..(415): a, c, t, g, unknown or other
  misc_feature (415)..(415): n is a, c, g, or t
tcagtcgtcgctcgcacgaccggtgctcgatttagcatactctacagggggctgtgggctcaggaggcagagctctgggaatctcaccatggctggacccctctcctgcctccccctcctcactttctgcacagtcctctgacggccctcctatcgagctgacncagccacccgtggtcgtacaggtctcccccgaggaccaaacggccaggactcaccctgcctcgtggganattccattgaccaaaaggatatactttgtgtccacncgaagaatcgacggaccacggtcccctgtacgtcgtcactcctancggaggccgtagtaccgaacgtaccgaccgtccggctacccgtgaaggagtaccctttcgtccgttacgtccctaccgtacggtcctaccgacggggtaanacggggttccgacccttaccgttaggtaacccgtagtaccgtaacgggttccggggtacccggtaacggggtacgggtaacgggtaacggtacggaacgtacggtacgtacgttaacttacgtttacggtaaccgttaccgaccaaccggtactacggtaacggttcgttacgggtacgtacgggttacggggttacggttaccgggaccgggtacggggtaaccgtagttaaccggtaacccgttccgggttaccggtagtcccgggaccgtacggtcccgtaccggttccccccggtacggtacccttacccggttaccgttccccg

SEQ ID NO: 90361 - DNA, 808 bp, Homo sapiens
  misc_feature: GYAE6OF02H9VXY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctctatgagctgacacagccacctcggtgtcacgtgtcccaggacaaacggccaggactcacctgctcgtggagtattcattcgaccaaaagtaatatacgttgttggttaccagcagtacgtacaggtccacggtcccctagtactacggtctacgtcagttcgacggcctaggtccggacgaccaccggtaccgggactccccgtaggagtagtcttctcgtcgtacctccgagccgtacgacgggtacaacgtccggtaccctacccgtttacggaacgttaccgtacggtaccgggttaccgggggtaccccggtaaggggttaccggggaaacggacggttacggtaaacggtccgttaacggttaaccgtttaaacgtttacgttttaaccggttaaccgtacccgtaaacccgaacggtaacccggtaaggttaaccgggtttcggggtaaccgttaacggttacggggtaacggggggtttaacggttaccccgggtaagggggttaccgggtaaacgggtaaccggtttaccggggtaacccggttttcccgtttacgggtacccgggtaaccggtaacccgtacccggtacccggtttaccccggtacccccgggtttacggtacccgttacccggtttacccgtttaaccccgg

SEQ ID NO: 90362 - DNA, 714 bp, Homo sapiens
  misc_feature: GYAE6OF02I3PRG.21.8.A08.1.454.CMB.1.raw
  modified_base (104)..(104): a, c, t, g, unknown or other
  misc_feature (104)..(104): n is a, c, g, or t
  modified_base (179)..(179): a, c, t, g, unknown or other
  misc_feature (179)..(179): n is a, c, g, or t
  modified_base (380)..(380): a, c, t, g, unknown or other
  misc_feature (380)..(380): n is a, c, g, or t
  modified_base (414)..(414): a, c, t, g, unknown or other
  misc_feature (414)..(414): n is a, c, g, or t
tcagtcgtcgctcgcacgaccggtgctcgatttagcatactctacagggggctgtgggctcaggaggcagagctctgggaatctcaccatggcctggacccctntcctgcctcccctcctcactttctgcacagtctctgacggcctcctatgagctgacacacgtccaccctcgggtntccagtcgtccccaaggaccaaacggccaggactcacctgctcgtaggagtacttcattgaccaaaaagacttataccgtttggttggttaccagaccagtaacgtcagggccacgggtcccctgtacctggtcctatacccgagttcggaacggtcccctaggtaccgaccgacgacgttacccgggacttcccgtaagnggtaactcttcgtacctggaccctccgagcctanacgggaccagttcggaccctaccttgaacctatacgtacggtgggccccgagggtcgaacgagttacgggaaagtccgtgtaaccttacgttaaacttcggtttaaccaccgttaccgaacggtactaaccggtttagttacggtccgtaagttaccggtttaggggggttaaacttccgggggtaacgggtaggtaacccgttaaggttcggtacccgttccggttacggtaccgtaccggcccgtaacgggcccgttccggtcccccttacgggtcctacccctttcgttacccccgg

SEQ ID NO: 90363 - DNA, 896 bp, Homo sapiens
  misc_feature: GYAE6OF02HAYHM.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctctatgagctgacacacgcccacccgtcgggtatcacggtcgtaccccgaaggaaccgaaacggccgaaggtactaccgtacctcggtctccggtaggtatacgttacaacgttccgaaaaccgaaaagttaacttaacgtttacgtttggtttacggttacccgaggtacgtaaacgtaaggttaccgaccgggtacccgtaccgggtaccccccttgggttaaccgtcggtaacctacttcccgaaggtacggtaccggtacccgtacggttaaccggaccgtaacggtacccggttacccggggtaaccgttccccggtaaaggtaacgggtattaccgtttacccgtaccgttccggtaccccttaacccggtacggtacccgttaacgggaaccggggtaaccgtacggggttaccccggtacccttaaacccgtttacggaacccgttacgtttaccggtaaccggggggtcccggggaacccggttacggggtaacggtaccgggtaaggtaccggtaaacgtcgggtaaacccgttacgttaacgtttaaggtttaccgtacccggtaacccgtaaggaaaccgtacgggttaaaggtccgttaacggacgttaacggtccgggtaaggggttaccggaccggggtaggtaacccgggcgttaacggtcgttcccggtagttacggctacccggacggaacgttccgcccggtaccgtccggtacctacccgtctccccggg

SEQ ID NO: 90364 - DNA, 855 bp, Homo sapiens
  misc_feature: GYAE6OF02J1XIN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctctactttctgcacagtctctgacggcctacctatgagtctagacacgagcccacccgtcggtgtacgagttcgtaccccgaacggaaccgaaaccgggcctaagggacttccgaaccctggacctcgtacggacgtaacttaccgtattaccggaaacccaaaaaggttaacttaaactttcccggttttaggtttaccggtttacccgaacgtaccgtaacggtaacgttaccgaaccggcccgtaaccggtacccccttaggttaccgtacggttacctacgttacccgagtacggtaccggaccgtacggtacggaaccgtaccgtacccggtacccggggtaccttaccccggtaggaaccgtaacggttaccttccgtaccgtccgtacccgtaccgaacggtccgttacggaacggtaccgtagttccggtacccttacgtaacggtacctaacgtacggtacgggtaccgggtaccgtacgggttacggaccggtaagtacggtaacgggtacctaggtaaccttacgttacgttacggtaacctaccgaacgtacgtaacgtacggttacggagtaccgtagttcgggtaacgggttccgtacgggaaccggaacgggttaccctagggttaccgaccgggtttcgttaaccggttacgacccggttacgtacccggccgtttaccggacccccgttaggtacccgtacccgttacccgtttccccgg

SEQ ID NO: 90365 - DNA, 693 bp, Homo sapiens
  misc_feature: GYAE6OF02H31D3.21.8.A08.1.454.CMB.1.raw
  modified_base (127)..(127): a, c, t, g, unknown or other
  misc_feature (127)..(127): n is a, c, g, or t
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggctcaggaggcagagctctgggaatctcaccatggcctggacccctctcctgcctcccctctcactttcngcacagtctctgacggcctctatgagctgacacacgccaccgtcggtcgtcagtcgtcccgaggaacaacggctaggactcacctgctcgnggatattcagttcgaacaaaagtattattacgttgttcggttccagcgaagaacgtcgacggaccacggtcccctaggtacgtcggtcactacgtatacgggacggccgtacggtacgaccgaacgtccggtaccgggactccccgtaaggacggtaacgtactcctcgtacgtcccgtacaggtaccgtacggaacggtacgtacgggtccgacccgtacgttagaactttacgacgtacggggtccgggacccgttagggtacgacgtacgtagaacggtctacggtaacttacgttaggttacgtaccgacgtaacacggtaacgtggttaacggtgtaccacggttacgggtacggggttacgtccgggaacgggtacgaacgtacggttccggtaccggttcgtaccggtacgaccgtacccggaggtccctacccgggtccccttacgggcttaccgtccgttaccccg

SEQ ID NO: 90366 - DNA, 649 bp, Homo sapiens
  misc_feature: GYAE6OF02IW6NE.21.8.A08.1.454.CMB.1.raw
  modified_base (153)..(153): a, c, t, g, unknown or other
  misc_feature (153)..(153): n is a, c, g, or t
  modified_base (170)..(170): a, c, t, g, unknown or other
  misc_feature (170)..(170): n is a, c, g, or t
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (436)..(436): a, c, t, g, unknown or other
  misc_feature (436)..(436): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagctgggttttccnccttgcttcttttaagnggtgtccagtgtcaggcgcaacgtgggtggagtcgtggggggaggcagtgggtccagccgtgggacggtcccngacgcctctcctgtgcagcgtctggattcngtatccggcttcctttccatcgctacgtcgggtcccgcaggcctccgagggaccgaagggggtctggggaggtggggnggtctagttntcgtggtangaagtggaggtgaaggatacttattacttcgagtacctcggtagggaacggtcctattccaacctntaccgtaccgagaacaaccgtaagtaccgaaccctaaacgaacctaacctacgttagtaaccttcgtaactaacggttaccgacccggtacgttaggaacgtaccggacccggaaggtaaccgacgggtacttagttacgttactttacgtagggtaccgtagttacgtttggctagggtccgggaccgacgggtaccgttcggacctcccgg

SEQ ID NO: 90367 - DNA, 739 bp, Homo sapiens
  misc_feature: GYAE6OF02I4WMV.21.8.A08.1.454.CMB.1.raw
  modified_base (121)..(121): a, c, t, g, unknown or other
  misc_feature (121)..(121): n is a, c, g, or t
  modified_base (172)..(172): a, c, t, g, unknown or other
  misc_feature (172)..(172): n is a, c, g, or t
  modified_base (707)..(707): a, c, t, g, unknown or other
  misc_feature (707)..(707): n is a, c, g, or t
tcagtcgtcgctcgcacgaccggtgctcgatttagcatactctacagggggtggctcaggaggcagagctctgggaatctcaccatggcctggaccctctcctgctcccctctcactttcngccacagtctctgacggcctactatgacgctcgacacagcccaccgtggtntacacgtctacccgaggaccaaacggcctaagctaccaaccttgcctcgtaggacgtactttccgaatttcggaacctaaaaaggtacttacttaccgtttgttaaccggttccagtaccgtaagtaacgtcgacggtacccgaacggtccccctagtaccgtggtacctactccgtagtcgacggtaccgtacggtacgtaccgaacgtaccgtaccgggtacctcccgtagtaaccgtagtactttccgtacgtacgtccctacgtcgtaccgttacgacgggaactggtaccgtacccgtaccgttgaaccgtttacgtacggtacgggttacgggaccgtaacgggtacggtaaccgtagtcggaacgtacttaggaaccttacgttagttacggtacaccgtaacacggtatacggttacgtcggtaacctagtaccggtaacggggtcttcggggaagtaccggtaacgtaggtccgtaccgttcgtacggtcgaccggtcggtaacgtcgtccccggacccggttacnccgtaaccgtttcctacccggtccctaccccg

SEQ ID NO: 90368 - DNA, 718 bp, Homo sapiens
  misc_feature: GYAE6OF02H6SMS.21.8.A08.1.454.CMB.1.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtgtcagtcgtccccaggaccagacggccaggactccactgctcgtgcagatggactgaccaaaagaatatgactttattacggtaaccaacgaagaacgaccgaaggcccacggtcccccgtgtgttagtgaattaataataaagacctaacnggaacgacggtcccctanaaggacgtactcccgtggacgccgtatttctcgtcggtaccttccgacgtctcggaacgggaccaggcctaacggttacgtacggtttaacgaacttacgacgtaacgtaggtaaacgtccgtaggacgaaggtaacgggacggtaacggcgtagtaaccgttaatttaccgtagttaacccgaaaacgtacgtaacgtacgtaagggttaacgtaacgggttaccttaaggtaacgggtttgggggtttacgggtttacccgggggaacggggaaccgggtaaacccggtaacggccggttaccggtaccccgtttacccggtaacgggtcccgaaccggtaccccggtacgggtcccgttacccccggg

SEQ ID NO: 90369 - DNA, 793 bp, Homo sapiens
  misc_feature: GYAE6OF02GM04M.21.8.A08.1.454.CMB.1.raw
tcagtcgtcgctcgcacgaccggtgctcgatttagcatactctacagggggggagaggagcccagcactagaagtcggcggtgtttccattcggtgatcagcactgaacacagaggactcaccatggagtttgggctgagctgggttttcctccttgctcttttaagaggtgtccagtgtcaggcgcaactggtggagtcgtgggggagcagtcggtccaggccgtgggacggtcccctgacgcctctcctggtcgcagcgtctggattcgagtactccggcttcctttgccctattcgcctacgttcggggtcccgccgtacgggtccctcccggaaggggaccggtaaacggggggccttagggggaacgggttggggtacgggtaccgtaagttacgttcggttagggttaacgtggtaagttggggaagttacggaaggaagttaacgtttagtttaaacgtttccgaaacggttacccgttccgggtaagggtaacgggggtcccgttaacgtttacccgaaccctaactttcccgtaacccgtaaggtaaaccggtaaccgtaacgtaccggaaccctaaaaaccggaaaccctaaccgtaacgttacgttaaccttaccttaacgtaaacgtaccggtacccggtaccgtaaggacggtaaccggcccggaaacggaccgtaacggtaccgttagttacgttaacgttaacggtacggttacgtacggttcgtttacggtcgtaacggttccgggacccgtaaccggggtacccgtcggttacccg

SEQ ID NO: 90370 - DNA, 838 bp, Homo sapiens
  misc_feature: GYAE6OF02G3SKE.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacgcctcctatgagctgacacagccctacctcggtgtcagtcgtaccccaggaccaaacggccaggactccacctgctcgtacggagtcttacagttacgaaccaaaaagtaattaattacgttttggttacggttacccaaggtacctaaggtaacgttaccgaacgggtacccgaaccgggtccccccttagttaccgtacgggttcctaacgtacccctagttacggaaccgggtaccctaacgggttaccgaaccggacccgtaccggtaccccggggtaacttcccccggtaggaacggtacggtattttacccgtcgtcccgtcccttacccgaacggtcccttaaccggaacgggggtaacaccggggttacggacccccttaacggtttacccgggtaaaccttacgttacccgggtaacggggtaccgggggaccccggttaaggggtaacggggtaccgtaaaggttaacgggaacggtaccgttacggtaaacctttacggtttaaacgtttcgttaaaccggacctaacccgaaggttaacgtacgggttaaacgttcggtaacttacggttacgggttaacgggggttacgtacgggtacgggacggtaacgtacggttcggtaaccgtcgtacggcgaccaccggtacgccttccggccccgtagtccgttcctccgttacccg

SEQ ID NO: 90371 - DNA, 712 bp, Homo sapiens
  misc_feature: GYAE6OF02FKVES.21.8.A08.1.454.CMB.1.raw
  modified_base (424)..(424): a, c, t, g, unknown or other
  misc_feature (424)..(424): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctcgtgacggcctcctatgagctgacacacgcccaccctcggtgtccagtcgtccccaggaccaacggccaggactccacctcgcctcgtggacacttcattcgaccaaaagtactatacttgttcgttccgagcgagacgtcgacggccaggcccctagtaccgttgtcagttccatcggtacgccgtacggtcgaccgacctaccgtccgggtacttccccgtaggacgtacggtactttcctaccgtcggcccctacccgaagtcccgtacggaacggggtaccncgggttaccggacccctaccggtttacgacctacgtccgtaacggggcgggggttaccccctaggggtaccggtaacggactttacgggaacgtccgttacgaaccgtttaactacgtttacggttaccgacctaacccgagtaacgtacgttagggtacgtacgtaaggtaccggttagggggtactccggggacggaacgggtaccgtaagttccggacccggtcgttacgggacctaccggccaaccggtcctaccggccccgttggccctacgttccgtacccg

SEQ ID NO: 90372 - DNA, 679 bp, Homo sapiens
  misc_feature: GYAE6OF02F2ALX.21.8.A08.1.454.CMB.1.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagttcgtccccgaggaaccaaacggccaaggactccacctgcctcgnggatatcattgaaccaaaagaatatacttgttcgtcagnagaagtcgacggccgacggcccctgtaccgtggtccactccgagtggacggccgaggtccgacgacaccgtccggactcccgaggacgagtacttctcgtcgtccctccgagtcccgtacggaacgggacgtacgggtcgcccctaaccgtttcggaacttacgtaccggtacgggtccggggacccgtacggggtacgggacgtaggtaacggacgtcgtacgtaaccttaagtacgtttacgtaccgacaaccgagacgtacggtagtacggtactaggtacggtacggggttacgtacgggtacgggtaacgggtacggtacggtcggtacccggttcgttacggtacgtaccgtacccggacgtccggtcccggtacccggtcccggttccgtacgttcccgttaccccg

SEQ ID NO: 90373 - DNA, 672 bp, Homo sapiens
  misc_feature: GYAE6OF02FTO34.21.8.A08.1.454.CMB.1.raw
  modified_base (230)..(230): a, c, t, g, unknown or other
  misc_feature (230)..(230): n is a, c, g, or t
tcagtcgtcgctcgcacgaccggtgctcgatttagcatactctacagggggctgtgggctcaggaggcagagctctgggaactctcaaccatggcctggacccctctcctgctccccctcctcactttctgcacagtctctgacggcctcctatgagctgacacagcccacccgtcggtgtcacgtcgtccccaggaccaaacggccaggtatccaccgtgctcgtgganacttcagttacgacctaaaagattactacgttgttcggttaccagcgaagtaagtcaacggccacggtcccctgtacgtcggtactacgtccgtaatcggacgccaggtacacgtaccacgtccgggtactcccgtagagtacgtacttacgtctcgtccctacacgtcgtacggaggacctaggtcgtaccctacgttacgtactacgtcgtacggtccgggaccgagggtacggacgtagtacggaacgtcgtagtaccttacgtagtttcgtacgacaccgacgtactacgttagtcggtactacgtcggtaaggggtctacgggtcgggtaacggtccgtaacggttccgaccggtttccgtacggttaccgaccggttcccgaacggttaccgttcccggaccccgttaccgacccgttaccgtaccgttacccccg

SEQ ID NO: 90374 - DNA, 816 bp, Homo sapiens
  misc_feature: GYAE6OF02I75RC.21.8.A08.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctggacccctctcctgccttcccctcctcactttctgcacagtctctgagcctctatgagctgacacacgcccacccgtggtgtcaggtcgtccccgaggacaaaccggccaaggatccaccgtgctcgtaggatnttcgattcgaaccaaaagtaacttattactttggtttcggttacccagtaccgaaggtaacggtccgaacggacccgaacggtccccgttacggttaaccgtcggttaccaacttcccgaagttcgggaacggaccgtaggtaccggaaccggacctaccggtaccggtaactcccgttaggaacgacgttacgttcctacgtccgtaccctccgacgtccgtacggacgggtactacgggcgtccctacgttcggacttacgtacgtcggttaccgggaccgtacgggtacggacgtacgtacggaccgtacgtcgtaacttaacggttacgtttaccggtaaccgtaaccggtaacctaacgggtaacgttaacggttacgggtaccgttaacggtaccggttaacggggttaagggggttaaccgttacgggggaaccgggtaaccgggttaaccggtacgggttccgggttaccggtttccgggttacggtaccgtacccggaaccgggttaccggttacccgttaccccgggtaccccgttaacccgggtccccgttaaccggttcccctttaacccccggg

SEQ ID NO: 90375 - DNA, 491 bp, Homo sapiens
  misc_feature: GYAE6OF02FJSH8.21.8.A08.1.454.CMB.1.raw
  modified_base (104)..(104): a, c, t, g, unknown or other
  misc_feature (104)..(104): n is a, c, g, or t
  modified_base (126)..(126): a, c, t, g, unknown or other
  misc_feature (126)..(126): n is a, c, g, or t
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (459)..(459): a, c, t, g, unknown or other
  misc_feature (459)..(459): n is a, c, g, or t
tcagtcgtcgctcgcacgaccggtgctcgatttagcatactctacagggggctgtgggctcaggaggcagagctctgggaatctcaccatggcctggacccctntcctgctcccctctcactttcngcacagtctctgagcctctatgagctgacacagccacctggtntcagtntcccaggacaacggcaggatcacctgctcnggatctcattgccaaaagactntacttgtggtccagcaggaatnaggccaggtcccctgtacnggtcatccatgagccagtcgagcatcggatccnganagtntcncgtgcctcgaagtctacaagggcagttgaccacgttgactatcagcggggaccaggtgacgntgaanctgactatgttagtcncacgagactagngtcgtcattgaaggggtcttcggcggacggacttaggtcaccggtcttggacngcccaggccttgccccttggcacgtcttcccg

SEQ ID NO: 90376 - DNA, 780 bp, Homo sapiens
  misc_feature: GYAE6OF02I8MRJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccacccgtcggtcgtcagtcgtaccccgaggaaccgaaaccggccaggactccaccgtcgtctcgtggacgtacttcaagttacggaacccaaaaaggtaaacttattacgtttggtttcggttaccacgacaaggaacgtcgaggccgacggtccccttgtacgtcgtctactccgagtggaccggtccgaggtaccgacggaccaccggtaccgggacttacccgagacggtactacttcctacgtcgtccctacgacgtcctacggacggaccgtacggtcgtacccctaacgttcgtaacttacgtacggtcgggtaccgggccggtagggtacggacgtagtacggaacgtacgtacgttaactacgttactacgttacgacctacgtacgtacgtaacggttacgtaggtaccgtacgttaacgggtacggggttaacggttaccgggtacgggtaacggttaaccggtacgggtttacggtaaccgggtttcccggttacgggttaccgtaaccgggtacccggttaaacccgggtccggttaaccccgggttaccccccggttaccggtaccccggttacccggtttaccccggtttacccccggg

SEQ ID NO: 90377 - DNA, 706 bp, Homo sapiens
  misc_feature: GYAE6OF02FOPUP.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctcactttctgcactgtctctgaggcctcctatgagctgacacagcccaccctcggtgtcagtcgtccccaggacaaacggccaggatcactgctctggatattcattcgaccaaaaagattatacgtttgttcggttccagcaagaagtcaggccacggcccctgtactggctatccatgacggccagtccgacaccacgtccgggatccccgtgacgagtacttcctactcggcccttccacgccgtacggacgggactacggtcgggtaccctaccgtttagtaccgttagtccgtaacggggtccggggtaccccgtacggggttacgggacggtaagtacgggaaacgtaccgtacgtacgttaacttacgtttacgttaaccggacctaccgtaaggtactaagggttacgttggtaccgtaacggtacggtacgggggttaagtcccgggagggtaccgggtaaccgttacggttaccggttaccccgggttcggtttaccgggtctaacccggtacccgggtaacgcccggttccccggtaccccccggttgggtacccctacggttcccgttcccccggg

SEQ ID NO: 90378 - DNA, 696 bp, Homo sapiens
  misc_feature: GYAE6OF02I9M1S.21.8.A08.1.454.CMB.1.raw
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
tcagtcgtcgctcgcacgaccggtgctcgatttagcatactctacagggggctgtgggctcaggaggcagagctctgggaatctcaccatggcctggacccctctcctgctccccctctctactttctgcacagtctctgacggccttcctagtgagctagacacacgcccacccgtcggtagtcaggttcgtccccgaggaccaaaccggccgaggactccaccgtgtcctacgtagggatacttacgattcgaaccaaaagtaattacgtacgtttcggttcggtaccagaccgtaaggaacgtcgaacggcctacccggcccccttggtaaccgttcggtaactcgtacccctaggtcggacgtacccgtacgtccggtaaccggcctaacgggtcccgggaacttccgaggacgtagtcttctccgtanccctccacgctacggacgggtacacggtccgaccctacgttcgactntcggacggtaccgggccgtaggtgacagtacgagacgtactacgttacttacgtggttacaccgtactacgggaactagggtacgtcggtacacggtacgggtacgggtacggtccggtacggacggtaaccgttacggtacgtacccggttcgttacgacggtaccgccgaacggtcctaccggtcccgtaccgtacgtccgtacccttccccgg

SEQ ID NO: 90379 - DNA, 1004 bp, Homo sapiens
  misc_feature: GYAE6OF02IC9Q3.21.8.A08.1.454.CMB.1.raw
  modified_base (123)..(123): a, c, t, g, unknown or other
  misc_feature (123)..(123): n is a, c, g, or t
  modified_base (127)..(127): a, c, t, g, unknown or other
  misc_feature (127)..(127): n is a, c, g, or t
  modified_base (492)..(492): a, c, t, g, unknown or other
  misc_feature (492)..(492): n is a, c, g, or t
tcagtcgtcgctcgcacgaccggtgctcgatttagcatactctacagggggtgggctcaggaggcagagctctgggaatctcaccatggcctggaccctctcctgctccccctctcactttcngcanagtctctgacggcctcctatgagtctgacacgagccctacccgtggtgtcagtcgtcccaggaccaacggcaggactccactgcctcgtggagtacttctattcgaacctaaaaagtacttagtttaaccgttggttacggtttacccagtaccgtaaggtaaacgtccgaacgggtccccgaacggtccccccttaggttaaccggttggtacctaaacgttccgtaagtcgggtacggcccgtaaacggttccggaaccgtaccgtaaccggttccccggggtacttacccgagggaacgttacggttaaccgtttccgtgtccgtaaccccgtcgaacggttccgtaacggaggggtaaccngggtcccggtaaccctaccgttttacgggaaacttacgtccgggtacggggtacccggggtacccgggttaacgggtaccgggttaaaccggtacgtaacggttaaccgtaccgggttaaccggttaaccgttttaaaccggtttaacgtttttaaccgggttaaccccgtacccggtaaacccggttaacgggtaaacccgttaacggggtttaccgggttaaccggggtaccggtttaaccgggttaacccgggggttaacgggggggtttttaaccgttacccgggggggtaaaccggggttaaacccggggttaaaacccggtttaacgggttacccgggtttaccccgggttttaccgggtttaaccggggtaacccgtaccccgggttaaccccggtaaacccggggttcccgttaacccccggggtacccccggttttacgggtaccccgtttaaccccggttttccggtttaccccccgggttccccccggttaaccccccggg

SEQ ID NO: 90380 - DNA, 802 bp, Homo sapiens
  misc_feature: GYAE6OF02JLES1.21.8.A08.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcatactctacagggggctgtgggcgtcaggaggcagagctctgggaagtctcaccatggcctggacccctctcctgctccccctcctcacctttctgcacagtctctgaggcctcctatgagctgaccacagccaccctcgggtacgtcagtcgtccccaggaccaaacggccaggatcactnctctgagtatcattcgacctaaagaattatacgttgttcggttacctagacagtaacgtcgacggccgaaggtccccctagtacctacggtacaacgtcctaattcggacggtaccgtaggtaccgaccgtaaccaccgtacccgggtactacccccgttaggaacgtacgtaacttccgtacgtccggtaccctaccgtaacggtcctaccggtaacggggtaccgtaacgggtaccgtacccgtaccgttacggtacgttacgtaccggtaacgggtccggggtacccgaacggggttcgggaacgtacggtacggtaacgggtaccgtacggtaaccgttaccgttaacgtttacggttaacccggtacctaaacccgtaggtaaccttaacgggttaacggttcggtaaccgtaacggttaccgggtagggggtttaacgtccggggtaccgggtaacggggtaccggtaacggttaccgggtacccggttaaccggtttggtaacccggacggtaaccccggtagggtaccgttaccccgggtccccgttaacggtcccgtacgttcccgttacccggg

SEQ ID NO: 90381 - DNA, 747 bp, Homo sapiens
  misc_feature: GYAE6OF02GD8BI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctgctctggagattcatgaccaaaagaatatacttgttggttccagcagaacgtcaggccacggccctgtactggtcatccatggacgcagtacgacgacacgtccgggactccctaggagagtacttcctcgtcgtcctccgaagtcctacggaagggtactacggtcgaccctaccgtttcgaacttacgtacgagggtccggggcccgtaagggttcgggaacgtagtagggaacgtccgtaggtaaccttaacgttaacgttttcggttaaccgacccgtaaaccgtaacggtacgtaacgggttaagggtttaccggttaacgtaacggttacgggttaaacgggggggttttaacgttcccggggggtaaccggggtaaccggggtaaccgttaacggggttttcccggaaccccgggttttccgggtttaccgggtacccggttaacccggaacccggttaacgggtcccgttacccgggtaccccccggttccgggttaccttaccccggtttcccgttacccccggg

SEQ ID NO: 90382 - DNA, 933 bp, Homo sapiens
  misc_feature: GYAE6OF02HQ8GA.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctctatgagctgacacagccacccgtggtgtcagtcgtaccccgaggaaccgaaacggccaaggactaccaccgtcgcttcgtaggaacgtatttacctaagtttacgaaacccaaaaaaggtaacttaacttaacgttttacgggtttcggtttacccgaagaccgtaaggtaaacggttacgaacggggtaccccgaaccgggttacccccgttagggttaaccgttcgggtacctaacttaccgaagtacggacggaccctacggtaccggaaccgaccgtaaccggtcccgggtaacctcccggtagaacgtacgtactttccgtactccggtccctaccggacgttaccgtacggtaacggggtaccgagggttcccggaaccctttaccggttaacgtaccgttaacgtccggtaaccgggggtccgggggtaaccccggtttaaaggggtaacgggtaacggtaaacgtagggtaaccggtacgttacggtaaaccttttaacggttaaacttttacccgggtaaccaacccgtaaacccgaacggtaaaccgttaagggttaaccggttaggttaacccgtaacggttaccggggttaagggggggtttaccgttaccggggtaaagggggtacccgtaaaacgggttacgttacccggtaacgttttcccggggtttacgaaccggtaacccggtacccggtaaccggtacccgttaccccgggaccccgttacggtaccccgttacccggtttaccgtttcccccgttaaccccgttccccc

SEQ ID NO: 90383 - DNA, 754 bp, Homo sapiens
  misc_feature: GYAE6OF02H66WC.21.8.A08.1.454.CMB.1.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgccaccgtcggtgtcgagtcgtcccgaggaccaaacggcaggatcacctgcncgtggagtnttacattcgacaaaagtatatacgttgttgtccagacaagtagtacgacggccacggccctgtcgttggtacacgtaccngttacggacggaccgtacggtaccggaaccgtaaccgaccggttaccgggacgttaccccgaggtaacggacgttaacgtttcctaccgttcgtacctcctacggtctacggaacgggtacgtacgtcggacccttacgtacgtaccgttactaccgggtacgggtccggggtaccgacgggtacgggtaacgaaggttacggaacgtaggtacgtaaccgtttaagttacgtttaacggttaccgaaccggaacgtaacggaacgttagttacggttcgtaacgtaggttacgggttaaggggttccgtaacggggaacgggtacgggtaaccggttacgggtacggttaacccgcggtttaccggtacggacccgttaaccgaacgggttccggtacccggtaccccggtttcccgtaccgttaccccggttcgtttaccccccgg

SEQ ID NO: 90384 - DNA, 670 bp, Homo sapiens
  misc_feature: GYAE6OF02HALE5.21.8.A08.1.454.CMB.1.raw
  modified_base (262)..(262): a, c, t, g, unknown or other
  misc_feature (262)..(262): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagttctctgaggtcctcctatgagtctgacacagcccacccgtggtgtcagtcgtcccaggacaaacggccaggctcacctgctctggatattcattgaccaaaagatatacttgtgttccagcagatcngccacggcccctgtactggtcatccagtcgagcgagtcgacgacaccgtccggaattccccgtagacggagtactttcctcttccgtccctccgaagtccttacggacgggtacgtaggtcggaccctaccgttgaaccgttactacgagggttcggggcccgtaagggtcgggaaccaggtacgaacggtaccgtagtaccttaacgtttatttacggttacgtaacctaaccgtagaaccgttaggttacggttacggtactacgtacgggtacggggttaacgttcggggaacgggtacgggaaccgttaggttcggttacccggtacggttcggtaccgaaccggtacccgaagggtcccttacccggccccgttaccggtacgtacccgttggttccccccgg

SEQ ID NO: 90385 - DNA, 732 bp, Homo sapiens
  misc_feature: GYAE6OF02IRVT5.21.8.A08.1.454.CMB.1.raw
  modified_base (119)..(119): a, c, t, g, unknown or other
  misc_feature (119)..(119): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
  modified_base (435)..(435): a, c, t, g, unknown or other
  misc_feature (435)..(435): n is a, c, g, or t
  modified_base (471)..(471): a, c, t, g, unknown or other
  misc_feature (471)..(471): n is a, c, g, or t
tcagtcgtcgctcgcacgaccggtgctcgatttagcatactctacagggggtgggctcaggaggcagagctctgggaatctcaccatggcctggacccctctcctgctccccctcctcncttctgcacagtctctgacgcctcctatgagctgactacacgccacctcggtctcagtcgtcccccaggaccaaacgcccaggacgtcacccttgcctcgtgagtnttcncttagaccaaacgtaagtactcttagttgtcctagacgtaagtacgcgtacggcccacggtaccccctggtactacggtctaactcctagtacgcgccgtagtcggaccgtacnccggtcccgggactcccgagtacgacgttactctcgtcnccgtacacgcgtacgaaacgggtcctggtacgtcccgtactccgtaacgtacngggtaaccggtcggtccggacggtaggccggttaanaccggagtaccgtacgtacgttaaccgtacttaacggtacccggtaacaccgtaaccggttcgaaacgttacgggttcggttacggacgtttagggtaaccgggggtttgggtaacccgggttagggtaaccgaacggttaacgtccgttaccgttccggttacgtacggttaccggccggttaaccggccgggttaacccctttccccggtacgggttaccctacccgttttccggtttacccctaccccggttaccccc

SEQ ID NO: 90386 - DNA, 837 bp, Homo sapiens
  misc_feature: GYAE6OF02GW0NU.21.8.A08.1.454.CMB.1.raw
  modified_base (723)..(723): a, c, t, g, unknown or other
  misc_feature (723)..(723): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctcgtgacggtccttcctagtgagtcgtagaccacgtacgcccctacccgtcggtcgtaccaggttccgtaccccgaagggaacccgaaaccggcgaaacggtactcctaccgtgtcttacggtaggactacttactaacgttacgaaaccgtaaaaagtaattacgtttacgtttaggttacggttaccgacggtacgaacggtaacggtacgaaccggtacccgtaacccgggtcccccgttaggttacgttacggtaccgtaacgtacccgtaagtaccggaaccggtacctaacgggttaccggaaccgtaaccccgtaaccggtacccggggtaccttaccccggtaaggaaccggtacgttacctttaccgtccgttacccgtacccgtacccggtaagtcccgtacggtaacggggtaaacgtccgtaccggggtaacccttaacccgttagtaacccgtagtaccggttacggggtaccgggaacccggtaggggtacggtaaccggtagtacggaacgttaccgtagtaacttaacgttagttacgtaccaccgtacgtacgaacgtcggtagtcgtanacggtcgggttaggtacgttcggaacggtacgtacgtacgtccgtaaccggttgtacggcgacgtaccgtacggtccgtacccgtaccgtcctaccgttaccgtccgttacccg

SEQ ID NO: 90387 - DNA, 763 bp, Homo sapiens
  misc_feature: GYAE6OF02IECJB.21.8.A08.1.454.CMB.1.raw
  modified_base (138)..(138): a, c, t, g, unknown or other
  misc_feature (138)..(138): n is a, c, g, or t
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (573)..(573): a, c, t, g, unknown or other
  misc_feature (573)..(573): n is a, c, g, or t
tcagtcgtcgctcgcacgaccggtgctcgatttagcatactctacagggggctgtgggctcaggaggcagagctctgggatctcaccatggctcgggaccctctcctgcctcccctctactctttctgcaactgtctntcggacggcctcctagtgacgtctgacacgcgccctaccgtcggtagtcngtcgaccgagaacaacggnaggactcgactcncgtcgtaggacgttntactagtacgaaacaaaacgttatattacgtttagttcggttaacacgtacaagtaacggtaccgaacgggtaccgaaccccgggttccgtacgtttacgtacgggtcctacaaccgagtcggtaacgggcctaacggtccgaaccgacgtaccggtacccggtaacgttcccgaaggggtactaccgtatttccctggtacccttccgcctacggtccgaacgtacggtaacgtctaacggggtacccttacgggttactacgtacggtacggtcgggtaccgggaccgttaggggagtaccgtagtacggaacgtcgtaactacgttgtttaaacncgttaccgtaacgccgtataacgtagggttaactagggttacgtaaggttacgggggtaagggttagggtaccgggggaaggtacgggtaacgttacgggttcggtccggtttacgggccctacgggtaaccggttccgtacgaccggttcccgaccggtccggtaccttccgggttaccttcccccggg

SEQ ID NO: 90388 - DNA, 717 bp, Homo sapiens
  misc_feature: GYAE6OF02H6LCB.21.8.A08.1.454.CMB.1.raw
tcagtcgtcgctcgcacgaccggtgctcgatttagcatactctacagggggctgtgggctcaggaggcagagctctgggaatctcaccatggcctggaaccctctcctgcctccccctcctcactttctgcaacagtctctgaggcctcctatgagctgacacacgcccacccctcggtgtcgagtcgtcccaggaacaaacggccaggactccacctgctcgtggagtattacaagttacgaacctaaaaagtaattacttaccgtttaggtttcgggttaccagtacgaagaacgtcgaacgggccgaaccggtcccctagttacgtcggtacacgtccaagttcggacgtcccaggtccgaccgtacacgtccggactccgtagagagtctcgtctcgcctcgtagcacgaggacgaggtccgaccctacgttagacttagtacgacgggtccggggacccgagggtacggaacgtagtaggaacgtccgtaacgttaacgttaacgttaatttcggtaaccgtacaaccgaacgtacgtaaggtacgttaggtacgtacggtagggtaacggggtagttccgggaacgggttaacgggtaaccgttacggttaccggtacccggtttccggttacggtaccgaaccggttacccgacggttcccgtacccggcccccggttcggtaacccgttaccggtccccgtttacccgg

SEQ ID NO: 90389 - DNA, 771 bp, Homo sapiens
  misc_feature: GYAE6OF02F9F46.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgccttccccctcctcactttctgcacagtctctgacggcctacctatgagctgacacacgcccacccgtcggtgtcagtcgtccccgaggacaacggcaggctaccaccgtgctcgtggatattcattcgaacaaaagtaatattacgttgttcgtaccagtacaagtagtccgaggcccaacggtcccctaggtaccctggttacactaccgagttcggaaccgtccgaggtaccgaccgactacccgggtcggacctccgtaggacgtacgttacttctacgtacgataccctacgacgtccgtaacggacggggaactcggttacccgggacccttaaccgggtttacgacgtttacgaccggtacggggtcccgggtaccggtaacggggtacggtaacgtaacgtacggaaaccggtccgttaggtaaccgtttaacgtttacgttaccggttaaccgaccctaacgtacggttaccgtaaggttaccgggttagtaacctggttaacggggtaagggttaccgggttaccggggaacggggtaaccggttaccgtaaacgggttcccgtaccggtttaccggtgggtaaccgaccggttaaccgaccgggttacccgtaccccggttcccggtaccggtccttaccgtttcccccgg

SEQ ID NO: 90390 - DNA, 660 bp, Homo sapiens
  misc_feature: GYAE6OF02JUUPA.21.8.A08.1.454.CMB.1.raw
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
tcagtcgtcgctcgcacgaccggtgctcgatttagcatactctacaggggggaggaggagcccagcactagaagtcggcggtgtttccattcggtgatcagcactgaacacacgaggactcaccatggagtttgggctgagctgggttttcctccttgcttcttttaagaggtgtcagtgtcagcgcaacgtggtggagtcgtggggaggcacgtggtccagccgttaggggacgggttcccctgacgtccctcttcccgtagtcgctagcgttcnggtaattcgagtacgtcggcttacccttgcctagtcncgacgtttcgggcccggacctacgggcctccgtacgggaccgaagggggcctagggacgggtggggtcggcgtaaacttgtacgttggtagtgtacgtaggtaagtgaagacgattagttattcgagtacgtaccggtaggaacggacgactaccgactactctaccagacgacaactacgaccaacaacgaacatacgtattaccttaacgaacgttaccgaccgtaccgacgacggtacgaccgaccggaccgacgtacgattacgttacgttacgtagttacgtacgttacgtttacggttacgtaggttaccggtaccggtacggtaacccgtacggtaccgg

SEQ ID NO: 90391 - DNA, 790 bp, Homo sapiens
  misc_feature: GYAE6OF02H2HJK.21.8.A08.1.454.CMB.1.raw
  modified_base (129)..(129): a, c, t, g, unknown or other
  misc_feature (129)..(129): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgaggccctcctatgagctagaccacacgcccacccgtcggtgtcgagttcgtcccccgaaggaaccgaaacggcaaggactaccacctgcctacgtggacgtattcacgttacgaacctaaaaagtaacttaattacgtttggtttacggttaccaggactaaggaacgttacgacggtccccgaacggtcccccgttaggttaccgtggttaccaacttacccgtaaggtcggaccgggcccgtaacggttacccggaaccgtaacccgtaaccggtaccccgggaacctttcccgaggaacgtacgtactttaccgtcccgtacgtcccgtaccgtagtcccgtacggaaccgggtaaccgtagggttcccggaccctaaccgtttacgaacgttacgtccggacggggttccgggaccccggtaggggtacggtacggacgtaggaacgtcgtacgtaacgttaacgttacgttacgttaaccgaccaacgtacgtaacgtaggttacggtcgtacgtagtacgggtaggggtacgtccgggacgggtaacggtacgtacggttcgaccgttcgtttaccggcgtaaccggaccgtaccggtccgtacccgttccccggtacgttacccgtccgttccgttaccccg

SEQ ID NO: 90392 - DNA, 830 bp, Homo sapiens
  misc_feature: GYAE6OF02GSW67.21.8.A08.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctcctagtgacgctagaccacacgcccacccttcggtgtccagtcgtccccaggaaccaaaccggccaggactcacctgctcgnggacgtattctattcgaaccaaaaagtaattacgttacgtttggtttcggttaccagaccaaggtaacgtacgacgggcccacgggcccccttaggttacgtcgggtctactccgagtacggacggccaggtccgaaccgtactaccggtcccggacctacccgtagaacggtatactttcctacgtccgtcctaccgacgtcccttacgggacgggtaacgtacggtcgaacccgtaccgtttacgacttacgtcgaccggggtcggggaccccgaagggtcggtaacgtacgggtaaggtaaccgacgttaccggtaaacgttaaccgtttagtttaccggttacccggaaccgaaacccgtaacgggtaaccgttagggtttaaaccgggttcgggttaacctacggggttaacggggttacgggggttaaccggttccggggggtaaacggggacccggggttaaccgtaccgggttaccggttacccggtttacccgggtttagtaacccggacccggtaacccggtacggttccccggtaccccggttaccccgttaccgggttacccttccccggttaccgtttaccccccggg

SEQ ID NO: 90393 - DNA, 711 bp, Homo sapiens
  misc_feature: GYAE6OF02GEVR8.21.8.A08.1.454.CMB.1.raw
  modified_base (246)..(246): a, c, t, g, unknown or other
  misc_feature (246)..(246): n is a, c, g, or t
  modified_base (528)..(528): a, c, t, g, unknown or other
  misc_feature (528)..(528): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtcctcagtcgtccccgggaacaaacggccaggatcacctgctcgtggagatgctattcgaacctaaaaatttnttgttttttggaacctgctaagagtcaggcctacggcccctgtgtggcatccagtgaggacaggacgaccgtaccgtccgggactcccgtagagtacgtattcctacgtcggacctaccgaacgttacggacggggtcggtacggccgtacgttgtactttccgtacggtacgggtccgggaccccggtaggggtacgggtaacggagtacggaacggttacgtacgtaaccgttaccgttaccgttcgttaccgtacgtacgtacgacggacacgtaccgnggttacgtcacgggtacggagggtccgtacgggttcggacggggtacgaccggttacgtaccgtacccggtaccgttacgggtcccgtaacgggtacccaaccgggttcccgtcccccggtaccccggttacccgggtaaccgttcccggttacccgtttccccggttacccccgtccccccg

SEQ ID NO: 90394 - DNA, 741 bp, Homo sapiens
  misc_feature: GYAE6OF02H12KK.21.8.A08.1.454.CMB.1.raw
  modified_base (467)..(467): a, c, t, g, unknown or other
  misc_feature (467)..(467): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctctactttctgcacagtctctggacggcctcctatgagctagacacagccaccgtcggtgtcaggtccgtcccgaggaaccgaaacggccaaggtactcaccgtgctcgtggagtattacgtagttacgaaccgaaaaagtaattacgttacgttttaggttcggttacccgaaggtacgaaggtaacgttcgaacggaccgaccggtccccttagtacgtcggtactacgtaccgtagtacggacggaccgtacggtaccgaccgacctaccggtacccgggtaactcccgtaggacgtacgttctccgtaccgtcgtccctcgacgtcgtacgacgggtaacgnggtaccgtcctaccgttacgtacgtacgtacggcgggtccggggaccggtgggtacggaacgtagaggtacgtctacgtacgttaacttacggttacgtaccggtcaaaccgtaacggtactacgggttaggttccgtacggtaacggtccggggttaagggttcggttacgggacggggtaaacggtaccgttaacggtcgtaccggttggttaccgtacggaccggtacgacggtcgtcccgtcccgtcgtcctaccggttccttaccccgg

SEQ ID NO: 90395 - DNA, 709 bp, Homo sapiens
  misc_feature: GYAE6OF02HITM3.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtcggtntcagtcgtcccaggacaaacggcaggatcactgctctggatattcattcgaccaaaagatatacttgttgtccagcaagagtcaggccacggcccctgtacgtggtcactccatcgacggccagtccgacgacctaccggtccgggactcccgtaggacgacgtactttcctacgtcgccctaccgacgtcctacggaacggggtaaccgtacggtccggacccgttaaccgtttacgaaccgtttaacgtaccggtacggggttccggggaccccgtaggggtacgggacgtaagtagggaacgtacgtacgtaaccgttaacgtttacgtttacggttaccgaccgaaccgtaagtaacgtacggttaggtacggtactaaggttcgggtaagggggttcgttacggggacgggttaacgggaaccgttagggttacgttacccggttccggttacggtaccgaccggtaaccgtacgggtccgtacccggtaccccggttcggtacccgtaccttcccggttaccccg

SEQ ID NO: 90396 - DNA, 778 bp, Homo sapiens
  misc_feature: GYAE6OF02IVRAB.21.8.A08.1.454.CMB.1.raw
  modified_base (309)..(309): a, c, t, g, unknown or other
  misc_feature (309)..(309): n is a, c, g, or t
  modified_base (586)..(586): a, c, t, g, unknown or other
  misc_feature (586)..(586): n is a, c, g, or t
  modified_base (596)..(596): a, c, t, g, unknown or other
  misc_feature (596)..(596): n is a, c, g, or t
  modified_base (612)..(612): a, c, t, g, unknown or other
  misc_feature (612)..(612): n is a, c, g, or t
  modified_base (630)..(630): a, c, t, g, unknown or other
  misc_feature (630)..(630): n is a, c, g, or t
  modified_base (668)..(668): a, c, t, g, unknown or other
  misc_feature (668)..(668): n is a, c, g, or t
tcagtcgtcgctcgcacgaccggtgctcgatttagcatactctacgagggggggggagaggagcccagcactagaagtcggcggtgtttccattcggtgatcagcactgaacacagaggactcaccagtggagtttgggctgagtcttcgggttttcctccttggtccttacgttttaaggaggttcgtccgaggtcgtcgagggcgcgtaacgtgggtggagtcggtgggggacggcagtcggtccaggtccgtgggtacgtccctagcgtccttccgtcctaggtcgcgtacgtccgttcgtaggtnttccgaggttcgtcggtccttccggttgccgtacgtcgaccggtacggtccgggtcccgccgtacggtcctaccggacggacggtacggggttcgacggggttcgggttgggggccggttagttacgttacgttccggttaaggtacgttagggtacggtagggtaaacgttgggtaaagtagttaagtttaaccgttagtaacccggacgttaccgggttccgggtaaggtaccggggtacttacgtaccgactttaccgacgttaccgaacgtanacccggtaanccgaacgactaaccgnaccgttagtactacgtanaacggtccggtaacgcgtagaacggcgaacccgggtanaccgttacggtatacgttaggttaccctaggttacccgaagggttccctttaggttccggtacggttaccgggtcgggacccgtaacccggggttcgtacccgtacccgg

SEQ ID NO: 90397 - DNA, 585 bp, Homo sapiens
  misc_feature: GYAE6OF02FVW9F.21.8.A08.1.454.CMB.1.raw
  modified_base (217)..(217): a, c, t, g, unknown or other
  misc_feature (217)..(217): n is a, c, g, or t
  modified_base (453)..(453): a, c, t, g, unknown or other
  misc_feature (453)..(453): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaaacggccaggatcacctgctcgtgganattcattgaccaaaagatatacttgttggttccagcagaagtcaggccaggcccctgtactggtcatccatgaggccagtcgacgacacgtccgggatcccgtgagagacttctctgccctcagtctcgagggacaggtcggcctaacgttggacttaatcgaggtcggggcccagggtcggaccagtgaacgctagacctacgttattcgtacgcaccagacaggtagtcggtanagtacggaaggggtacttcggggacggtagggaacctaggttcgacccggttccgttagggtcctaacggccccgaaggtcccgtaccgcccccgttggtacccaccgttccgttccggttacccctccccg

SEQ ID NO: 90398 - DNA, 809 bp, Homo sapiens
  misc_feature: GYAE6OF02FTXZ5.21.8.A08.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagcatactctacagggggctgtgggctcaggaggcagagctctgggaatctcaccatggcctggacccctctcctgctcccccctcctctactttctgcacagtcctactgaggcccttcctagtgagctgacacacgccaccctcggtntcgacgtcgtcccaggaaccgaaaccggccaggactcacctcgactcgtgagtacttcattacgaaccgaaaaagtacttaataccgttggtttacggtaccgagactaagaacggtcgaggcccgaccggtccccttagtaaccgtggtacctaagtcctagtggaacggccgtacggtccgaacgtaccaccggttccgggacctcccgtaggactacggtacttctacgtccgcccttaccaggtcccgtacggacgggtaaacctacggggtccccttacccctaaggttttaccgtaaccacggtttacggtacggggttacccgggggaaccgtaacgggggttacggaacggtaacggtaacggtaccgtcggtaacgtttaacgttaaccggtttacgtttccgggtaacccacgtaaaccgacggttaaccgttaggtaccggttcgttaccgtacggttacgggtaaagggggttcgttaaccggggacggtaaccgggaacgttacggttccggtccggttaaccgttgggaaccgtaacccggaccggttaacgtccccggtacccggtcccccggtttacggtcccgtaccggttcccggtttaacccccccg

SEQ ID NO: 90399 - DNA, 829 bp, Homo sapiens
  misc_feature: GYAE6OF02JVI7Z.21.8.A08.1.454.CMB.1.raw
  modified_base (129)..(129): a, c, t, g, unknown or other
  misc_feature (129)..(129): n is a, c, g, or t
  modified_base (133)..(133): a, c, t, g, unknown or other
  misc_feature (133)..(133): n is a, c, g, or t
  modified_base (402)..(402): a, c, t, g, unknown or other
  misc_feature (402)..(402): n is a, c, g, or t
  modified_base (660)..(660): a, c, t, g, unknown or other
  misc_feature (660)..(660): n is a, c, g, or t
tcagtcgtcgctcgcacgaccggtgctcgatttagcatactctacagggggctgtgggctcaggaggcagagctctgggaatctcaccatggcctcggacccctctcctgcctccccctctcactttcngcanagtctctgacgcctctatgacgtctcgacacgacgtcccaccgtcggtgtccaggtccgtaccccgaaggaaccaaacgggccgaggtacctaccgccttggccttacgtcgggatacttcctaagttaccgaaacctaaaagtattacgttacgttttaggttaccggttacgagacgtaagtaaccgcgaccggtaccgaaccggttccccgtaggtaccgtcgtaccgtactaccgagtcgaacggcgtaacgtccggacgtaccncggtaccgtaccgtaccgtaggactgttacccgttcgtacgtaccgtcccttacgacgggttccgaaccgggtaacggtccgtagggttacccggtccctttaaccttccgggtaacttacggtaccgggtccgggtaccgggcggttaaccgggtacgtaccgtaaagggtcgtaacgttacccgtaaggttaacccgttttgtaaacgtttccggaacccgagttaacccagggttaacgttaaggtaccggttanaccgggttaggttaccgggggtaacgggtttgggttacggggaaacctaacgggggtttcctaacggttccgggtacccggtttaacggtcgtaaacccggcccgtaaccggtacgtttccccggaaccgtttccccgtagtccccgggtactttaccggtccccccgg

SEQ ID NO: 90400 - DNA, 847 bp, Homo sapiens
  misc_feature: GYAE6OF02G5N0F.21.8.A08.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagcatactctacagggggctgtgggctcagggaggcagagcttctgggaatctcaccatggcctcggacccctctcctcgccctccccctcctactactttcngaccactagtctcgtggacggtcccttcctagtggacgcgtacgacacaccgtcccacccggttcgggtacgtccgacggttccgaccccgaggaaccgaaaccggccgaaggacctccacgtcggtacttcggtacggtaatacgttcgtagttaaccaaacgtaaaagttaacttactttacggtttcggtttccggttaccgaagtacgtaacggtaacggtaaccgtaccgggaccgtacccggtaccccggttaggtccgttacggtactacgtaccggtaggtccggaccgggacgtaaccggtaaccgggaccgttaaccggaaccgggtcccgggttctaccggtaggtaccgtaacttcggttaccgttcgtaccgtccgacctacggtcggtacggacggtacggtaaccggtccggtaccgtactacggttaccgtacggtaccggtacggggtccgggaaccggttacggggacgtaccggtaagtacggtaacgtcggtaccgtaagtttacgtttaacttacggtacccgaccgtaaacgacgttaacggacgttaaggttcgggtacgtacgggtaacggggttcgggttacggggacggtaagggtaaccgtcgggtacgttccgtaccggttcggacggttacgacccgacgggtccgaccggtccggtccgtacgtccgtaccctacgttccc

SEQ ID NO: 90401 - DNA, 798 bp, Homo sapiens
  misc_feature: GYAE6OF02G2YVC.21.8.A08.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagcatactctacgagggggtgggctcaggaggcagagctctgggaatctcaccatggcctggacccctctcctgcctccccctctctactttcngccagagtctcgtggacggccttctagtgacgtctagacacgacgtccctacccgtgggtctcaggtccgtaccccgaggaaccgaaaccgggtccaagggtactcccaccgttcgtacttacgtagggaactactttccaggttaccggaaaccaaaagtattaacttcgtttggttacgtaccagtacaagtaacgtacggacggtaccgaccggtaccctgtacgtcggtacactccgagtcggtaccgaccgtaggtaccgaacgtacgtaccggtccggtacgtccctaggtagacgtacttcgcttcgacctccgagtcgtacggaggtacgtacgggtccgtaacccggttactacgtacgttacggcgttaccggggtaccgggtaccgtacggggtacgaacccgtagttaaggacgtaccgttagtaccgttacgtacgttacggttaccgacaccgtaacggttacgtacgggttacgtacgggtatacgggtacgggttacggggttacgtacgggggtacgggtaaccggtaccggtaacgggttcccgtacccggtttacggtccgggtaacgtaaccggtcccggtaaacgtccggtacccgtccccgtacggttaccgtaccccggttccggttaccccggtaccccgttccccg

SEQ ID NO: 90402 - DNA, 750 bp, Homo sapiens
  misc_feature: GYAE6OF02GM0AQ.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngccacagtctctgacggcctctatgagctcgacacacgccctacccgttcgggtgtcgaggtcggttacccccgaaggaaccaaaaccgggccaagggacttccaaccgtggaccttcgtggagtacttcaagttacgaaccaaaaaaggtactaacgttaccgttttggttacggttaccaaggtcaaacggaacgttccgaaggccccgaccggtcccccgttaggtaaccgttgggtaccaacgttacccgtagtacggtaaccggtaccgaacggttaccggaaccgaccgtaaccggtcccggggtaactaccccgtaggacgtaacggtactttacctcgcgtacccgtcgtaacgccgttacggaggtactacggtacgaccctacgttacgtactagtcgtacgggtcgggacgtacgggtaacggacgtacggtaagacggtctaacggtaacgtaaccgtttacgttacgttacgaaccgtacaacgtaacgaggttactaggtacgtacgtacggtaacggggttagaccgggcgggtacgtaacgtacggttcggtaccgtcggtacgtcgtacgaccgacgtcgcgtacccgtgtactacgtcgtcccg

SEQ ID NO: 90403 - DNA, 781 bp, Homo sapiens
  misc_feature: GYAE6OF02H6B8T.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctgacggcctcctatgagctagacacacgcccacccgtcggtgtcacgtccgtacccgaaggaaccgaaaccggccgaaggactacctaccgtgaccttcggtgggtactacttactacgttacgaaactaaaaaagtaattaactttacgtttggttacggttccgagacgaaggtaacgtacgacggcccgacggtcccctgtacgtacgtcactacgagtacggacgccgacgtacgaccgacgtacggtcccggctccgaggaggtactacttcctaccgtctccgtaccgacggtccgtacgggacggtacgacggtccggtacccttaccgttcgtaccgtttacgaccgggtacggggtccggggaccggtagggtacggtacgtagtacggaacgtcgtaacgtaactttacgttacgttcggtaacgaccgaacgtacggtaacgtaggttaacggtacggtacgtacggttacgggtaacgggggttacgtacggggaacgggtaccggtaacgttaccgggtaccggtaccggtttccggttaacggacccggtaacggtaccccgttaacgggtcccgtccccgggttaccccgtccgggtttaccacccggtttcccgttacccccgg

SEQ ID NO: 90404 - DNA, 760 bp, Homo sapiens
  misc_feature: GYAE6OF02GGY7A.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaacggccaggactcacctgctcgtggagattcattcgaccaaaagatatacttgttggttccagcaagaagtcacggccgacggcccctagtactgtacactccagtgacggccaggtccgacgacgtaccgtaccggggacttcccgtaggaacgtagtacttcgtaccgtcgacccttccgacgtcgtacgacgggactacggtccggtaccctaccgttacgacttaacgtcggtacggggttaccgggggaccccgtaaggggggttacccgtacgggtaagttacggaaacggtccgtacgtaaaccgttaacgttaccgttttacggtacctacccggaacctaaggaaccggttaaggttacggttacggtaccgtaaggttcggggttaaagggggttaccgtttcgggggaacggggacgggttaaccgtaacgggtttcccgggtaaccgggttcccgtttaacggggtcccgaaccggtacccgtaacggggttccccgttaccccggtaccccgggtttacccggtaccgttacccgttccccggtttaccccgg

SEQ ID NO: 90405 - DNA, 649 bp, Homo sapiens
  misc_feature: GYAE6OF02FHNTK.21.8.A08.1.454.CMB.1.raw
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (479)..(479): a, c, t, g, unknown or other
  misc_feature (479)..(479): n is a, c, g, or t
tcagtcgtcgctcgcacgaccggtgctcgatttagcatactctacagggggggggagaggagcccagcactagaagtcgcggtgtttccattcggtgatcagcactgaacacagaggactcaccatggagtttgggctgagctgggttttcctccttgctcttttaagaggtgtccagtgtcgaggcgcaactggtggagtcgtgggggagcatggtccagccgtgggacgtccctgacgcctcgtcctgtgcagcgtntggnttccgaagtactcggcttccgttgccatgcacgtgggtccgctaggctaccgaggtacgaaggggtcctagggaggttcggggtcgggctacgtttagtcgtaggtagtggagtagggtaagtcgaagaaggtattaattagttcgaagtccgtcgggtagacgggtacctatccgaccgtacttaccacgaagacgacaacgtacgacccgaaanaacccactactaacgtcttacgtaacaagtacgacccggtcgacggaacgacgaccgaacggtaacgaaccggtcttagacgttaaggttactacgggtttaacgaaggttcctttagggacgttacgggttaccggggtccgtaaccgggttacccgtcggttaccccg

SEQ ID NO: 90406 - DNA, 765 bp, Homo sapiens
  misc_feature: GYAE6OF02HALOA.21.8.A08.1.454.CMB.1.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
tcagtcgtcgctcgcacgaccggtgctcgatttagcatactctacagggggctgtgggctcaggaggcagagctctgggaatctcaccatggcctcggacccctctcctgcctcccctcctcactttctgcacagtctctgaggcctcctatgagctgacacgagcccaccgtcggtcgtcaggtcgtaccccaggaccgaaaccggccagggtactcgacctggtcctcgtaggagtacttacgagttacgaacctaaaaagtaattacttaacgtttggtttacggtaccaagaccgtaagtaacgtcgacggccgaacggtcccctagttacgnggtcatcgtaagtgacggtccnggtacaccggtacaccggtacggactccctaggagtacgtntaccttcgtcgaccctcgacgtactaccggtaggacctgggttaccgacccgtaacgttcggaacttacgtacgtacgggtacgggtacccgtacggggtaacggtaacggacgtaacggtaccgggtactacggtaaccgttacgttaacgtttacgaccgttaaccacggtaaccggtaacgttaggttaaccgtcggtacgtaacgttaaccggggtaaggggtttccgggtacgggtaaccggggtaccggtaaacggtacggttaccggtacccggttaacggttccgggaaccgtacggtaaccgtaaccggccggttaacccgtccccggttcggaccttaccggtcccttaccccgg

SEQ ID NO: 90407 - DNA, 647 bp, Homo sapiens
  misc_feature: GYAE6OF02JJUK1.21.8.A08.1.454.CMB.1.raw
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
  modified_base (495)..(495): a, c, t, g, unknown or other
  misc_feature (495)..(495): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgaccacagcccaccctcggtgtcaggtcgtccccgaggaccaaaccggccaggactcacctgctctggatatcatgaccaaaagtatactcttgttcgttccagcaagaacgtcgacggtccacggtccccttgtactggtcacgtccagtcgacggcctagtcgacgaccacgtcgggactccgtagagacgtacttccgtcgtcgtaccctccaaggtctacggacgggaaccngtccggaccctacggttnaacgtacgtcgacgggtccgggccgtaagggtcggaacgtagtacggaaggtcctaggtaactttacgtatttcgggtaaccnctaccggaccgtagaacgttggacgtacgtagttgggaacggggttgtacgggaacggggtaccgtaacggtacggtccggtaccgttaccggtggtaccgacgtcccggtagcccggtaccggtccctcggtactaccgttccggtaaccc

SEQ ID NO: 90408 - DNA, 682 bp, Homo sapiens
  misc_feature: GYAE6OF02GIK8D.21.8.A08.1.454.CMB.1.raw
  modified_base (104)..(104): a, c, t, g, unknown or other
  misc_feature (104)..(104): n is a, c, g, or t
  modified_base (174)..(174): a, c, t, g, unknown or other
  misc_feature (174)..(174): n is a, c, g, or t
tcagtcgtcgctcgcacgaccggtgctcgatttagcatactctacagggggctgtgggctcaggaggcagagctctgggaatctcaccatggcctggacccctntcctgcctccccctcctcactttctgcacagtctctgaggcctctatgagctgacacagccaccctggtntcagtcgtccccaggaaccaacggccaggatcacctgctcgtgggaatattcattcgacctaaaaagattatacttgtttgttccagcaagagtcgaggccgaggtcccctagtactgtacatccatgacggcacgtcgaacgacaccgtccggactccgtgagtagtaacttctctcgcccttcgacgtctaccggaggaactaggcggacctaccgttagtacctagtaccggtaggtccggggacccgtagggtcggaacgtagtacggtaacgacgttacggaaccgtttaacgttaagtttacggttaaccgacgaaaccgaacgtaacgttaacgttaggttacggtaccgtaagttaccgggttaggggttaacgttcggggacgggtaaccgggtaaccgtacggttaccgtaccggttccgttacgggtacccgaaccggtaccgtaccggtccgtcccggtcccccgttacgggtccctacgtttcccgttaccccgg

SEQ ID NO: 90409 - DNA, 745 bp, Homo sapiens
  misc_feature: GYAE6OF02F6JSL.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgacggccttcctatgagctgaccacagcccaccctggtctcagtcgtccccaggaacaaacggccaggtactccacctgcctcgtgggatacttcattacgaaccgaaaaagtattattaacgttggttcgttaccagtacagtaagtccgaggccacggtccctgtactggtcactcagtgagcctagtacgaccgactaccggtccgggtactcccgtaggtacgagtacctttcctacgtccgtcctacccgacgttccgtaccggaagggtaccgtagggtacccggtacccctaaccgtttcgaaccttacgtaccggtacgggttccggggaccccgttaggggtaacggacccgtaaggttaccggaacgtccgtacgtaccgttaaacgttcgtttaggtacccgacctaccgtaacgtacgagggttagtcggtaccgaaggttccgggtaggggttaccgtccgggaacgggtaaccgggtacccttagggttaccggtacccgtttccggttacggtaccgtaccgggaacccgtaccggttcccgtacccggtcccccgtacgggttcccgttaccgttccgttaacccccgg

SEQ ID NO: 90410 - DNA, 794 bp, Homo sapiens
  misc_feature: GYAE6OF02G7JRC.21.8.A08.1.454.CMB.1.raw
  modified_base (180)..(180): a, c, t, g, unknown or other
  misc_feature (180)..(180): n is a, c, g, or t
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (415)..(415): a, c, t, g, unknown or other
  misc_feature (415)..(415): n is a, c, g, or t
tcagtcgtcgctcgcacgaccggtgctcgatttagcatactctacagggggctgtggactcaggaggcagagctctgggaatctcaccatggcctggacccctctcctgcctccccctctcactttctgcacagtctctgaggccctcctatgacgtctgacacagccctacccgtggtntcgacggtcgtacccccaggaaccaacggccaggactccactgctcgtggagtntcattgaaccaaaagtatattacgttgttcggtacancgagtaagtcgaggccgacggcccgtagtacgtggtcactccagtcggacggccgtagtaccgaccgacgtaccgtcccgggacgtccccgtaggacgtacgtacgtttctccgtcgtccctacgaccgtactcggaggtaccnggtaccgaccgttaccgtcgtaacttacgacgtacgggtaccgggaccccgagggtacggacgtaaggtagtaacgtacgtacgtaaccgttagttaacgtttacgtaaccgtacccgaaccgtaacggtaccgtaagggttacgttacggtccgttaaggtaccggggttaacgggggtttacggttccgggaaacggggtaacggggtaaccgtttaacggggtacccgggtttaaccccgggttaaccggggtttaccggttaccggtaaccccgggtaacccggttaaccgggtacccccgggtttacccccggtaccccccgggttaccccgggtttacccggttacccgtttcccgggtttaaccccccccgg

SEQ ID NO: 90411 - DNA, 740 bp, Homo sapiens
  misc_feature: GYAE6OF02GPJAW.21.8.A08.1.454.CMB.1.raw
  modified_base (174)..(174): a, c, t, g, unknown or other
  misc_feature (174)..(174): n is a, c, g, or t
tcagtcgtcgctcgcacgaccggtgctcgatttagcatactctacagggggctgtgggctcaggaggcagagctctgggaatctcaccatggcctggacccctctcctgctcccctctcactttctgcacagtctctgaggcctcctatgagctagacacagccaccctcggtntcagtcgtccccaggaacaaacggccaggatccacctgctcgtggagtattcagttcgaaccaaaaagatacttacgttgttcggttaccagtacaaggtaacgtcgaggaccgacggccccttagtacgtcggtacctaacgttccgaagttcggaaccgggtcctaacggttaaccggaaccggtaaccgtacccgggttaccggggtacctaccccggtaggtaacgtacgttacttcctcgtacgtcccttaccgagtccgtacggaacggaacgtcggtccgacccgtacttggaaccttacgtccgaacggttcggggaccgtaggggtcggtaaacgtaggtacggaagtccgaggttaacttacgttacggtttacgtaccgactaaccgagtacgagttaacggtcgtataccgggaggttacggggttactcggggtacgggaacgggtaccttagggttaccggtacccgggttcggtttacggacccgtaaccggtacccgtaaggtcccgtacccggtccccgttacggtacttacccggtccgtttccccgg

SEQ ID NO: 90412 - DNA, 724 bp, Homo sapiens
  misc_feature: GYAE6OF02GXVR8.21.8.A08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacagcccaccctcggtntcagtcgtcccgaggaccaaacggccaaggactcacctgctcgtaggatattacattagaccaaaaagaacttattacgtttggtttacggttaccagacaaggaaagtcaacggccgaacggtcccctagtacgtcggtacgaactccagtacggacggaccgacgtaccggacgaaccgtaccgtacgggacttccccgtggaagagtacttcttcgcgccttcgacgtcgtacaggggacacggttacggaccctaccgttagacgttacgttacgtacggtaccggggtacccgtagggtacgggaacggacgtaggaaacggtcgtaacgtaccgttaacgttacttacggttaaccacccgtaaccgaaccgtaacgtaacggttaacggttcgtaccgtaaggtacgggttaaggggttacggtacgggtacgggaacgggtaacgtacggttaccggtaaccggttcggttacgtaccggaccgaccgtaacggtccgtccggtacccccgtcggttacccgtaccttccgttcccgg

SEQ ID NO: 90413 - DNA, 800 bp, Homo sapiens
  misc_feature: GYAE6OF02HFTVG.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctagaggcctcctagtgagcgtgaacacacgccctaacccgtcgggtcgtctacggtcgtccccgaaggaaccgaaccggccaagggactaccaccgttcgccgtacgtggaacgtacttacagttacgaacaaaaggtaattaacttacgttgttacggttaccagctaaggaacgtcgacggtacccggacggtccccttaggtacgtacggtacctaacgtccgacgtggacggacccgtacggtaccggaaccgaccgtaaccgtaccggggacttcccgaaggtaactagtacttcgtacgtccggaccgccgacggtaccacgggacggtaccgtaggtaccggaccctaccgttagaacgtacgttacggtacgggtcgggaccgtacgggtaggtaacgagtacggacgtactacggtaacttaacgtttacgttacgtaacgtaccgaccctaagtaacgtagggttaacgttcggtaacgagttaccgggggtaagggttacggtacggggtaaccggaacggggttaacccgttacgggttaccgggtaccctttaccgggtacggtacccgggtaaccgaccgggttaaccgtcccggttacccggtcccccggttaacgttacccggaccggtttcccttaaccccccgg

SEQ ID NO: 90414 - DNA, 834 bp, Homo sapiens
  misc_feature: GYAE6OF02HVYM7.21.8.A08.1.454.CMB.1.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgacggcctcctatgagctgacacacgcccaccctggtgtcagtcgtacccaggacaacggcaggatcactgctcgnggagtatagatacgaacaaaanattaatagttagttcggttaccagacaaggtaacgtacgacggaccgacggtccctaggtaacgtcgggtacagttaccaggttcgtaacgggaccctacggtacggtaaccggacgtaaccgttacccggggtaacttacccgacggtaaaggtacgtactttaccttccgtacgtccccgtaccgacggtccgttacggaacggggtaccttaacgggttaccggtaacccgttaaccccgtttacggtaaacccgtttaaggtaccgttaacggggttaaccgggggaccccggttaaaccgggggttacgggaacggttaaacggtaaggtaaaccggtaacggttaccgttaaccgttaaactttaacgggtttaacggttaaccggtaaccgacccggtaaacgtaacggtaacgttaagggttaccggacggttaacgtaacggggaacgggggttaacggtaccggggtacgggtaacggggtaaccggttaagttacccggtaccgggtttcccgttacggtacgtaacccgtacggaaccggtccgttcccggacccccggttaggtccctacgttaccgttccccg

SEQ ID NO: 90415 - DNA, 829 bp, Homo sapiens
  misc_feature: GYAE6OF02G7A5V.21.8.A08.1.454.CMB.1.raw
  modified_base (587)..(587): a, c, t, g, unknown or other
  misc_feature (587)..(587): n is a, c, g, or t
tcagtcgtcgctcgcacgaccggtgctcgatttagcatactctacagggggctgtgggctcaggaggcagagctctgggaatctcaccatggcctggaccccctctcctgcctcccccctcctcactttctgcacagttctctgacggcctcctatgagctgacacacgccctacccgtcggtcgtacgacgttccgtcccccgaaggaaccgaaaaccggccgtaacggtactccaacccgtggccgtacgtaggagtacttacctagttacgaaccctaaaaagtaacttaagttaacgtttcggttcggtttacccaagaccgtaaggtaacgtccgtacgggcccgaaccggtcccccttaggtaaccgtggtaccgtactaccgaagtcgggacggcccgtaacggtccgaaccgtacctacccggtaccgggtaccttcccccggtaggaacgtaacgttcctttaccgtccgtccggtacccttccccgaagtcccgtaccggaaggggactacggtccggaccctaccgtacgttacctacgtacgtacgggtccgggaccgtaggggtacgaccgtanaacggacctacgtaccgtaacgttacgtttaagttaccggttaacgaccctaccgaaggaccgttaaggtacgtaccgtacgacggttcgggaagggggtttccgaacgggtccggggtaacgtaccgttaacgggttcccgtaccggttacggttacgggacccgtaacggaccccggtaacggtcccggtacccggttccccgtaccggttacccgttaccttcccggtttaaccccccg

SEQ ID NO: 90416 - DNA, 795 bp, Homo sapiens
  misc_feature: GYAE6OF02FXKTG.21.8.A08.1.454.CMB.1.raw
  modified_base (230)..(230): a, c, t, g, unknown or other
  misc_feature (230)..(230): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatgagctgacacacgcccacccgtcggtcgtcaggtcgtcccgaggaccaaacggccgaggactccgacctcgcttcgnggatagttcagttcgaaccgaaaagtaattagttactttggttacggttccagacgaagaagtcgaacggcccgacggtccctgtacgtcggtacactcagtcggacggccgtacgtaccgaacgaccgtaccggtcccggtaccttaccggtacggaagtacgtaccgtttccgtaccgtccgtaccctcgtaccgtaccgaccggaacgggtaacgtacgggtacccgtacccttaaccggtttacgtaaccgttacggtaccggtacgggggttacccgggaaccgggtagggtaacgggtacgtaacgggtacgaaccgtacgtaccgttaacgttacgtttacgttaaccgtaaccgtaccgaacgtaacgtaacggtaggttaacggttacgtacgtaacggttaggggttacggggttaacggttaccgggaacgggtaaccgtaacggttacggttaccggttaccgttccgggttaccggaaccgtacccgtaccggtaccgttacccggtcccggttacccgtccgttacccgtaccgtttccccgttaaccccg

SEQ ID NO: 90417 - DNA, 727 bp, Homo sapiens
  misc_feature: GYAE6OF02I28TC.21.8.A08.1.454.CMB.1.raw
  modified_base (124)..(124): a, c, t, g, unknown or other
  misc_feature (124)..(124): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
tcagtcgtcgctcgcacgaccggtgctcgatttagcatactctacgaggggcgtgtgggctcaggaggcagagctctgggaatctcaccatggcctggacccctctctgccttcccctctaccnctttctgcacgtgtctcgtgacggccctctatgacgtctagacacacgccacccgttcggtgtcagtcgtcccgaggaaccaacggcagtacncactgctcgtgatntacagttcgaactaaagtacttagttactttcgttacgttaccagtacgtacgtaagtaccgacggtaccgacggtacccctaggtaccgtacggtaacctacttaccgagtaggtacgtacgtacgggtaacgaccgtaaccgtaccggtacccggtaccttcccgtaggtaacgtacgtacttccgtcgtaccgtccgtaccgtacgtaccgtacggtacggaacgtcgggtaccctcccggttaccttacgggtactaacggtcgtaacgggtccgggttaccgacgggttcggactaggtaggaacgtcgtacggtacttagtttacgttaccgtcgacgacgtaacgtacgagtttacggacgtacgtacggaccgggttagggtaacggtcggaccggtaacgtacgtacggttccgtacccggttcgtacggacctacggaccgtacggtcccgccggttacccgcggttaacgtccgtccgttccccg

SEQ ID NO: 90418 - DNA, 730 bp, Homo sapiens
  misc_feature: GYAE6OF02GKOCJ.21.8.A08.1.454.CMB.1.raw
  modified_base (129)..(129): a, c, t, g, unknown or other
  misc_feature (129)..(129): n is a, c, g, or t
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
tcagtcgtcgctcgcacgaccggtgctcgatttagcatactctacagggggctgtgggctcaggaggcagagctcgtgggaatctcaccagtggcctggacccctctcctgcctcccctctcactttcngcacagtctctgaggccttctagtgagctgacacacgccacctggtgtcagtcgtcccaggacaacggcaggatcactgctcnggatatcattcgaccaaaaagtnttacttacgttggttcgttaccaggcaaggaacgttcgacggccgacggtccccttaggtaaccgttggtacctagtacccgagttacggacgggccaacgggttaccgaaccggtactaccggtacccgggggtaacttccccggtaaggtaacggtacgttacttccgtccgttagaccccttaccggaagtcccgttacggaacggggtacccaggggttcccgacccttaaccggttcggtaactaacgttcggaccgggttacccgggggacctaagggggtacggaacggtagtacggaaacggtcgtacggtacgtttaactttacggttccgtaccgaactaccgaacggaacgtaggtaacgtcggtactacgtcgggtaacggggttcgtaccgggacggacgggtaacctaggttccgtaccggttcgtagtccgtaccgaccgtacggtcgtaccgcccgtacggtcctaccgtcgttcccgg

SEQ ID NO: 90419 - DNA, 747 bp, Homo sapiens
  misc_feature: GYAE6OF02JEC8O.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctctcacttctgcacagtctctagagcctcctatgagctagacacgcgcccacccgtggtgtcagtcgtaccccgaggacaacggccaggctcacctgctctggagattcgagttgaaccaaaagtatacgttcgttggttcgtaccgagccgtagtaacgtcacggtacccacggtcccccttaggtaacgtcggtacctacgtacccgagtcggacgaccgtagaccgaaccgtacctaaccggttcccggggaattccccgtaggaaacgtacggttaaccttccgttaccgtcggtaccccttcccggaagttccggaccggaaacgggtaccgaacggtttcggaccccctaaaggttcggtaacgtacgttccgaaggggttccggacccggtaagggtacggaaccgtagttacgggaccgtacggtacggtaaccgttacgttaacgtttcgtaaccggacctaccgtaaggtcgtaaagtaccggttcgttaccgagttaccgggtagggtttaacgcggaaccgggtagaccgttacgtaccgtacccggtcggttagaccggtaaccaccggtacgtccgtacccggttacccgtcccgtagttcccgccgtttaccccgg

SEQ ID NO: 90420 - DNA, 647 bp, Homo sapiens
  misc_feature: GYAE6OF02FKALU.21.8.A08.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagcatactctacagggggtgggctcaggaggcagagctctgggaatctcaccatggcctggaccctctcctgctcccctctcactttctgcacagtctctgaggcctcctatgagctgacacagccaccgtggtgtcagtcgtcccaggacaaacggcaggatcactgctcgtggatnttcattcgaccaaaagtaatacgttacttggttcggttccagcaagaagtcaggccacggcccctagtactggtcatccagtcggacggccgagtacgaccgacgaccggtccgggactcccgtggtacgagtactttctcgtcgcctccgacgcctacggagggtacctacgggtacggaccctaccgttacgacgttaacgtcgtacggggtcgggacccgtaggggtcggacgtagtacggaacgtcgtacgtaacctacgttacgttacgtaacgaccgtacgagtaacgtaggttaggtcgtacgtggtacggtaggggttactaccgggacggtacgacgtagttcgtaccgttcgtcggtacaccggtaccggaccggtccgtcccggtccccgtacggtacctccgtccgttcccgtacccctccccg

SEQ ID NO: 90421 - DNA, 700 bp, Homo sapiens
  misc_feature: GYAE6OF02IV7H2.21.8.A08.1.454.CMB.1.raw
  modified_base (130)..(130): a, c, t, g, unknown or other
  misc_feature (130)..(130): n is a, c, g, or t
  modified_base (163)..(163): a, c, t, g, unknown or other
  misc_feature (163)..(163): n is a, c, g, or t
  modified_base (184)..(184): a, c, t, g, unknown or other
  misc_feature (184)..(184): n is a, c, g, or t
  modified_base (355)..(355): a, c, t, g, unknown or other
  misc_feature (355)..(355): n is a, c, g, or t
  modified_base (654)..(654): a, c, t, g, unknown or other
  misc_feature (654)..(654): n is a, c, g, or t
tcagtcgtcgctcgcacgaccggtgctcgatttagcatactctacagggggctgtgggctcaggagcagagctctgggaatctcaccatggcctggacccctctcctcgcctccccctcctctactttcngcacagtctctggacgcctacctatcgagcgtnacacacgccctaccgtcggtntctagtccgtacccgaggaccaacggcgagactcacctgctcgtaggatactcgtagtacgaactaaagtatacgttacgttgttcgtacagacgtaagtaacgtcgacggccgaacggtccccttgtacgtcggtacactacgtagtggacgacacgtaccgacgtaccnccggtacggactccgtagagtacgttactccgtacgtccggtacccacgtaacgtcgtacggaacggacgttagccgtaccctacgtagtaacctagtacggtcgggtcggtaccggagggtacgacgtagacggtacgtaccggtacgtaacttagtcgttaaccggtccgtaaccacgtacggtaacgtgggttaagacgttacggaggttaccgggtaagggttccgggtaccgggacgggttaaccggtacgtacgggtaccgttcgggttaaccgtcgtcggaccggttaaccncgggtacccgttcccgtacccgtccgtcgtacccgtcgtcccccgg

SEQ ID NO: 90422 - DNA, 661 bp, Homo sapiens
  misc_feature: GYAE6OF02G8OQX.21.8.A08.1.454.CMB.1.raw
  modified_base (105)..(105): a, c, t, g, unknown or other
  misc_feature (105)..(105): n is a, c, g, or t
  modified_base (129)..(129): a, c, t, g, unknown or other
  misc_feature (129)..(129): n is a, c, g, or t
  modified_base (134)..(134): a, c, t, g, unknown or other
  misc_feature (134)..(134): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (306)..(306): a, c, t, g, unknown or other
  misc_feature (306)..(306): n is a, c, g, or t
  modified_base (492)..(492): a, c, t, g, unknown or other
  misc_feature (492)..(492): n is a, c, g, or t
tcagtcgtcgctcgcacgaccggtgctcgatttagcatactctacagggggctgtgggctcaggaggcagagctctgggaatctcaccagtggcctggacccctntcctgcctcccctctcgactttcngccanagtctctgagcctcctatgacgctgacacacgcccaccgtcggtgtcagttcgccccaggaaccaacggtcaggactcactgctcnggatntnatcgaccgaaanagtatagttgttcggtcagcagaagcgtgccgacggtccctgtaacgtcggttactacgtactacgnggtaccggtcctaaggtacccccgacgtaccaccggttaccgggctaccccgttggaacggtacgttaccgttctcgtcctccgttaccaggtcaaccgtaggggctaacggtcggtaccctactttcgggaaacttcggtaccgtagggtacccggggtaccgaaacggggttcggaccggttanacggtacgtacggtacttaacggtaactttgtccgtttaacgcgtacccgtagaactgggttacggtcgtctagtcgggtacggttaagtccggagtcgtaacggtagtcggaaccgttcaggtcctcgaccgatccgtaccgtcccgtaggccttacgtcccgttccg

SEQ ID NO: 90423 - DNA, 707 bp, Homo sapiens
  misc_feature: GYAE6OF02I30II.21.8.A08.1.454.CMB.1.raw
  modified_base (655)..(655): a, c, t, g, unknown or other
  misc_feature (655)..(655): n is a, c, g, or t
tcagtcgtcgctcgcacgaccggtgctcgatttagcatactctacagggggggggagaggagcccagcactagaagtcggcggtgtttccattcggtgatcagcactgaacacagaggactcaccatggaggtttgggctgagcttgggttttcctccttgctcttttaagaggtgtcctaggtgtcaggcgcaacgtggtggagtcgtgggggagcagtcggtccagtccgtgggacggtccctagacgccgtctccgtgtgacagccgtcgtggattcgagtatcggtcttccgtttgccctatcggctaccggttcggggcccaccgacgggtcctccggaagggcgtaaacgggggtccttaggggacggttggggtcggaccggtatttacggtcgttaggagtggtaagtagggtacgtaggaacgtaggtagttaacttagtacgaggtaacccgtcggtaggtaacgggtcctaagttacccaaccacgtaccctacggaacgtacgtaacctaagtaacccgaaccgtaaacctaaaccgacttaaaccgttcgtaaaccttacgtaaaccctaaaggtaccgggtaacccgtccggtacgtaaggaccgacggacggtaaccgacgtactagtacgtacgttacncggttaacgtcgtcgttagtcgtaggtccggacgtacggaccgttcgtaccg

SEQ ID NO: 90424 - DNA, 678 bp, Homo sapiens
  misc_feature: GYAE6OF02FO7E4.21.8.A08.1.454.CMB.1.raw
  modified_base (177)..(177): a, c, t, g, unknown or other
  misc_feature (177)..(177): n is a, c, g, or t
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggaccccctctcctgcctccccctctcactttctgcacagtctctgaggcctcctatgagctgacacagcccacccgtggtntcagtcgtccccgaggaaccgaaacgccgaaggatcacctgcctcgnggatattcagttcgaccaaaaagattatacttgttggttccagacaaggaagtcacggccagtcccccgtagtacgtggcacgtcatggacgccgaagtcggacacgacgtcccgggatcccgtaggagtacgtacttcgtactcgccctccaggcctacggtacgggactaggtcggacctaccgttgaacttacgccgtaagggtcggggacccgtaagggtacgggaacgtaaggtacgtaacggtctacgtaaccgttaaccgttagtttacgtttaacggacacccgtaagaacgtaaggttacggtacgtacgacgttacgggtaaggggttacgttaccgggaggggaccggtaaccggtaggttccgaaccggttccgttacggtaccgacgacccgtaaggtcccgtaccggtcccccgtcggtcccgtaccgttccgttacccg

SEQ ID NO: 90425 - DNA, 917 bp, Homo sapiens
  misc_feature: GYAE6OF02HKKWV.21.8.A08.1.454.CMB.1.raw
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagtcttgggttttcctccttgcttctttaagaggtgtccagtgtcaggcgcaacgtggtaggagtcggtgggggaggcagttcggtccagccgtgggacggtccctgagtcctctctgtgcagtcgtcgtggattcgagtagtcggtcttccgtttagcctagtcgccgtacgtcggggtccccgaccgtacggccctaccgaaggggtaccgaacggggggtccgttagggggaagggttcgggggtacggtacgtaagttttaacggtccggttagggtagttagggaagttagggggaaggttaggaaacgggtagtttaaagtttaacgtttaacgttacccgaaagggttaaccccttaccggggtaaggggtaaaccggggtcccgttaaactttacccgaaacccgtttaacgtcccgttaaccggaaaggtaaaccgtaaacgtaaacgtaccggaaaacccgaaaacctaaaacccgtaacccgttaaacgttaccggtaaactttaacccgtttaaacgaaaccggttaaccgggtaccccgggtaagtttaaccgggaaacggttacccggggaaacccggtaaacgggtaaacccgggtaaccggggttaaccttaaacggttacggttttaaaacccggtttaacggaccgggttttaaacggtaaccgggtttaccgggttttacgggttaaccgttaacggggggttttacccgggaaacccggggttaaacccggggttaccccgttacggttaacccccgg

SEQ ID NO: 90426 - DNA, 738 bp, Homo sapiens
  misc_feature: GYAE6OF02JMUP8.21.8.A08.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngtctctgagcctctatgagctgacacagcccaccgtggtgtctagtcgtaccccgaggaaccaacggccaggactccacctgctcgtggatacttcgattacgaacctaaaagaattacgttacttggttcggttaccagctaaggacgttcgaacggcctacggtccccttagtaccgttcggtaccacgttccgtagtacggaacggtcccgtaggtaccggaaccgactaccggtccgggtactcccgtaggacgtacgtcttcgtccgtcgtcccgtaccgagtacctacggaacgggtactaccgggtccgccctacgttacgaccttacgtcggacggtaccgggcgtaagggtacgggacgtagtacggacgtcgtacgtacttacgttagttacggtaacgaccctacggaagtacgtacggttaggtccgttacgaaggttacgggtacggggttacgttacgggacgtaccgggtaccgttaccgggttacgtaaccgggttccgttacgggttaccgaccggtaccccgtacggtaccccggttaccgggtaccccggtttacggtacccgttacgttcccggttaaccccgg

SEQ ID NO: 90427 - DNA, 621 bp, Homo sapiens
  misc_feature: GYAE6OF02H0OWX.21.8.A08.1.454.CMB.1.raw
  modified_base (176)..(176): a, c, t, g, unknown or other
  misc_feature (176)..(176): n is a, c, g, or t
  modified_base (224)..(224): a, c, t, g, unknown or other
  misc_feature (224)..(224): n is a, c, g, or t
  modified_base (367)..(367): a, c, t, g, unknown or other
  misc_feature (367)..(367): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacctcggtntcagtcgtacccaggacaacggccaggatcactgctcgtggatacttnaattcgacctaaaaagattattacgttgttacggttacccaggaccaagacgtcgacggccacgggcccctaggtaccgtggtcactccagtcggaggtccaggtccaacgactaccgtccggacttccgagagagtacttcnctcgcctcgagtctcgaggcagtccgacctagttcacttatcgaggtcgggacccgtaggtacggacgacgtagacgtcgtacgtacttaacgttagttacgttaccgacaccgtaacgacgtaaggtacgtacggtacgagttacgggtaggggtcgttacggacgggtacggacctacggttacgtaccgtcgttcggtacgaccgaccgtacggtccgtccggaccccgttcggtacctccgttcgtcccg

SEQ ID NO: 90428 - DNA, 684 bp, Homo sapiens
  misc_feature: GYAE6OF02GXXVP.21.8.A08.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccaccctcggtgtcagtcgtccccaggaccaacggcagganccactgctcgngagtctcagttcgaccaaaagtatactactttggttagttccagcgagaagtcacggaccacggccccttgtaccgtggtcactcgatggacggcgacggtcgaccgacctaccggtacccgggacctcccgtaggagacgtaacttccttccgtcgtccctaccgtacgccgtacgacgggaccgtggtacccggcccttaccgttcgaaccttacgtcgtaccgggtcgggtacccggtagggtaccggaggacgtaggaacgtcgtacgtaacgttacgtttagtttacgtaccgaccgtaaccgagtaaccgttacggtaggtcgtacgtagttaacgggtaggggttacggtccgggaacgggtacgggacgtacggttcgtaccggttcgtaccggtagacccgtaccgtacggtacccgtccccgtaccccggttaggccccttacgttcctcccccggg

SEQ ID NO: 90429 - DNA, 672 bp, Homo sapiens
  misc_feature: GYAE6OF02JYEOR.21.8.A08.1.454.CMB.1.raw
  modified_base (125)..(125): a, c, t, g, unknown or other
  misc_feature (125)..(125): n is a, c, g, or t
  modified_base (130)..(130): a, c, t, g, unknown or other
  misc_feature (130)..(130): n is a, c, g, or t
  modified_base (175)..(175): a, c, t, g, unknown or other
  misc_feature (175)..(175): n is a, c, g, or t
  modified_base (463)..(463): a, c, t, g, unknown or other
  misc_feature (463)..(463): n is a, c, g, or t
tcagtcgtcgctcgcacgaccggtgctcgatttagcatactctacagggggtgggctcaggaggcagagctctgggaatctcaccatggcctggacccctctcctgcctccccctctcactttcngccanagtctctgacgcctccatggagctagactacagccacccgtggtncagtccacccaggacaacgcagatcacctgcctgtaggatacttcagttacacctaaaaagattaagtcgtttacgtaggttccagcgaagaagtcacgccgacgcccctagtcctcggactatccagtcgacggacacgtacgacgacctaccgtaccggtacctccgaggacgtagtacttcgtactccggacctcgacgtccgtacgtagggaactcggtacggtacccctaccgtcgtaaacgttcgaggtaccggggtccggacccgtaagggtcgtaacggngtaggacgtctacgtactaagttaccttgtaccgtactaccgagtacgagtggtacgtacgtacggtacgggttaacgggttcgtcggggtaccggaacggtaataccggttccgaccgttcggtaccggtacgaccgggtaccaacccggttcacccccgggtaccctcggtccctaaccgtttccgtacccgtaccttaccccccgg

SEQ ID NO: 90430 - DNA, 914 bp, Homo sapiens
  misc_feature: GYAE6OF02FVRSN.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctctcactttctgcacagtctctgacggcctcctatgagctgacacagcctacccgtggtgtcagtcgtcccaggacaaacggcaggactccgacctggacctcgtaggagtacttacacgttacgaaccctaaaaagtaaaccttaacgtttaaccgtttcggttttaccgggttacccaaacggaccgtaagggtaaacggttccgaaacggggtacccccgtaaccgggtacccccttaggttaacccgtttaccggttttacgtaacgtttacgtaaggttaccgggtaaccggtacccggtaaggtttaacccggaacccggtaaccgtaaccccgggtttaacccgggggaacctttcccccggtaaggggaacggttaacggttaaccgttttcccgtaacccgggttcccggtaccccgtttaacccgaacgggttcccgttaaccggggtaacgggtaccggttacggtaccgggtacccctaaccggtttacaccggttacgtcggtacgggtaccggggtaccgtacgggtacggtaaccggtacgtacggaacgtcgtacgtaccgttaacgtacggttacgtaccgtacgaccgtaacgtacgtaacggttcggtacgtacacggttacgggtaaggggttcgttacgggagggttaaccggtacggttacggtaccggtaaccggtttcccggttaacggttacccgtaaccgggtaccgtacgggttacccggtaccccgttacccccggttcgtaacccgtccgttacccggtttaacccccg

SEQ ID NO: 90431 - DNA, 1054 bp, Homo sapiens
  misc_feature: GYAE6OF02JKMFS.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggccttcctatgagctgacacacgcccacccgtcggtcgtcaggtcgtacccccagggaaccaaaccggccaggataccacctgccttcgtagggacgtacttactaacgttacggaaacccaaaaaggtaaacttactttaaccgtttacggtttccggtttaccacggtacgtaacggtaaacgtacggtaaccgggacccgtaccgggtacccccgttacggtaaccggttaggttacctacgtacctaacgtcggtacgggtaccccgtaagggtacccgtaaacggacccgtaaacccgtccgggggtaacctccccggttaggaacgtacggttacgtttccttaccggttccctaccgttacccgtacgtccgtaaccgggtaacgggtaaccggttacggtacccggggtaccccttaaccggtttaccgtaacccgtttaaccgtacccggggttaaccggggtacccgggggggttaccccggttaaacggggggttcccggtaaacccggtaaacggggttaccgggtaaacggttacccggtaaccgttaaccgtttaaccgggttttaaccgttttaccggtttaaaccccggtacccggtaaacccgtacgggttaaaaccggtaaccggttttaacgggggttacccggttaaccggttaaacgggtttacccgggggtttaacgggggggttttaacgggtacccgggggttaaacccggggggtaaccggggttaaaccccggttaacgggttttaccccggtaacccgggtttccgggtttaaccgggtaaccggtttaacccgaaccccgggtaaccgggtttccccggtacccccgggttaaccccggttccccgggtttaacctttccccgggttaccgttttacccccccgg

SEQ ID NO: 90432 - DNA, 644 bp, Homo sapiens
  misc_feature: GYAE6OF02HL7WB.21.8.A08.1.454.CMB.1.raw
  modified_base (460)..(460): a, c, t, g, unknown or other
  misc_feature (460)..(460): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctcgtgacggtccctcctatgacgctgacacacgccacccgttcggtgtcaggtccgtacccccgaggaaccgaaaaccgggccaaggacttccacctgctcgtaggatattcattacgaacaaaagtatattattgttagttccagcaagagtcgaggccaggccctagtactggtcactccagtgtacggctagtacgaacgacgtccgtaccgggatccgtagacgactattcgtctcgcctcaacgtcacgacggacgagtccgaccttacgttcgacttagtcggaggtcgggaccgtaggtacggagtagtaggtaanacgtagtaaccgttaagttacgttacgtaccgacaaccggtagaactacgtaggttacgtagtaacgttagggaaggggtttacacgggtacgggaagtaaccggtagtaccgtaccggtcgttacgtaccgaaccggtccgaacggtcgtcccggacccttgggaccttaccgtcgttcccgg

SEQ ID NO: 90433 - DNA, 878 bp, Homo sapiens
  misc_feature: GYAE6OF02HPP1X.21.8.A08.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngtctctgaggcctcctatgagctgacacacgcccacccgtcggtgtcacgtcgtccccgaggaaccaaaccggccaggactccgacctgctcgtaggagtattcgattcgaaccaaaaagtataacttacgtttgttacggttaccagtaccgaagtaacgtacgacggtaccccgaacgggtcccccttaggtaccgtcggttacccaacttacccgaagttaccgggaacggaccctaacgggttacccggaaccggtaacccgtacccgggttaccccggggaccttacccccggttagggaacggtaacgttaccgtttacccgttccggtcccgtaccccgttaccgaacggtcccgtaccggaacggggtaactaacgggtcccggtacccctacggtttacgacccgttaagtacccggtacggggtaccggggtacccgtagggttaaccggacggtaacgtacggtaacgtaccgtaacgtaaccgttaacgtttacggtttaacggttaacccgaaccgtaaacccggtaacgtaaccgttaaggttaccggttaacggtacgtacggttacgggtaacggggttacggttaccgggaacggggtaacgggtaaccggtacggtttccggtaacccggtttcgttaccggtaccgaaccggtaccccggttaacggtccccgtaccccggtacccccggttcggtaaccccgttaccgttccccgttaccccgg

SEQ ID NO: 90434 - DNA, 729 bp, Homo sapiens
  misc_feature: GYAE6OF02FI597.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttcngcacagtctctgaggcctcctatgagctgacacagcccaccctggtgtcagtcgtccccaggaccaaacggccaggatcacctgctcgaggagtattcattcgaccaaaagatatacttgttggttccagcagagtcaggccagccccctagtactggtcatccatggagccaagtccgacgaccacgtcccggggacttcccgtaggaagacggtactttcctcttcgcccctccgacgtccgtcgaagggaccacggtcgaccctaccgttcgaacttcgtaccgtagggtccggggacccgtaagggtcgggtacgtagtacggaaacgtcgtacggtaaccttaccgtttaacgtttacggtttaacccgccgtaacccgtaggtaaaccgtacggttaacgggtttacgtaccgttaaggttacgggttaacggggggtttaccttcgggggtaccggggtaacgggtaaaccgtaaccgggtttacggacccgggttttacccttacggggttaaccctaaccggtaccccgaacggtcccgttcccggtacccccccgttacgggttcccgtacccgtttcccgttacccccgg

SEQ ID NO: 90435 - DNA, 642 bp, Homo sapiens
  misc_feature: GYAE6OF02GWLE3.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctcctatgagctgacacagccacccgtcggtgtcagtcgtccccgaggacaaacggccaggactccacgtgactcgtggatattcattgaccaaaagaatatacgttgttcggttaccagcaagaagcacggccacggcccctgtactggtcatccatggacggccagtccgacgacacgtccggatcccgtgaagtagactttctcgtcgccctcgagtctacggagggactggtacggaccctaccgttgaacttacgtacgtacggggtccgggaccgtaggggtacgggaacgtagtagggaactccgtacgtaaccgttaacgtagttttacgtaccgacctaaccgagtacgaggttacggtgtacagtacgggaggggttacgtcgggacgggacggtacgtaacggttcggtaccggttcggttacggtacgaccggtacccgaaggtccgtacccggtccccggtcggtactaccgtccgttaccccgg

SEQ ID NO: 90436 - DNA, 862 bp, Homo sapiens
  misc_feature: GYAE6OF02JHD0C.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctggacgcctctatgagctgacacacgccctacccgtcggtgtcacggtcgtccccgaggaaccaaaccggccaaggactccgaccctgcctcgtgggatacttcagttacgaaccaaaaagtaacttacgttaactttcggtttcggttacccgaaggtacctaaggtaaccgttacacgggacccgtacccggtacccccttaggttaaccgttgggtaccctactaaccgtagtacggaaccgggccctaacgggttaccggaaccgtacccgtaaacccgggttccggggtaccttcccggtaggacgtaaggtactttcgtccctacggtccccttacgacgccgttaacggacgggtaactcgggtaccgtaccctaaccggtttacaaccgttacgtaccgggtcggggtacccgggggacccctaaagggggtccggtaaaccgggtagttaacggaaacgttcccgttaacgtaaaccgtttacgtttaaccgtttacggtaaaccccaccgtaaaccggtagtaaccgtagggtttaacgacgggttacttaacggtcgggggtttaacgggggtacgttaccggggaccggggttaaccgggtaaccgttacggttttcccgggacggtttacccgggtttccggaaggcccgtaccccggtacgggtccctacccgggtaccccgttcggacctttccgtcccgtttacccg

SEQ ID NO: 90437 - DNA, 668 bp, Homo sapiens
  misc_feature: GYAE6OF02IEME3.21.8.A08.1.454.CMB.1.raw
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (576)..(576): a, c, t, g, unknown or other
  misc_feature (576)..(576): n is a, c, g, or t
tcagtcgtcgctcgcacgaccggtgctcgatttagcatactctacagggggctgtgggctcaggaggcagagctctgggaatctcaccatggcctggaccccctctcctgccttcccccctcctcacctttctgcacagtctctgacggtcctcctatgacgctagacacacgccccacccgtcggtcgtacacgtcgtacccccgaggaaccaaacggccgaaggtactaccaccgtgcctcgtacggatacttcagttccgaaaccaaaagtattactacgtttcgttcgttaccgaagcgaagtacgtacgacggccacggtccctggtactcggttccagtcctaagtcggacgaccgtgccgaacgaccgtaccgtccggtactcccgaggagtacgtcttcctcgtaccgtcctacgcgtccgtacgagggtaccacggtaccgtacccgtacgttacgtactacgtcggtacgggtccgggcgtacggtcggacgtagtacgagtcagtaacttacgttacgttctaacgcacganacgtanaggtagtcgacgtgttacggggttacncgggacggacgtacgtagtaccgtacggttcgtacggttaccacggaccgtacgtccgtacccgtcccgtacggcttaccgtacgtccccgg

SEQ ID NO: 90438 - DNA, 863 bp, Homo sapiens
  misc_feature: GYAE6OF02JHDC9.21.8.A08.1.454.CMB.1.raw
tcagtcgtcgctcgcacgaccggtgctcgatttagcatactctacagggggctgtgggctcaggaggcagagctctgggaatctcaccatggctggacccctctcctgctcccctcctcacttctgcacagtctctgacggtcctcctatgagtctagacacacgcccacccgtcggtgtcagtccgtaccccgaggaacaaccgggccaaggactcctaccgtgcctcgtaggtactacttctattcgaaaccaaaagtaacttaacgttacgttggtttaccggtaccagacgaagtaacgtcgacggaccgaccgtccccgttagtaccgtggtacctacttccgaaggtaggaccggtaccgtaggtaccgtaaccgtaccgtacccggtacccgggtacttaccccggtaggtaacgtaacggttacctttaccgtaccgtcccgttaccctacccggtaacgttacccggtacggtaaccggggtaaccgttaacgggtacccggtaccccgttaaccggtttcgtaaaccgttacgtaccgggtaacgggtacccgggacccggtaaggggtaccggaacgtaggtacggtaacggtccgtacgtaacttaccggttaacgttccgaacccgtaacctaacctaacggtaacggtacggttaacgtcggtacgaccgggttagggtaacgggggttaaccgttacgggggaacccggtaagggttaacccgtacgggttccgtaacccggggttcttaaccgggtaccggtaacccggttaacccggaacggtttcccgtacccccgggttccccggttacggtaaccccgttaccgtcccccggtttaaccccgg

SEQ ID NO: 90439 - DNA, 722 bp, Homo sapiens
  misc_feature: GYAE6OF02F8VPW.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatgagctgacacagcccacctcggtgtcagtctcccaggacaaacggccaggactcacctgcctctgggatacttcaattcgacaaaaagtattatctttggttcgttccagacaagtaagtcacggccacggtcccttaggtacctggtcactccgatggaccgcgaagtcggaaccactccggtccggtactcccgtaggatacgtacttcgtctcgtccctccgatcccgtagaacgggtactggtccggaccctacgttgaaccttcgtacgaacgggtccgggaccgtagggtacggaacgtacgtaggaaacgtcgtacgttaaacgttaacgttacgtttacgtaacccggaccaaccgtaacggaacgttaacggttacggttacgtaacgtaggtaccggggttagggggttaacgtaccggggtacgggtaacgggaacccgttaggtttccgggtaaccccggttccggttaacggttaccggacccggttaacccggaacgggtcccgttcccgggtacccccgttccgggttacccttacccgtcccggtttaacccccg

SEQ ID NO: 90440 - DNA, 842 bp, Homo sapiens
  misc_feature: GYAE6OF02G4DBH.21.8.A08.1.454.CMB.1.raw
  modified_base (254)..(254): a, c, t, g, unknown or other
  misc_feature (254)..(254): n is a, c, g, or t
tcagtcgtcgctcgcacgaccggtgctcgatttagcatactctacaggggggagaggagcccagcactagaagtcggcggtgtttccattcggtgatcagcactgaacacagaggactcaccatggaggtttgggctggagcttgggttttcctccttgcttacttttaagaggttgtccagtgttcagcgcaactggtggagtcgtggggagcagtcggttccagccttaggggacggttcccagacgccttnaccgtgtcggacaggccgttcgtcgggattcgtacgttacgtccggtccttcccgttttgaccctacgttcggacgtacccggttccggggttccccggaccggttaacgggccccgttacccggtaacgggaccgggtaaacgggggccggtttaggggtaagggtcggggggttaacgggcggtaagttttagttaccggtagggttagtacggaaggtttacgggaaggtttggaacggtaagttacttaagtttacgtttacggaacgtaccgtttaccgggtaaagggtaccgggtaccggtaaggttccctaaaccgactttaaccgtcgtaaaacggacgggtaaacctaaacgtaccggttaaaacccgaaacgaaacccgtaaaccgtaaacccgttagtttaccggttaaacctttaacgtaaaaccgtttaaccggtacccggttacgttaaccgacgggtaaacgtaccccgggaagaaacccgtacggtaacgttacgtcgtttaacgttaacgttaggtaccgtaggttccgttagtccgttaggtcggtacggtaccggaccgttggtacccg

SEQ ID NO: 90441 - DNA, 822 bp, Homo sapiens
  misc_feature: GYAE6OF02F536X.21.8.A08.1.454.CMB.1.raw
  modified_base (175)..(175): a, c, t, g, unknown or other
  misc_feature (175)..(175): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacagtctctgacgcctctatgagctgacacacgcccaccctggtntcagcgtacccaggaccaaacgccagactcactgactcgtaggatacttcgattacgaaccaaaaagtatacttaacgtttgtttcggtaccagacgaagaacgttccgacggacccaacgggtccccccttaggttaaccgtacgggttaccaacgttaccccggaaagttcgggtaaaccgggcccgttaaacgggaccggtaaaccggtaacccgtaccgggttaaccccgggggtaaccttaccccggtaaggaaacgacgttaactttcctacgttccgacccctacccggacggtttaccaacggtaacgggtaacctagggttaccggaacccccttacgtttacgtaaaccgttaactaccgtacggggtacggggacccggtaagggtacgggaaccgtaataagggtaaccgcgtacggtaacttaaacttacgtttaacgttaaccgacctaacgaacgtaacgtaacgttaaggtccgtagaacgtaggttaacggggttacgtcggtaacgggtacgggtaacgttacgggttaccgtaccggttaccggttacggtaccgtaccggaaccgtaaaccgggtccgttaccggacccccgtttccggtaccgtacccgttccggttaaccccccg

SEQ ID NO: 90442 - DNA, 680 bp, Homo sapiens
  misc_feature: GYAE6OF02FY19N.21.8.A08.1.454.CMB.1.raw
  modified_base (104)..(104): a, c, t, g, unknown or other
  misc_feature (104)..(104): n is a, c, g, or t
  modified_base (400)..(400): a, c, t, g, unknown or other
  misc_feature (400)..(400): n is a, c, g, or t
tcagtcgtcgctcgcacgaccggtgctcgatttagcatactctacagggggctgtgggctcaggaggcagagctctgggaatctcaccatggcctggacccctntcctgcctccccctctcactttctgcacagtctctgacggcctcctatgagctgacacacgcccacccgtcggtgtcagtcgtccccgaaggaccaaacggccaaggactccaccttgcctcgtgggaatacttcagttacgaaccaaaaagtattacttacgttggttacggttccagcagtaagtcgaggcctacggccctgtacgtggctatccatggacgccaggtacgacgacacgtaccggactcccgtagagagtcttcgtctcgtcctacgagtcgacgtacgggacngtccggacctacttcgactagtcgagggtcgggaccgtagggtacggacgagtacggaacgtcgtacgtaacgttacgttagtttacgtaccgtaccaaccgtagacgtaaggttacggttggtacttacgggtacgggttaggggtacgttaccggggaggggtacggtaccgttaaggttcccggtaccggtttccggtacgggtacgacccggtaccggtaacggttcccgtcccggttacccccggttcggtacccttacccgtcgtttacccccg

SEQ ID NO: 90443 - DNA, 689 bp, Homo sapiens
  misc_feature: GYAE6OF02GW2JG.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacacgcccacccgtcggttcgtcacgtcgtacccccgaggaccaaaccggccaggactccgacctgctcgtaggagtattcagttcgaaccaaaagtaatactactttggttcggttaccagacgagaacgtcgacggccgtacggcccccttgttaccgtcggtaccactaccagtcggacggcctaggtccgaccgaccgaccgtcccggggactcccgtaggacgtacgtactttctacgtcgtacccctcgacgtcgtacgacgggaccaggtccgaccctaccgtttcgacgtacgtacggtacgggtccgggaccgtagggtcggtaacgagtaggaacgtctacggtacttattacgtttacgtaccgcaccgagacgtaggttacgtacgtacgtaggtacgggtagggttcgtacgggacggaacgggtaccgtaggttccggtaccggttcggttacggacctaccggtacccgaggtacccgtcccggtcccgtacggtccctaccgtcttcccccg

SEQ ID NO: 90444 - DNA, 711 bp, Homo sapiens
  misc_feature: GYAE6OF02FTATG.21.8.A08.1.454.CMB.1.raw
  modified_base (130)..(130): a, c, t, g, unknown or other
  misc_feature (130)..(130): n is a, c, g, or t
  modified_base (180)..(180): a, c, t, g, unknown or other
  misc_feature (180)..(180): n is a, c, g, or t
tcagtcgtcgctcgcacgaccggtgctcgatttagcatactctacagggtgctgtgggctcaggaggcagagctctgggaatctcaccatggcctggacccctctcctgcctccccctcctctactttcngcacagtctctgacggccctcctatgagctgacacacgcccaccgtggtntcagtcgtcccgaggacgaaacgccgaggactccaccgtgctcgtaggactattctattacgaaccaaaaagtattattacttggtcggttaccagacagaagtcacggccgacgtccctagtactcgtcactcagtgagccgagtcgacgactacgtccgggtacctcccgtagacgtacgtacttcgtaccgtccggtccctcccgagtcccgttacggacggggtacacggggtccggtacccgtaaccgtagtaaccttacgtacggtaccggggtccggggtaccccgggtagggttaccgggaaacggtacgtacggaacgtcgtacggtaaccttacggttacgtttaacggtaccgcccgtaaacaccggtaacgtaggttaacgtcgtacgtaagttaccgggtaagggtcggtacggggaccgggtacggaccggtacggttaccggtaaccggttccgttacggtacgaccggtaccgacggtcgtaccccggtccccgtcggtacccttaccgttcccg

SEQ ID NO: 90445 - DNA, 732 bp, Homo sapiens
  misc_feature: GYAE6OF02IVEMY.21.8.A08.1.454.CMB.1.raw
  modified_base (160)..(160): a, c, t, g, unknown or other
  misc_feature (160)..(160): n is a, c, g, or t
  modified_base (502)..(502): a, c, t, g, unknown or other
  misc_feature (502)..(502): n is a, c, g, or t
  modified_base (637)..(637): a, c, t, g, unknown or other
  misc_feature (637)..(637): n is a, c, g, or t
tcagtcgtcgctcgcacgaccggtgctcgatttagcatactctacagggggctgtgggctcaggaggcagagctcgtgggaatctcaccatcggcctcggaccccctctcctgcctcccccctcctctactttctgcacagtctctgacggccctctagngagctagacacgacgcccacccgtcggtgtccacgtccgtccccgaaggaaccgaaaccggccaggactccaccgtcgcgtacgtaggacgtacttcacttacgaacctaaaaaaggtaattaactttaaccgttttggttccggttacccagtaccgtaaggtaacgtaccggaccggacccgtaaccgggtcccccttaggtaccgttcgggttaccacgtaccgtagtacggaccggtcgacgtaccgaaccgaccgtaccgtccgggtacctccgtaggacgtacgtacgtctccgtacgtccctaccgacgtcgacggacggtcacggtcgaccctntacgactagcgtacgggtcggaaccgtggacggaacgtagtacggaactgtaacgtcgttaacgttagttacgaccgtcaacgtcgaacgtaggttacgcgtacgtagtcgggttacggaccggttggaaccggngggtaacctggttaccgtccgtaacggtccggtaacgaacccgtcggtaccgccgttacccggtcccgtccggtaacgtccgtcccgttaccccg

SEQ ID NO: 90446 - DNA, 650 bp, Homo sapiens
  misc_feature: GYAE6OF02FQ6DR.21.8.A08.1.454.CMB.1.raw
  modified_base (222)..(222): a, c, t, g, unknown or other
  misc_feature (222)..(222): n is a, c, g, or t
  modified_base (325)..(325): a, c, t, g, unknown or other
  misc_feature (325)..(325): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgaccacagcccaccctcggtgtcagtcgtccccaggacaaacggccaggatcacctgctcgtgganattcattgaccaaaagatatacttgttggttccagcagaagtcaggccaggcccctgtactgacagtccatgacgccagtcgacacacgtccgggactcccgngagacgtattcctgtcgcctccagctacgaggactaggtcgacctaccgttgaacttacgtaccgacgggtcgggcccgtagggtcggaaccggagtacggaacgcgtacgtaaccgttacgtagtttacgttaccgacctaacccgtagaaccgtaaggttagttcgggtacaggttaccggaggggggttaacttccgggacgggaacgggtaaccgttacggttacggtaacccggttccgtttacggaccgtaacggttacccggaaggtccgttaccccggtaccccccgttgggtaccctaccgtccgtttacccccgg

SEQ ID NO: 90447 - DNA, 886 bp, Homo sapiens
  misc_feature: GYAE6OF02I5WO1.21.8.A08.1.454.CMB.1.raw
  modified_base (157)..(157): a, c, t, g, unknown or other
  misc_feature (157)..(157): n is a, c, g, or t
tcagtcgtcgctcgcacgaccggtgctcgatttagcatactctacagggggctgtgggctcaggaggcagagctactgggaatctcaccatggcctggacccctctcctgcctccccctcctcactttctgcacacgtctcgtagaggcctcctagngagctgacacacgccaccgtcggtgtacagtcgtcccgaggaacaaccggcgaggactccactcgctcgtaggatagttcaagttcgaacccgtaaaaagactttaagttaaccgtttcggttttaccgggtaccctaaggtaccgtaaggtaaaccggtccgtaaccggaccccgtaaccgggtcccccttaaggttaccgttaccggtactaccgttaccaggttaccgggacggtcccgacgggttaccaaccgaccggtaaccgtacccggggtccgttacccgtaggaaacgttacgtaactttccgcgtaccgacccttacccgtacggttacgaaccgggaacggggtaacctacggggttcccgacccctttaaaggttccgtaaaccgttacggtaccgggttacccgggggtaccggggtaccccgggttaacggggtacgggaacggttacgttaacgggaaacccgttacggttaaccggtaacggtttaaccgtttacggtttacccgggttaaccgaaccccgtttaaccgggaacggtaaccgtagggttacgttacggtacgttaacggtacgggtacggggttaacggttcccgggagggtaacggtaccgtttaaggggtccgttacccgggttcgttaacgggtacccacgggttacccgaacgtccggtcccgtacccggttacctcccggttacttcccggttacccg

SEQ ID NO: 90448 - DNA, 726 bp, Homo sapiens
  misc_feature: GYAE6OF02IAEFX.21.8.A08.1.454.CMB.1.raw
  modified_base (104)..(104): a, c, t, g, unknown or other
  misc_feature (104)..(104): n is a, c, g, or t
  modified_base (142)..(142): a, c, t, g, unknown or other
  misc_feature (142)..(142): n is a, c, g, or t
  modified_base (151)..(151): a, c, t, g, unknown or other
  misc_feature (151)..(151): n is a, c, g, or t
  modified_base (160)..(160): a, c, t, g, unknown or other
  misc_feature (160)..(160): n is a, c, g, or t
  modified_base (175)..(175): a, c, t, g, unknown or other
  misc_feature (175)..(175): n is a, c, g, or t
tcagtcgtcgctcgcacgaccggtgctcgatttagcatactctacagggggctgtgggctcaggaggcagagctctgggaatctcaccatggcctggacccctntcctgcctcccctcctcactttctgcacagtctcgtgnggcctctangagctgacncacgccaccctggtncagtcgtccccgagaaccaacgccaggactacaccgtgacctcgtggatattctagttacgaaacaaaagtaatacgtactttaggtttcggttaccgagacgaagtaacggtacgacggacccgtacggtccccctaggttaccgttcggtacacctaccgtagtacgggcggacctggaccgtaccgaccgtaaccgtcccgggtaactcccgtaggaacgtgtaaccttctaccgtcgcctacgacgtccgtacggaaggccgtagccggccttaaccgtgtaaacccttcgtacgtacgggtccgggtacccggtaggggtacggtacggtacgtacggaaggtaccgtacgtacttacgttagttacgttaccgtaccgtaaccgacgtaagtacgttaggtacggtcgtagtacgggtagggggttacggtcgggtacgggtaacgggtacgtacgtacggtaccggttcgttccggtcggtaccgacccgtaacggtcccggtacccgtcccggttacccgtacccgttacgtccgttcccccg

SEQ ID NO: 90449 - DNA, 800 bp, Homo sapiens
  misc_feature: GYAE6OF02HTZQC.21.8.A08.1.454.CMB.1.raw
  modified_base (254)..(254): a, c, t, g, unknown or other
  misc_feature (254)..(254): n is a, c, g, or t
  modified_base (527)..(527): a, c, t, g, unknown or other
  misc_feature (527)..(527): n is a, c, g, or t
  modified_base (668)..(668): a, c, t, g, unknown or other
  misc_feature (668)..(668): n is a, c, g, or t
  modified_base (740)..(740): a, c, t, g, unknown or other
  misc_feature (740)..(740): n is a, c, g, or t
tcagtcgtcgctcgcacgaccggtgctcgatttagcatactctacaggggctgtgggctcaggaggcagagctctggaatctcaccatggcctggaccccctctcctgccttcccccctcctacgctttctcgcacctagtcctcgtagacggtcccttacctaagtcgagtctagaacacgacgcccctacccgtgggtactaccaggttccgaccccgaaggaccaaacggcctaaggactaccgccgtacncgtttaccgagggtatatttaccgatttacggaaccctaaaaaaggtactttaaacgttccggttttaggttacgtttaccccgtaggtaaaccgaaaggtaaccggtacggtaaccggaccccgtaaaaccggttcccccccttaaggttaacccgttcggtaacgtacgttacccgtaagaccggtaacgtaccgtacggtacgtaaccgaacccgtacgtacccggtagtacccgtgaagacgtagtcctacgtcgtccacgacgtaccncggtaaggaacgtgtacccggtaaccgtaaccgttcggaacttacgtaccgtaaggggtttccggaacggtaacggggacttaggaaacgtagaacggtcttaagaacgttaacttaccgtttacggaccgtacaaaccgnggaacttaggtacgttagcccgtaagcgggttaagttggacggacgggtacgacgttaacgcgtaaccggtntccgggtaactcggaccgaacgtcgaccccgtaccggtaccgtactacgtcgttaccccg

SEQ ID NO: 90450 - DNA, 917 bp, Homo sapiens
  misc_feature: GYAE6OF02H74GC.21.8.A08.1.454.CMB.1.raw
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
tcagtcgtcgctcgcacgaccggtgctcgatttagcatactctacagggggctgtagggctcaggaggcagagctctgggaatctcaccacggcctggaccctctcctgcctccccctcctctactttctgcacacgtctctgaggcctaccttatgagctagaccncgacnccctacctgggtctcgagtcgtacccgaggaaccaaaccggccgaaggctaccgacgtcgacttcgaggattacgttactagtaccaaaacgtaaacgtattaacgtttcgttttcggtacgtacgaacgtcgtaagtacgtacgaccggtaccgccggttacccttggtaccggttcgtacctacgtccgtagtacgggaccggtacacgggtaccgaaccggtacccgtaccggtccggtaccttccgaggtacgtacggttactaccgtggtcccctacgtccgtaaggtccgtacgggtaaccggaccgttaccggggtccctaaccgttaaccggttaccgtaaccgtttaggggtaaccggttacggggtacccggggaaccgggttacgggtacgggaaaccggttacggtaacggtaaaccggttaccgtaacgggttaaacgttttacgtttacgtttaaacccggtaccgtaaacccggtaaaccggtacgttaaccggtttacgggtacggttaccggttaacggttaccgggggtagggttaacggggtaccgggttacgggggacccgggtaaaccggtaccggtttacgttaacccggggttccggtttaccggaaccgggtaccggtacccggttaaccggtacccggttaaccccggggttccccggttcccgttaacccggttacccggtttaccccggttttccccggtacccccggtttccccccg

SEQ ID NO: 90451 - DNA, 861 bp, Homo sapiens
  misc_feature: GYAE6OF02HYCH0.21.8.A08.1.454.CMB.1.raw
  modified_base (131)..(131): a, c, t, g, unknown or other
  misc_feature (131)..(131): n is a, c, g, or t
tcagtcgtcgctcgcacgaccggtgctcgatttagcatactctacagggggctgtgggctcaggaggcagagctctgggaatctcaccatggcctcggacccctctcctcgcctcccctcctctactttcngacacagtcctcgtgacggcctacctatggacgctagacacgacgaccctaccgtcggtcgtcacggttccgtaccccgaagggaacccaaacggccgaaggactcgaccgttgccttcggtaggataattctaagttacgaacaaaaagtattattacgttaggttcggtaccagacaagaacgtccggagtcccgacggtccccttagtaccgtgtaccactcctagtcggacggtaccgaggtaccgaacgacccgtacggtaccccgggtattcccgaggaacgttctattccgtcgtacgtacccgtcaacggtcgtaacggaggaactcggtacggtacccgtacctttagaacccgttaggaccggtaacgggggtaccgggtaaccggtaagggtacgggtaacggtacgtaaacgggtaaccgtacggttaacgtaacgttaccgttaaacgttttccgggaaacccgaccggtaaacccgaagggtaaccggttaaccgttaacgggttcccggtaaacgttacgggttacgggggtttaacggggttaccgggttaaccggggaaccggggtttaaaccggaccgggtttaacgttacccgggtacccgtttaacggggtttacccggaaccgttaaccccgggaccggttaaaccggtccccgttacccccgggtcccgtttaaccggaccttacccgggtttacccctaacccccgg

SEQ ID NO: 90452 - DNA, 754 bp, Homo sapiens
  misc_feature: GYAE6OF02G141K.21.8.A08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgacgcctcctatgagctgacacacgcccacccgtcggtntcacgtcgtcccgaggaccaaacggccaggactccacctgctcgtggatacttcattacgaaccaaaaagtaacttaacgttaccgttttaggtttacggttacctaaggacgaacggtaacggtaccgacggtacccgaccggtaccccgttacggttacgtacggtaccgtactaccgtacggttacgggaaccggacccgtaacggtacccggaaccggaaccgtaccggttacccgggtaaccgttaccccgtgggtaacgtacgtacgtttacctccgtacgtaccctccggaacgtcgtacggtacggacgtacgggtcgacccgttaccgttacgtaacttacggtacggacgggtccgggtaccggtaagggtacggaacgagtacggacgtcgtacgtacttacgttagttacgtacgtaaccacacgacgtaggtacgtcgtacgtagtagggacgggttacgtacgggacgggacggaacgttacggtacgtccggtcggttacggcgaccggtacccgaggtcccggtcccgtacccgttcggtacctcttccgttaccccg

SEQ ID NO: 90453 - DNA, 750 bp, Homo sapiens
  misc_feature: GYAE6OF02HMFWE.21.8.A08.1.454.CMB.1.raw
  modified_base (156)..(156): a, c, t, g, unknown or other
  misc_feature (156)..(156): n is a, c, g, or t
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctcctatganctgacacacgcccacctggtctcgagtcgtccccgaagacgaaacggcaggactccaccgtgctcgtggaatnttacagttacgaacctaaaagattacttacgtttcgttcggttaccagacgaagacgtcgacggaccgtacggtcccctgtacgtcgtactactaccgagttcggacggccctaggtaccgaaccggtacgaaccggtccggggtacctaccggtacggaagacgttccttaccgtccgtacgtcccttaccgagttcccgtacggaacgggtacctagggtacccgtacccgttaaccgttaagtacccgttacggtaccggacggggttacccggggacccgttaggggtacgggaacgtaaggtaacggacgttccgtaacgtacttacgttaacgtttaccggtacgaccgtaacgacggtaacttagggtacgttacggtacgtacggtacgggtacgggttcggtacgggacgggacggtaacgtaggttacggtaaccgttcggtacggtccaacggacccgtaacggttccgtaccccggtccgttccggtaccctcggttaccgttccccgg

SEQ ID NO: 90454 - DNA, 910 bp, Homo sapiens
  misc_feature: GYAE6OF02FT0JB.21.8.A08.1.454.CMB.1.raw
  modified_base (168)..(168): a, c, t, g, unknown or other
  misc_feature (168)..(168): n is a, c, g, or t
  modified_base (409)..(409): a, c, t, g, unknown or other
  misc_feature (409)..(409): n is a, c, g, or t
tcagtcgtcgctcgcacgaccggtgctcgatttagcatactctacagggggggagaggagcccagcactagaagtcggcggtgtttccattcggtgatcagcactgaacacagaggactcaccatggtagtttggctgagcttgggttttcctcttgcttctttaagnggtgtccagtgtcaggcgcaactggtggtaggtcgtgggggagcagtggtccagccgtgggacggtccctgacgtccctctccgtgtcgcgacgtcgtcgtggtacttcgaaggttacgtccgggtccttttacccgtttcggacctaacgttcggaccgttacccgggttcgggttacccccggacccggtacgggttcccgttaaccgggaacgggggaaccggtaaccggggggggtntttaccggggggtaagggtttcgggggggttacggtacccgggtttaagttttacggtaccgggttaggggtttacgtaaggggtaacggtttaggggtaaaacgggggtggtaaaggtagggttaaacgtttaagttttaacgttaccggaaccggtttacccgggtttccgggtaaggggtaaacccggggtacccggttaacggtttaacccgtaacccgtacgttacccgttaccggtaaacggaacgggtaaaccgtaacggttaccgaacccttaaacccgaacccgtaacttacccgtaacgtttaacctttaccggttaaactaaacggtacccggtacccggtaccgtaacgggaacggtaccggaccggtaaccggaaccgacgtaacgttacgttacgttaaccgttacggtaggttaaccggtacgtttacggttacggttacgttacgggtaccgggtaccggtaaccggttaccgtcggtaacccgg

SEQ ID NO: 90455 - DNA, 724 bp, Homo sapiens
  misc_feature: GYAE6OF02IBKBA.21.8.A08.1.454.CMB.1.raw
  modified_base (124)..(124): a, c, t, g, unknown or other
  misc_feature (124)..(124): n is a, c, g, or t
  modified_base (162)..(162): a, c, t, g, unknown or other
  misc_feature (162)..(162): n is a, c, g, or t
  modified_base (195)..(195): a, c, t, g, unknown or other
  misc_feature (195)..(195): n is a, c, g, or t
tcagtcgtcgctcgcacgaccggtgctcgatttagcatactctacagggggctgtgggctcaggaggcagagctctgggaatctcaccatcggcctcggacccctctcctcgcctcccctctcnctttcagcacgagttcctctggacggtccctacctagngaggtcacgaccacgacgcccaccgttcgggtntcgcggttccgacccgaggaacgaaccggcaaggtactccgccgtgctacggtgggaactcttacagttacgaaactaaaataattacgttacgttggttcggtacagtacgagtaacgtcgacggcctacggtccctaggttagtcggtacctacgtacgtacgtggaccgaccttaggacccgacgacccgttacggaacggcctaccgtaggacggtaacttcgtcggtactcgtcccggtatacggctacggggacggtactacggtaccgcctacccgttagtaactcgtacggtacggtccgggtaccgaggacgtacggtacgacggtaacggctacgtaacgtacgttacgtacggttaccacgacgtaacgtacgacgttacgtcgtacctaggtacgggttacggtacggtaccggaaccgggtagtacgtacgggttacgtccgttaacggttcggacctacgggtacccgaggttcccggaccgtcccgtacggttccgtccgtaccggttaccccg

SEQ ID NO: 90456 - DNA, 764 bp, Homo sapiens
  misc_feature: GYAE6OF02G5WET.21.8.A08.1.454.CMB.1.raw
  modified_base (128)..(128): a, c, t, g, unknown or other
  misc_feature (128)..(128): n is a, c, g, or t
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcngcacagtctctgacggtcctcctatgagctgacacacgccctacctcggtntcagtcgtacccagacaacgccagactcactgctcgnggtatattcattacgaaccgaaaatatattacgttggttacgtaccagacgaagtaacgtcgacggacccaccggtcccttacggtacgtacggtacaactccgaagtcggacggccgtaggtaccgaaccgaccgtaccggtccgggaaccttccggagaacggtacgtactttcctacgtccgtaccctacgactccgtacggagggtactacgggtccgacctaccgtagtaccctagtaccgggtacgggtacccgggtaaccggtagggttacgggaactaggtaacggtaacggttacgtaaccgtaacgttaaccgtttaacgtttaccggttaaccacccggtaaacgtacgtaaccggttaggtaccggttacggtaccgtaacggtcggggttaaccggggttcggaacccggggtagtaacccgggtaacgttaccgggtaccggtttcggtaacccggtcgtaaaccgggccccggttaaccggcggttcccggtccccggtcccggttaccgttactcccgttcccgttaccccg

SEQ ID NO: 90457 - DNA, 769 bp, Homo sapiens
  misc_feature: GYAE6OF02IAT8B.21.8.A08.1.454.CMB.1.raw
  modified_base (155)..(155): a, c, t, g, unknown or other
  misc_feature (155)..(155): n is a, c, g, or t
tcagtcgtcgctcgcacgaccggtgctcgatttagcatactctacagggggtgggctcaggaggcagagctctgggaatctcaccatggcctggaccctctcctgctccccctcctcacttttctcgcacacggccctgacggcctcctatgganctgacacacgccctacccgtcggtcgtactacgtcgttacccccaggaccacggaccggtcccgaggactaccgaccttgcctcgtcgaccaggtatcggactacggaacctaaaagtaaagtacttgtacgtttaagttacggttaaccaaacgaacggaacggacccgacgggaccctacgggccccgttggtacgtttagtaagtaatagtaattaaacgaccgtacgtggaacggtacgtaccctagaccggtacgtaacctgtacgggtctacgtaccttctttcgaccgtccgacgagtccgttacggacggtaacgacggtactacgttccgtacccggtttaggtaaccttaacgttccggtaacggttaacggtaacgttacccgggtaggaccgtaaggaaacccgggtaagggtcgacgttcgggtaaattacgttacgtacgtaacgaaacttacgggtaataacggacgtacggtacggttacgttaccggtttgcggggttaccggttagggaccgggtacggaccgtagtaacgtcggtaccgtaccggttacgaaccgcggtaacccgacgtccgaccggttccccgaggttaccccg

SEQ ID NO: 90458 - DNA, 717 bp, Homo sapiens
  misc_feature: GYAE6OF02GABEM.21.8.A08.1.454.CMB.1.raw
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
tcagtcgtcgctcgcacgaccggtgctcgatttagcatactctacagggggtgggctcaggaggcagagctctgggaaatctcaccatggcctggacccctctcctgcctccccctctctactttctgcacagtctcgtgaggtcctcctagtgagctgaccactacgccctacccgtcggtggtcagttcgtaccccgaggaaccgtaaaccggccgaagggtactaccaccgtgtccttcgtgaacgtattcctagttacgaaccctaaaaagtaacttacttacgtttcggttcggttccaacgacgaagtaacgtcgaacgggtcccgaacggtcccccttgtaccgtcggacctactcggaacgtcggacggtaccgtacgtcggacgtaacctaccggtccgggacctccggngacggtgtctccgtaccgtctcccgtanacgtccgacgngggtaccncggtcgtaccgtcttcgtactacgtcggnggtccgggtaccgtgggacgcggtatacggtagtcgtacgtaccctagttacgttacgtaccgtaccagtacgtacgtaagtcggttacgtcctagtacccggggtgggttacgacgggtacgaccggtaatacggttccgtaccgtcgttcgggacctacgaccggtcgccgtacccgtcccggtaccgtccgtaccgttcccgttacctcccggttcccg

SEQ ID NO: 90459 - DNA, 792 bp, Homo sapiens
  misc_feature: GYAE6OF02HKSWE.21.8.A08.1.454.CMB.1.raw
tcagtcgtcgctcgcacgaccggtgctcgatttagcatactctacagggggctgtgggctcaggaggcagagctctgggaatctcaccatggcctggacccctctctgcctccccctctctactttctgcacagtctctggacggcctcctatgagctagaccacacgccctacccgtcggtgtctagtcgtacccgaggaaccgaaacggcccaagggtactaccgaccgtgcctcgtaggatattacctatacgaaaccaaaaagtatttacgttaacgtttcgggtttacgttacgacgtacgaaaggtaacggtcgacggtaccgaaccggtccccttaggtacctaggtacttaccgactaccgtaagtcgggaacggaccaacggtccgaaccgtacgaaccggtccggtaccttacccggtagtagacggttaacttcctcgtacgcctaccgaacgtcctacgggaacgtagtacgtccggacctacgtttacgacttacgtccgggtacggtacgggtcccggtaaggggtacgggtaaactacggtacgtaaacggtcttaaacggtaacttaaccgtttaggtttaaccgaccgtaaccgtaaccgaagggtaaccgtaggtttacggtacgtacggtaacggtacggggttaggggttaccgtacgggggaaccgttacgggaaccgttaagggtacccggtaacgttccggttaggaccgtaccgggaacccggtcggtaccgtaccccggtccccgggtagttaccgtacccttccgg

SEQ ID NO: 90460 - DNA, 653 bp, Homo sapiens
  misc_feature: GYAE6OF02GNL7V.21.8.A08.1.454.CMB.1.raw
  modified_base (336)..(336): a, c, t, g, unknown or other
  misc_feature (336)..(336): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagccaccctcggtgtcagtcgtcccccaggacaaacggccaaggatcacctgctctggagattcattcgaccaaaaagaattatacttgttgttccagcagaagtcagcctacggcccctgtacgtggtcatccatgaggccaggtcgacgactacgtcccggatcccctgganagacttctctgtcctccgagcctcgagggactagtcgccctacgtcgactactcgaggtacgggccggacggtcggacggtagtaggaacgacgtagacttaacgttacgtttacgttaccgtaccaaccgaacgtaacgaacggtatacggggggggggtactagtacggtacggggttacggttaccgggtcgggacggggtaccgtaacggttaccggtacccgggttaccggttcggttacgtaccggtacccgaacgggacccgttaccggtccccccgttcccggtaccgtacccgttaccgttaccccgg

SEQ ID NO: 90461 - DNA, 762 bp, Homo sapiens
  misc_feature: GYAE6OF02FOLVT.21.8.A08.1.454.CMB.1.raw
  modified_base (257)..(257): a, c, t, g, unknown or other
  misc_feature (257)..(257): n is a, c, g, or t
  modified_base (365)..(365): a, c, t, g, unknown or other
  misc_feature (365)..(365): n is a, c, g, or t
tcagtcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacacgccacccgtcggtgtacagtcgaccccgaggacaaaccggccaaggactcacctgctctggagcttacattcgacaaaagatatacttgttcgtcancagaacgtcgagccacgcccgtagtaccgtggtacactaccgatacggacgccgtaggtaccgaccgaccacgtcccgggtactacccgtagacggtacgtacttacncgtcgtcctacccgtagtccgtacggacggtacgacgggtaccgtaccgttaaccttacggaacttactaccgggttacggtaccggggtaccggtaagggtacgggaacgtaacggtagggaacgttaccgacgttaaccgtaacgtttaggttaaccgtaaccgccgtaaacccgtaaggtaaccttaacgggttagttacggacggtttacgtacgggttaagggggttacgtttacggggaccggtaaaccgggtaaccgtaaggtttacgggtacccgttaccggttacgggtaaccggtaccggtacccggtaaggttcccgtacccggggttaccccttccggggtaccctaccgttacccggtttacccggtttaccccccgtaccccg

SEQ ID NO: 90462 - DNA, 698 bp, Homo sapiens
  misc_feature: GYAE6OF02GJ139.21.8.A08.1.454.CMB.1.raw
  modified_base (349)..(349): a, c, t, g, unknown or other
  misc_feature (349)..(349): n is a, c, g, or t
  modified_base (483)..(483): a, c, t, g, unknown or other
  misc_feature (483)..(483): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgaacacagcccacccgtcggtgtcagtcgtaccccaggaacaaacggccaaggactccaccgtgtctcgtaggatacttcgagttcgaaccaaaaaggaacttatacgttttggttcggttaccagacagtaagtccgaaggccacggccccttggtactggtctatccagtcgacgccgagtcgacggacncgtccgggaactcccgtgacgagtacttctcgtcgccttacacgtctacggaggtaccgaggttcgaccctaccgttagtacgtactcgtagggtccgggcccgtaagggtcggaacgtactgggaacgcgtanacgttaacgtagtttacgtaccgacctagaaccgtagtaaaggttcggtaggtactacggttacgggttacgggggttacgtcgggaaccgggtaacgggttaacccgtaggttccggtacccggtttccgtccggttaacggaccggtacccgtaagggtcccgtaccccggtacccccggtttcgtacccgttaccggttcccttacccccgg

SEQ ID NO: 90463 - DNA, 756 bp, Homo sapiens
  misc_feature: GYAE6OF02GL26G.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgccaccctcggtgtcagtcgtccccgaaggacaaacggccaaggactccacctgccttcgtgggaacgtattcattacgaaccaaaaagtaattaacttaccgtttggtttacggttaccagacgtaagaacgtcgaacggccgaacgggcccccttagtaaccgtggtccaactccgagtcggaacggtccaaggtccgaacgaaccgtaccgtcccggggaacttccccgtaggacggtaagttacctttccgtacgtcgtaccctccgaaggtcctacggacgggtactaacgggttccggacccgtacgttacgaaccttagtacgtacgggtcggggaccccgtaggggtacggtaacggagtaaggaacggtacgtacgtaacgttaacttacgtttacggttacccgaaccgaaccgtaagtacgtaaggtacggttacgtacgtacggtagggttacgggggttacgtcggggaacgggaacgggtaaccgtaggtccggtaccgttccggttacggtaccgaaccgacccgtacggtccggtcccggtacccccggttcgtacccgttccgtccgttccccgg

SEQ ID NO: 90464 - DNA, 728 bp, Homo sapiens
  misc_feature: GYAE6OF02GO18G.21.8.A08.1.454.CMB.1.raw
tcagtcgtcgctcgcacgaccggtgctcgatttagcatactctacagggggctgtgggctcaggaggcagagctctgggaatcgtcaccatggcctggacccctctcctgctccccctctcactttctgccacagtctctgaggcctcctatgagctgacacacgcccaccctcggtgtcagtcgtccccaggacaaacggccgaggactcacctgctcgtggatcttcattcgaaccaaaagtaatattaccgttgttcggttaccagacagaacgttcgacggcctacggtcccctagtaccgtggtacctacgtaccagtacggacggcgacggttccgacgaccgtaccgtacccggactccccgtagacgtacgtacttcctcgtccacctcacggtacctcggaacggggtactagggtaccgtacccgtaccgttacgtaccgttacgtacggtacgggtccggggtaccggtagggtacgggaacggtagtacggaacgtcgtacgtaaccgttacgttacgtttacgttaccgactaccgacgacgtagtacggtggtacgtacgtacggggtagggttacgtaccgggacgggtaacgggtacggttacggttaccggtaccggttccggttacggttaccgtaaccggtacccgtaaccggtccggtacccggttcccccggttacggtacccttacccggttcccgtttcccccgg

SEQ ID NO: 90465 - DNA, 1133 bp, Homo sapiens
  misc_feature: GYAE6OF02H0AAY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctctactttctgcacagtctctgaggcctcctatgagctgacacacgcccacccgtcggtgtcgagtcgtcccgaggaacaacggccaggtatacacctgcctcgtggagtcttacacgttacgaaccgtaaaaagtaacttaacgttaacgtttcggtttacggttacccgaggtaaccgtaaagggtaacggttaccgaacgggtaccccgtaacccgggtccccccgtttaggttaacgtttccgggtactaaccgttacccgaagggttccgggaaccgggtacccggtaaccgggttacccggaaaccccggtaaaccggtaaccccgggttaccccgggggtaaccctttacccccgggtagggaaacggttaacgttaaccgtttacccgttccgttacccggtccccgttaccgtaccgggtacccttaaccggggaaacggggtaccgttaaccgggttaccgggtacccccgtttaaaccggttcgttaaacccggtttacggttaccggggtaacccggggggtacccgggggtacccccgggttaaaggggttaccggggaaaccggttaacggggtaaccggtaacgggttaccccggttaacggtttaaacccgtttaaaccgtttttacgggttttaacccgggttaaaccccgtaacccggtaaaccccgggtaaacgggtaaccgggttaagggttttaacccgggttagggtttaaccggttaacgggggtttaaccggggtttaggggggggtttaacccggttacccggggggtaaccgggggttaacgggggtttaaaaccccgggttttagggggttacccccgggttttaacccgggtttacccggggtttttacccggggaaaccccggggttaaccccgggtttaaaccccggggtcccggttaccccccgggttacccccgggtttccccccggttaacccgggttttacccccgtttacccggtttcccccggttttaaccccccggg

SEQ ID NO: 90466 - DNA, 888 bp, Homo sapiens
  misc_feature: GYAE6OF02F19J1.21.8.A08.1.454.CMB.1.raw
  modified_base (123)..(123): a, c, t, g, unknown or other
  misc_feature (123)..(123): n is a, c, g, or t
  modified_base (131)..(131): a, c, t, g, unknown or other
  misc_feature (131)..(131): n is a, c, g, or t
tcagtcgtcgctcgcacgaccggtgctcgatttagcatactctacagggggctgtgggcgtcaggaggcagagctctgggaatctcaccatggcctggacccctctcctgctcccctcctccncttctgcnctagctctgacggcctcctatgagcgtgacacagtcccaccgtcggtctacgacgtcgtccccaggaaccgaaaaccggccgaaggactcaaccgtcggaccttcgtggtaacggacttcctatttcgggaaaccctaaaaaaggaactaaacgttaaccgtttagtttacggtttaccgtaacggttacgaacgtaaagttaaccggtaacggacccgtaacggtcccccgttaacgttaccgttacgttacggggggtactaccgtaacttacggaacggtccgtacgtaaccggaaccggtaacccgtaacccggtacccggtaaccgttaccccggtccggtaagggaaccggtaaacttccgttaccgtaccggtcccgttacccgtaacgtcccgttacgacgggtaaccgtaacgggtacggaacccgttacccgttacgtaaccgtacgtaccggtacggtaccgggacccggtacgggtaccggggacgggtaacgttaaccggtaagaccggtacggtaaccgttacgtaaggtttacgtacccgttaccgtaaccgtaccggaacgttacggtaacgttacggtacggtactaacgggaacggggtttaggtacccgggtacgggtacggggtaaccggtaggttaacggtacccggttaaccggttccgttaacgtaccgggttaacccgaccgggtaccggtccggtaccccggtacccggtccgtaccggtcccttaacccgg

SEQ ID NO: 90467 - DNA, 737 bp, Homo sapiens
  misc_feature: GYAE6OF02FHU0W.21.8.A08.1.454.CMB.1.raw
  modified_base (188)..(188): a, c, t, g, unknown or other
  misc_feature (188)..(188): n is a, c, g, or t
  modified_base (227)..(227): a, c, t, g, unknown or other
  misc_feature (227)..(227): n is a, c, g, or t
  modified_base (356)..(356): a, c, t, g, unknown or other
  misc_feature (356)..(356): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcctacttttctgccacagtctctggacggcctcctatgagctgaccacacgtcccacccttcggtntccagtcgtcccccgaggaccaacggccaggctccaccngtctcgtggatacttcattcgaacaaagtatacttacgttggttacggtccagcgacgtaacgtcgacggcccacgggtccccctaggtaccgtgtccacgtccatcggacgccaggtccgacgtaccnccggttaccgggacctacccgtaggacgtacgtacttccgtacgtcctccctaccgtacgtaccgttacgggaacgggtaaccacgggttcccgtaaccctacccggtttagaacctacgtacgtacgggtccggggcccggtagggacgggacgacgtaaggtaccgtcgtacgttaccttacgttacgttaccggttaccgaccgaaccgtacgaagttacggtacggtgttaccgtacggtacgggttaggggtaccgtttccggggacgggtaaccgggacgtacgtaccggtacccggttccgtaccggtacgacccgtacccggacggtcccgtccggcccccggttacgtacccgttcccgtaccgttccccgg

SEQ ID NO: 90468 - DNA, 624 bp, Homo sapiens
  misc_feature: GYAE6OF02FNWON.21.8.A08.1.454.CMB.1.raw
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (431)..(431): a, c, t, g, unknown or other
  misc_feature (431)..(431): n is a, c, g, or t
tcagtcgtcgctcgcacgaccggtgctcgatttagcatactctacagggggctgtgggctcaggaggcagagctctgggaatctcaccatggcctggacccctctcctgctcccccctcctcactttctgcacagtctctgaggcctcctatgagctgacacagcccacccgtcggtcgtcaggtcgtaccccaggaaccaaaccggccaggatccacctgctcgtgggagtattcattcgacctaaaaagatactacttgttcgtaccagacaagacgtcaggccacggcccctgtactggtacattccagtcggaggtccagtacgacggtaccacgttccggactccgtagaggtatcttctctcgtaccctccaggtctacgacggacgngtcggaccctacgttnactatcgtacgggcggccggngggtcggacggtagtagacgtcgtacgtacgttacgttacgttacgttaccgacgaccgtagacgtaacggttaggtcgtagtacggtacggtaggggttacgtcggacgggtacggtaccgtaggtacgtccggtcgtcgtcgacgtaccgtacggccgtccgtcccggttcggtcctacgtccgttacccg

SEQ ID NO: 90469 - DNA, 766 bp, Homo sapiens
  misc_feature: GYAE6OF02HPJLR.21.8.A08.1.454.CMB.1.raw
  modified_base (133)..(133): a, c, t, g, unknown or other
  misc_feature (133)..(133): n is a, c, g, or t
  modified_base (179)..(179): a, c, t, g, unknown or other
  misc_feature (179)..(179): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacngtctctgaggccctcctatgagctgacacacgcccacccgttggtntcagtcgtccccgaggaccaaacggccaggactccactgctcgtggatacttcagttacgaaacctaaaaagtaattacgttacgttttacggtttacggttacccaggtaccgtaaaggtaaccggttacgaacgggtacccccgtaccgggtccccccttaggttaacccgttcggtacctaacgttacccgtagttaccgggacggtaccctaggtaccggaacccgtaccgtacccggtaccgggaaccttacccgtaggaagtacgtactttcccgtcttccgaccctccgtacgtccgtacggaacggtaccgtacgtccggacccttaccgttagaccttcgtacggacgggtccgggaaccgtagggtacggaacgtagtaggaaccgtcgtaacgtacttaacgtttagtacgttaccaccgtacgaacgtacggagtacgtcggtacgaggtaacgggtcgggtacgtcgggaacggacggtaacgtaggttaccggtaccgttcgtacggtaccgaaccggttaccgacggtccctacccggtacccgtaccgtaccctacgttcccgttaccccg

SEQ ID NO: 90470 - DNA, 734 bp, Homo sapiens
  misc_feature: GYAE6OF02GYXF4.21.8.A08.1.454.CMB.1.raw
tcagtcgtcgctcgcacgaccggtgctcgatttagcatactctacagggggctgtgggctcaggaggcagagctcgtgggaatctcacccatggcctggacccctctcctgcctccccctcctctactttctgccacagtcctctgacggtccctccttatgagctgacacgacgcccacccgtcggtgtccgacgtccgtccccgaacggaaccgaaaccgggccaaggtactccctaccgtcgtccttgtggaactacttcgaacgttcgaaacctaaaagtaacttagttaccgtttggttcgtaccgagtacgtaacggaacgtccgacggtacccgtacggtccccgttaggtacgtcggtacctaacgttccgaagtcggtacgtccgaacggtcaccggtactacccggtccggaacttcccggaggaacgttacgtaccttcgtcgtccgtccaacgttcgcgtacggcggtactacgtcggaccctagtccgagttacgcggtacgtcgggtaccgacgggttacgacggagtcgaacggtctaacgttacgttaacttacgttcgtaccgcgtaacgaagtaccgtaggtacgtgaccgttgtacggtacggggtactacgggaccggtacggtaaccgtgtaccggtacccggttcggtaccgtacgacccggacgtaacggcccgttcccgtacccgtccggtaccgtccgtccgttccccg

SEQ ID NO: 90471 - DNA, 679 bp, Homo sapiens
  misc_feature: GYAE6OF02JHM26.21.8.A08.1.454.CMB.1.raw
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgacggcctcctatgagctgacacacgcccacccgtcggtntcgagtcgtccccgaggacgaaaccggcaaggatccacctgctntggagtatcatcgaaccaaaagatattacttgttcggtacagcgagagtcgacggccgaccggccccttagtacgtggtacatccgtagcggacgccgagtacgaaccgacgacgtccgggacttccggtaggacgtagtactacgtcctcgccctacgtacgcgtacggagggacctacggccggtaccctaccgttcggaacttacgtacggtacggggtacccggggtacccggaggggttacgggaaccgtagtacgggaactcggtaacgttaaccttacgtttacgtttaccggtacgacccgtaccgagttacgaggttcgtacgtacgttaaggtcgggtaggggttagaccgggtcgggaacgtacgtacggttcgtaccggttcggtcgaccggtacggaccgtacgtccgtcccgttccccgtaggtccctacgttccgtcccg

SEQ ID NO: 90472 - DNA, 607 bp, Homo sapiens
  misc_feature: GYAE6OF02HLTCP.21.8.A08.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctctgganattcattgaccaaaagatatacttgttggttccagcaagaagtcaggccaggcccctgtacgtggtcagtccatgagccagtcgacgacacgtccgggatcccgtagagagtattctcgtcgcctcagctcgaggacagtcggcctacgttgactagacgaggtcggggacccgagggtacggaacgtagtaggaacgcgtagtaacttaacttagttacgttaccgactaaccgagactaggtaagtcgtacgagtcggtaagggggttagttacggggacgggtacgggaactagggttccggtacccggtttcgtacggtacgtaacggacccgtaaggtccgtcccggtcccccgttaggtaccctaccgttccgtaccccgg

SEQ ID NO: 90473 - DNA, 818 bp, Homo sapiens
  misc_feature: GYAE6OF02G6MF9.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccctcctcactttctgcacagtctctgaggcctcctatgagctgacacacgcccacccgtcggtgtcagtcgtccccaggaccaaaccggcaggactcacctgctcgtggatattcattcgaaccaaaagtatattacgttggttcggttaccagcagaagtcgacggccacggccctgtacgtgtacatcagtcggacggccaggtcgacgacaccgtccgggactcccgaggagtagtacttccgtccgacgtccctaccgacgtccgtacggacgggtaactacggtacccggtacccttaaccgttcgtaaccttacgtaccgggtacggggtccggggaccccggtaagggggtacgggtaacggtaacggtacgggaacggttaccggttacggtaaccgtttaaacggtttacgttttacggttaaacccgtacccgtaaaccggtaacggtaaccggtaagggtttacgggttaccggtaacggtaacggttacgggggttaaacggggggtttaaccgttccgggggaaaccgggggttaacggggttaaacccggttacggggtttacccgggtaacccggttttcccgggttaccgggtacccggtaacccggtacccggtaaacgggttcccggttaccccgggtcccccggtttacgggtacccgttaccggttccccggtttacccccggg

SEQ ID NO: 90474 - DNA, 694 bp, Homo sapiens
  misc_feature: GYAE6OF02IFTIP.21.8.A08.1.454.CMB.1.raw
  modified_base (287)..(287): a, c, t, g, unknown or other
  misc_feature (287)..(287): n is a, c, g, or t
  modified_base (393)..(393): a, c, t, g, unknown or other
  misc_feature (393)..(393): n is a, c, g, or t
tcagtcgtcgctcgcacgaccggtgctcgatttagcatactctacagggggctgtgggctcaggaggcagagctcgtggaatctcaccatggcctcggacccctctcctgcctccccctctctactttctgcacagtctctgacgcctcctatgacgctcgacacacgcccacccgtggtgtactcgtcgacccgaggaccgaggaccggcaggtactaccacgtcgctcgtgacagtagcgtactacgaacaaagtaatcgtgtacttagtacgaacaagaagacnccgagccgaccgccgttagtgttacgtagaaattaagtaaagaagtctacgaggaacgaccgtaccctaaggacgacgtaccttccgaggtacgtactacgttccncgtacgcctacgacgccgtaaacgacggacgacgtacgtacgtaccttaaggttcgtaactatacgtagtaccggtaagacccgagacggaaggacggttacgacgtacgtagttaacgttacgtaactacgtaaaccgtaaacggtagtaacgttaaagaggtttaacggtacgttaacgtcggttaaggttcgggttacggtaaccggggaccggtaaacggtaaccggtacggacccgttaaccgtaccgtacggtacggttacccggaacccggaccggtaccgtccgtacccccgg

SEQ ID NO: 90475 - DNA, 737 bp, Homo sapiens
  misc_feature: GYAE6OF02HB3TL.21.8.A08.1.454.CMB.1.raw
  modified_base (131)..(131): a, c, t, g, unknown or other
  misc_feature (131)..(131): n is a, c, g, or t
  modified_base (185)..(185): a, c, t, g, unknown or other
  misc_feature (185)..(185): n is a, c, g, or t
  modified_base (240)..(240): a, c, t, g, unknown or other
  misc_feature (240)..(240): n is a, c, g, or t
  modified_base (562)..(562): a, c, t, g, unknown or other
  misc_feature (562)..(562): n is a, c, g, or t
  modified_base (567)..(567): a, c, t, g, unknown or other
  misc_feature (567)..(567): n is a, c, g, or t
  modified_base (582)..(582): a, c, t, g, unknown or other
  misc_feature (582)..(582): n is a, c, g, or t
  modified_base (707)..(707): a, c, t, g, unknown or other
  misc_feature (707)..(707): n is a, c, g, or t
tcagtcgtcgctcgcacgaccggtgctcgatttagcatactctacagggggctgtgggctcaggaggcagagctctgggaatctcaccatgggcctcggacccctctcctgcctcccccctctcactttcncgcacagtctctgacggtccctctatgacgtctgacacacgcccaccctgggtntccaggtccgtaccccgaggaaccaaacggccaggactccacgtgctcgaggtanacttacacttaggaaccaaaagattacgtacgtttaggttcgttaccaggacagtaacgtcgacgtccgaccggtcccgtaggttcgttcggtactactccgtaagtaggaacgggaaccggaggaaccggacccggtaccccggttaccgggcctaccgtaggacgtaacgtcgttctcgttacgacctacgtaaccgtcgggaacgggtaccgtcgggtacctaacggtttctacgtttcccgtggacggggtccgggaaccgtggggtaggtagggaagtcggacgtacgtacggaacttaccgttagttacgttaccncgtanaccgatacggacgtntacggggtctacggacgacggtaccggggtctaacggggttcggaaccggggtacgaccggttaccgggtaccgtaccgggtagtaccggtaaccgtaccggccggtacggaccttcccccgggngtacccgggtctacccggtcccggtccccg

SEQ ID NO: 90476 - DNA, 817 bp, Homo sapiens
  misc_feature: GYAE6OF02JKLR1.21.8.A08.1.454.CMB.1.raw
  modified_base (769)..(769): a, c, t, g, unknown or other
  misc_feature (769)..(769): n is a, c, g, or t
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacggcctctatgagctgacacacgccctaccgtcggtgtcgtacgtcgtacccgaaggaccaaccggccaaggtactccgacctcgtcctcggtaggacgtattacgtagttacgaacctaaaaagtacttacgttaccgtttggtttaccgttacctacgacgtaaacggtaacttccggaacggtcccgtaacggtacccccgttggttaaccggttcggttaaccaccttaacgtacggtaacgggtaccgtaaccgtacggttaaccggaaccgtaaacccgtccgggttacccggggaaccttcccggttgggaaaccggtcgttaaccttccggttcgaccgtttaccccgacggtaacggtacccgttaacggacgggttaaccgtacggttacccgggtacccgttacttaacggtaccgtttaacgcggttacccgggggtaccgggcccgggtttaaagggccggaacgttgggtaaacgtccgtacggtaactacggttaccgttttaagtccggtaaccacgttaccgagtaaccggtgttaggtacctggtaacgtacgggtacggttcgacggaacggggtacgtaacgttcgtacggttacccgtggttacnccggtacgaccggtacgtccaccgtccgtactccgtactcgtaccccg
